United States Patent 7,560,542 (NUCLEIC ACID MOLECULE SEQ ID NO. 68811 AND OTHER MOLECULES ASSOCIATED WITH PLANTS) - sequence listing, part 3

SEQ ID NO: 12824 - DNA, 597 bp, Zea mays
  Clone ID: cC-zmpo14820012h12d1
ctgaaaacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgacagggcatgtaactactacgtaccaactggaatgcatgtcgacgacgatggtttccagtttcgacttccataatagtacaacaaagcaaggcctttctcccgcgtattgctttgctcttctctcacg

SEQ ID NO: 12825 - DNA, 520 bp, Zea mays
  unsure at all n locations
  Clone ID: cC-zmpo14820013a01a1
gaccaaaaaaaatttatattattcattcataagacatcaataaccaatgacaatccgaagtagcctcatcaggcgtctcattagaattgaatggaccttaacatattgtgtccaaaaatcacaagtgagaagcataggtagcgacagttattgcggtcttgatgaataggggaggaaagcggcggccgatagaccggcacaaaactttgttcgcgctaatgaagaaacggcaacgaaaacgggggcaggagaggctggcggcggtaacggctcccccacggcttgcatttctcgggcccaaagaattagaagcatttcctgtggacgatggatgggccggactcgtcgtactcggccttggcgatccacatctgctggaaggtgctgagggatgccaagatggatcctccgatccagacactgtacttcctctctggaggagcgaccaccttgatcttcatgctgctgggagccaaggcagngatctccttgctcatcctgtcagcgatgccagggaaca

SEQ ID NO: 12826 - DNA, 639 bp, Zea mays
  unsure at all n locations
  Clone ID: cC-zmpo14820013a01d1
cgtccgcggacgcgtgggaagctgccggcatccacgagaccacctacaactccatcatgaagtgcgacgtggatatggggaaggacctgtacggcaacatcgtcctctccggtggcaccaccatgttccctggcatcgctgacaggatgagcaaggagatcactgccttggctcccagcagcatgaagatcaaggtggtcgctcctccagagaggaagtacagtgtctggatcggaggatccatcctggcatccctcagcaccttccagcagatgtggatcgccaaggccgagtacgacgagtccggcccatccatcgtccacaggaaatgcttctaattctttgggcccgagaaatgcaagccgtgggggagccgttaccgccgccagcctctcctgcccccgttttcgttgccgtttcttcattagcgcgaacaaagttttgtgccggtctatcggccgccgctttcctcccctattcatcaagaccgcaataactgtcgctacctatgcttctcacttgtgattntcggacacaatatgttaaggtccattcattctaatgagacgcctgatgaggctacttcgcatgtcaattggtattgatgcttatgaatgataatataaatttttatgtcac

SEQ ID NO: 12827 - DNA, 415 bp, Zea mays
  Clone ID: cC-zmpo14820013a02a1
cagacccaaattaaagtacttaaatatatatataaacggaatccaaccgaatacaggcaatggcagccagcagcatctccctccgaccctcctttaattttactgcaggtagtcggcgaagaaggagagcacggaggcgcccagcacggcgccgacggccggaaacacagccgaggaggcgctggtgggggcgggcgcccgggcctcggcggcgaggaccacagaggcggaggcggcggcggcgaggacagagcatgcgaccttcttcatctccatcgcgacttgatgtggtttgccggagccgaagggagcgtcgtcgggatcgagacgagaacgaagggcacgcagggttattagcaagatggatcaacggatgatcacacttgctattattggttgcgcccttgcctgtggc

SEQ ID NO: 12828 - DNA, 416 bp, Zea mays
  Clone ID: cC-zmpo14820013a02d1
gggcacagggcgagggcgcaaccaataatagcaagtgcatcatctttcgatccatcttgctaataaccctgcgtgccggtcgttctcgtctcgatcccgacgacgctcccttcggctacggcaaaccacatcaagtcgcgatggagatgaagaaggtcgcctgcgccgtcctcgccgtcgccgactacggcaccgtggtcctcgccgtcgaagcaccggcgcccgcatccaccagctcgctctgagtcgcgttcccggccgtcggcgccgtgctgggcgcctccgtgctctccttcttcgcctactacctgcagtaaaatgaaaggagggtccgaaggagatgctgctggctgccattgactgtatgcgacaggattacgaccatctatatattcaactactttaatttgggtctg

SEQ ID NO: 12829 - DNA, 519 bp, Zea mays
  Clone ID: cC-zmpo14820013a03a1
caaacatgaaacccttcacctgcttgtttccgcgcgcgcatcctacgaaagcatcattagcaaatcccatcattgcgtgtgcactacttttgacctgaagcacaggccggatgtcatttctaaagggcaaatcgtccgactccaagcgaaagcttgtggtgtaccataagtagtcagtatcgtccttggtttggttatattgctctaggggttcctttgtcctgactttagtatcacgatactttgggatcgtttctgagaacatctcccactggttattcttgcttgttacatctgaggtatggaatgacctttcactgtgttgtacaaacactctcttggtattgtaaactacgttcttgcacccagcaagaatggagacagaacggctaggcacatagtgcttatcccctcggaagatcactgttccgtctttgcccgtgttattgttggaaaggaaagagaggcatatcttttcttcaggcaactcaagatgtgtgcctcatacccatgacccaa

SEQ ID NO: 12830 - DNA, 563 bp, Zea mays
  Clone ID: cC-zmpo14820013a03d1
gggcggagtggagcgctacgaagaaaggcagcgtcgtcttctactatgggcgctctctcatgatcgacggcagtcggggcctcttcttctccggcgccatccactaccctaggagcccgcctgagatgtggccgaagctgatcgagcgggccaaggagggcggcctcaacacgatcgagacgtacatattctggaatgcacacgagcctgagcctggcaagtacaattttgaaggcaggttcgacttgatcaagtacctcaagatgatccaggagcatgacatgtatgcaattgtgcgcatcgggcccttcatccaggcagaatggaaccatggtggactgccgtattggcttagagagattgaccacataatattccgggcaaacaatgacccgtacaagaaagaaatggagaaattcgtgagattcatagtgcagaagttgaaggatgctgagttatttgcatcgcacggaggacccatcattctaacacagattgagaatgagtatgggaacataaaaaacgatcatgcaacagatggtgacaagtacctcgagtgggca

SEQ ID NO: 12831 - DNA, 387 bp, Zea mays
  Clone ID: cC-zmpo14820013a04a1
gaaccactgaatatggattgaatgaatctggttaatatatacagggattggactaaatgcctgtcctatccgaacagcgctactcgtttacacatcagagcagctcgtctacaggcaattctgcttcccaggttcattcattaataatgtggtgaatggctaccgaatcatgttctgatgatggcaacacaggcgcctctgtaggccagcagtggagggagtttaggccgaggtcccgccaagctgtgtggccatgcgaaccatttttatcatccagccacaagggcccgttgatccgaactaatgaagccactgcatgctggatgttgacatatatacaggtgacgtggacaccgctaggtgctttggagatcatgacgcgcctac

SEQ ID NO: 12832 - DNA, 559 bp, Zea mays
  Clone ID: cC-zmpo14820013a04d1
gcgcccgagaaaggcaaggagagtgggaaggtaggagagagaggttgacattgaaagctctcttcctcctcctcctccgctcgggttccgtctcttgtccctgtcgtcctcgcccggtttccccggtttttgagaggggaaagaggaggcggaggagagggatggggagggacgagaggttcccggtgtgggaggccgcgctcggcgccggagtcgccgacggcttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgattgctggtgctctgattgggcaactgcctgtcctcgcgcctgtggtctttgctgtcactgcacgagcttcttcgtgctatttcctgtcgaagatgattgggaagccactggagttcacact

SEQ ID NO: 12833 - DNA, 511 bp, Zea mays
  Clone ID: cC-zmpo14820013a05a1
cagattgatcacaactggttaagatgtcatttgaatttgcacattgatttacatttttttaactccggcaccgtatcggagtgcatgagcgaaagaatgaatatgcatgcatgatgcatgttatcatccgtatggctgcttgctggcatgcaggttgaagaagaggagggaaagtggctacttagaagttcttggacgcctggtacgtgacgccgaacttccagtcagcggggagaacgtgccatgaggtggccttgcggtggtcgctggtcatcacccggaacgtcagtgactcgcaggtgaggtcctccccggtctgccacacttgcccccagttgcgcttcatctccgtccacttaacgcgcttgctccccttcaccgacaccgccgagatgtcgccggcgccgcctacgttggtgatcgtcaccatgttgaagtacttgttcccggtgatggtgtaccggatgccaccctgcttcgtgcacgccaccctgcggtaggagatgggcac

SEQ ID NO: 12834 - DNA, 520 bp, Zea mays
  Clone ID: cC-zmpo14820013a05d1
gggttcgtggatgccggcgccacagcctctcctgctgattctgtttgtcgccgtgctagcggtggccgccgagatcggggacgccggccacgccaagcccctgacgcctggcgggcgcgtggtacaccacaaccacggcaagttcacggccgggccgtggaaacccgcccacgcgaccttctacggggggcgggacggatccggcaccacggaaggcgcatgcgggtacaaggacacgcgcgcgcaggggtatggcgtgcagacggtggccgtgagcacggtgctgttcggagactgcgcggcctgcggcgggtgctacgaggtgcgctgcgtggacagccctagcgggtgcaagcccagcgcggcgacactggtggtgactgcgaccgacctgtgcccgcccaacgaccagcagtccgcggacagcggcggatggtgcaacccgccgtgggagcacttctacctcagcatgcccgcgttcctgcagatcgcacaggagaaggccggcatcgtgcccatc

SEQ ID NO: 12835 - DNA, 358 bp, Zea mays
  Clone ID: cC-zmpo14820013a06a1
aaacccccaaaaaaaagaggggtttttaaaccccctttcaggggtttggggggggcttccaagaataccccaaaagatttttccggggggttttatttgggtaacccccacccaaagggccttttcccttccctagggttcctttggctttggttttttggaagaaataatttcccccgcccccccaggaaggggttttttaaacggggggggcaaaacacggggggaaaacgggcccttttttttttttaacccgggggggggtaagaaggggggaaggggaggcccaaaaccttttccaaaaggagggggttttcgggaattttttattttttccgcaagaacccgcccgggaaaa

SEQ ID NO: 12836 - DNA, 546 bp, Zea mays
  Clone ID: cC-zmpo14820013a06d1
gccgcggttcggaccttatcagatcgcttcgatacgtttgaagagcatagactccctcacctggcaggtgtaccttttggcgtcgggatggggcctggacgtggtcgccggagatgaggaagacgtacaacctactggacacggtgagccggcacacgatccaggtgtacccgcggtcatggacggcatcatgctgacattcgacaacgcgggcatgtggagcgtccggtccaacgtctggagcggactacctcgggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccgttttcacctcgggttctgaccatccagtctaactaatccattcctgtgctgctcggcgaaataaaatcatcataaagaacatagacgaaggaagcctagggaagggagaagggacgttggttgcggtgagccaatgagacg

SEQ ID NO: 12837 - DNA, 374 bp, Zea mays
  Clone ID: cC-zmpo14820013a07a1
aggacagaccaaaagtcgggctatgttgagggataatatatttattttgcaggcgctccatccttgattgaccgtatcaaggattgccaatcaggtttcccttggccgtgggcctggcccaatctgaagctttctggcaacaatgaagaagaaggaaagatcatccttatgtgctacactcataatcggagcttgctgggatacgcaaataccaaatcgcttccatcacacacaaaacttgttttctggtgggcgtgagcaattcactgttgtttgcttgtaccaacgaaagaaaccccagctcttattgctattttcaatgcatgcaagcagcgcccccagactctcaagaggctcctgcacggacttttttg

SEQ ID NO: 12838 - DNA, 517 bp, Zea mays
  Clone ID: cC-zmpo14820013a08a1
gaaaaatgaactatataaacacaggcacacatctattctgaatggttgccctgctcgtgaccatacatctcctcgtctcttgtcaatctagcggcgcggtgctgccatctgccttacggctttggcggagggcagtgcagcagttgagtgattacattacattaatctcagattttgagagcttcgccataggtagatttgaatcccggatctgcaacagtatgcactgcagtgatgtttcaactattttactccgatcccaagctaatcaggaccaaccaacccaataggctattaggccgaaataaataaggcatgtctgtgttcgttatgggccccacacaaggtacccagcccaactcaaatgactataaggctataattagccttaatctgccttttttcagtaaagcggcaagattatgcatacacatggctacaaatcatattcagacaagtttccacgatcctcctgtagtcctgtttacaacgaaagttagctccaagatgcagcgca

SEQ ID NO: 12839 - DNA, 537 bp, Zea mays
  unsure at all n locations
  Clone ID: cC-zmpo14820013a08d1
gcttttcgtttggaggatgcgctgcatcttggagctatctctcgttgtaaacaggactacaggaggatcgtggaaacgtgtctgaatatgatttgtagccatgtgtatgcataatcttgccgctttactgaaaaaaggcagattaaggctaattatagccttatagtcatttgagttgggctgggtaccttgtgtggggcccataacgaacacagacatgccttatttatttcggcctaatagcctattgggttggttggtcctgattagcttgggatcggagtaaaatagttgaaacatcactgcagtgcatactgttgcacatccgggattcaaatctacctatggcgaagctctcaaaatctgagattaatgtaatgtaatcactcaactgctgcactgccctacgccaaagccgttaggcagatggcagcaccgagccgctagattgacaagagacgaggagatgtatggtcacgaacagggcaaccattcagaatagatgtgtgcctgtgtntatatagttcatttttaaac

SEQ ID NO: 12840 - DNA, 397 bp, Zea mays
  Clone ID: cC-zmpo14820013a09a1
gatgtatgcataatgatttcttatatctgacaatgtgtataagtgacaatatttaacattaatagcaaagtacgtatgtcttaattgtaatttaaacggggatgagatcccgttggggatttatccccgcgaggaacagggataaggaagaaatattcttcgcaaagcgttcgtaggatccctgcagggaagttttttcgtcgcggggacggagacggtgagctatttccggcggggaactccccgttgccatcagttgaggagccagaccccccggctggtgcaacgtactcggagaggagctcgcctaccgctacggcggcgtgctagctgcgctcttccaactccggccgcgtccttaccaccttcgccgatggcatcttgttcccgggcaccg

SEQ ID NO: 12841 - DNA, 555 bp, Zea mays
  unsure at all n locations
  Clone ID: cC-zmpo14820013a09d1
ggttccgatcctctgcgccgtcgcgatggcggcctcctttcgcctttgccgtcacacgccaccgcagagctagcntcggtctaagacaaggcgggcaatggccaaggcgcccctgccgcttccgtcgctgctcgtcctcgccgccttcttcttccaccacccctgctgcacggcgcagggccgcgccgaaaacatctcggaggtcgaggccgcggtccgcgcccgcgcgtccgagctgctccgcgacgccaccagccagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgcctcgccatcgtcttcgagctcttcgtgggaaactcgacggccgcgttcgccgcgccgcgcggctacgcgctggccacgcccgtggccggcctccttgcgtacgacgcgtcggcggtgcccgacgcgcgcgtctcgctccgggc

SEQ ID NO: 12842 - DNA, 358 bp, Zea mays
  unsure at all n locations
  Clone ID: cC-zmpo14820013a11d1
gagtcatctgctccatcaccaccaccaagctcatttacagttttctcgcgaaaataatgaagagccgggcatggtgtatctgcncgctcttgtcctagccctcgcgctagtggcggccaccgccccacaggtagcggaggcaaagaagaagagagcggcggagagcggcgaggcggcggaggcgaagaacatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccggccatg

SEQ ID NO: 12843 - DNA, 265 bp, Zea mays
  Clone ID: cC-zmpo14820013a12d1
cggcgccgctcgagctcgtcctcctttaggagcgagagtgtgggctcggctgctgcgaatccctgggcttcgcaagagggagtcatggacggagcaagcatcggagagacctccttcagggacacgaaaagcgaggcgggcggtggcgacgactccccgccgtcccccgccacgcgccggacgagacgacagcaccgctctcgcggctcggccacctcctccatggacgacaccaccggcggcgagggcggcgccgaggagaagg

SEQ ID NO: 12844 - DNA, 451 bp, Zea mays
  Clone ID: cC-zmpo14820013b01a1
acatggacaacacaacattcatggatccttttataaaaaatgaaggcctatcaaatatttcattaggcacttattatataacgtgtcaatccatttcttaactctgatcttttaaacaacagcgaagtctcactctagctatatatggagatgaagaagatggagaaggaggatgacaccatcattgttggcgccagcatcactgtcataatagggtagtggtagcaaatagatatcacggtccaatgcatgcatgtgtaatgcattgcttgggatccaacccaatctagtatagctagcataggtcagcttaaagtattgtcagcactaaagttaattatttggcggtgtaggcggtgttggccttccagttggcagggatgacatcgtcgtagacggacttggtgcctccctcggtagtgaggcggacggtgaggggtcccttaagcgg

SEQ ID NO: 12845 - DNA, 451 bp, Zea mays
  unsure at all n locations
  Clone ID: cC-zmpo14820013b01d1
gccgcttaagggacccctcaccgnccgcctcactaccgtttgatttccaagtccgtctacgacgatgtcatgcctgcgaactggaaggccaacaccgcctacaccgccaaataattaactttagtgctgacaatactttaagctgacctatgctagctatactagattgggttggatcccaagcaatgcattacacatgcatgcattggaccgtgatatctatttgctaccactaccctattatgacagtgatgctggcgccaacaatgatggtgtcatcctccttctccatcttcttcatctccatatatagctagagtgagacttcgctgttgtttaaaagatcagagttaagaaatggattgacacgttatataataagtgcctaatgaaatatttgataggccttcattttttataaaaggatccatgaatgttgtgttgtccatgt

SEQ ID NO: 12846 - DNA, 443 bp, Zea mays
  unsure at all n locations
  Clone ID: cC-zmpo14820013b02a1
agtagtaactgccagcatgcctttttattattacccattcaatcgatgaaaaacacacatttgcgtgacattacatttggagttccatcgacggtatatttggaaaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatggttcattcatttcaaggggcttcgcttcaagaaggaggaggggtgcaggacctcttgcagttctcgctgaggcgcgggttcttctccttggcgcaggtgacgctgcaggccttggtgacctcggncgccttcaccacgtacgccttgtcgcactcctcctggca

SEQ ID NO: 12847 - DNA, 572 bp, Zea mays
  Clone ID: cC-zmpo14820013b02d1
gcgtccgcgagtatatagccgcggccgaaaggccaccaatctcatttacagccagctcgcgaaaataatgaagggccggggcatggcatcatcgggcgcgctcttggtgctagccctcgcgctagtggcggccaccgtcccacaggtagcggaggcaaagaagaagagagcggaggagagcggcgaggcggcggaggcgaagaagatccaggacgacttctgctcgacgctgtgcgagggcaagaaggggacggacctggtcgagtgcaaggagtcctgcgcgctctcccagcagtccaacctggtgctgtacggcaggatccagtgcaagggcaagtgcaccgagcagaaaggcatcacggcgccggccatgaaggtctgccaggaggagtgcgacaaggcgtacgtggtgaacgcggccgatgtcaccaaggcctgcagcgtcacctgcgccaaggagaagaacccgcgcctcagcgagaactgcaagaagtcctgcaccccttctccttcttgaagcgaagtcccttgaaatgaatgaaccatgcatgcatgcatgtatgcatgcgccg

SEQ ID NO: 12848 - DNA, 276 bp, Zea mays
  Clone ID: cC-zmpo14820013b03a1
gcatcaaacaaaagaataatttaggctcagcatgatgcaacatttcatgactcacataagttttgacaaaataaataattaaaccctcgcctaattcacttacttttaatcaaaaggaaaagagagagagagaccagaggtaacccctgaatttggttggtatttggagaagaaattttataccctcaaattcagggtgttacaccgtcgaacataatataactgtcggatgtctgtcgttttactgttgggcgttaccaatggatagcatctaat

SEQ ID NO: 12849 - DNA, 278 bp, Zea mays
  Clone ID: cC-zmpo14820013b03d1
cgattagatgctatccattggtaacgcacaacagtaaatttacagtcttccgacagctatattatgttcgacggggtaacaccctgaatttgagggtataaaatttcttctccaaataccaaccaaattcaggggttacctcttgtctctctctctcttttccttttgattaaaagtaagtgaattaggcgagggtttaattatttattttgtcaaaacttatgtgagtcatgaaatgttgcatcatgctgagcctaaattattcttttgtttgatgc

SEQ ID NO: 12850 - DNA, 414 bp, Zea mays
  Clone ID: cC-zmpo14820013b04a1
aaaacaactgaatatattattatatgtaccggctggatctggagacatgaatatttgaacagatgaattaaatggagacatgcttgcatgaaccaacagatcggagacatgaatcaaaccccgacgggctggctggctggtcgacggatgatcaacgccccatcccctgcgaggccggggggcacatggcgaccccggcgggggccctttgggcgttgaactcccagccgaggacgggctcgtagccgcgcgcctttagctccctgtactcctggcaaagcgcgcagtggaggcagcaaaggtggacgaggaagtcggcgcagggcgccttggggagcccgtgctgcgcgcgcagcctggtgcggtacgtgcaggaaaaggcccacgtgcactgtgaccccgacagccactgga

SEQ ID NO: 12851 - DNA, 499 bp, Zea mays
  Clone ID: cC-zmpo14820013b04d1
gcgcccgatgacgtcgtgcgggacgagcgcggcgctgttcgcgcttatcctgtggctgtcggggtcgcagtgcacgggggcctggtcctgcacgtaccgcaccaggctgcgcgcgcagcacgggctccccgaggcgccctgcgccgacttcctcgtccacctctgctgcctccactgcgcgctctgccaggagtacagggagctaaaggcgcgcggctacgagcccgtcctcggctgggagttcaacgcccagagggccgccgccggcgtcgccatgtgcccgccggcctcgcaggggatggggcgctgatcatccgtcgaccagccagccagcccgtcggggtttgattcatgtctccgatctgttggttcatgcatgcatgtctccatttaattcatctgttcatatattcatgtctccagatccagacggtacatataataatatattcagttgctttaaaaaaaaaaaatctctatcttatctgtaatataaaaa

SEQ ID NO: 12852 - DNA, 404 bp, Zea mays
  Clone ID: cC-zmpo14820013b05a1
accaggaagggcgggcgcgggccgtgggggggaaaaaaagggaaggacagggcccccacaaggggggggggcaaacccccccccaacgggggaggggggggcccccccgggaccccagaagggaaaaaggggggggggggggggggggggggcccccccaaagcgccggggggcccccccaaagcccgccgggggggggcccgggggaaggggggggcgggggggggcggggggggggcccgggggggggggggcggcccccgggggggggcccacaaggggaaaaagaaacccggggggaaaatgggtcgggggtaaacaccccccccccccggggggccccgaaaaaaaaaaaaaaagccgggggggggcaagcggggggcccaaaaaaaaaaaactggggg

SEQ ID NO: 12853 - DNA, 380 bp, Zea mays
  Clone ID: cC-zmpo14820013b05d1
gatcggagaccagcgcggcagaatgcatgcacttggtattatgtttcgttgggtgtcggaggcaagggggaggaccgagtcactgcatacacgagtggaaaatgctactgctgttcagtttaagttcgcgttgtacttgtatgtatagtggctgctacttatgtgagttttgtacctgtactgtacatgaagtctcttttcttttatataccatggctaagggggtgttgactaaaaaaaaaaaaaaaaaaaaaaaaaaaaaaaaaaaaaaaaaaaataaaaataataaaaaaaataaaaataataaataaattacttcaataagaattctttaatttatttatattactctattcctaaccttttctttattacttttt

SEQ ID NO: 12854 - DNA, 544 bp, Zea mays
  Clone ID: cC-zmpo14820013b06a1
accggcaaatctggaaacttgcagcgaactggaactcgtgaggtttcccatccgatatctttttcatctgtcgtaacaactaccactatacagagaccattgctctagggttgctttatcgtaagctcggctctcagatgcagcatcccatccacgaagaagaggctgtcatcggccaagaacttctgccatgggattgcaaagagattcctgtatccaacagcctttccaccggtgaatgtgtagttacccttgtacttgctcacaaactcgccggatggtctcgtccttgcagcgaactcgtagtccactgtcacactcgtggagcccttctcttgcatccccaggaagagcccgaagcagtagaacgcgctttgctgctccatgttacagtgagccgagaggaagaaaccctgccctgcaaggtggaacgcttgcgagtatatccgccctgcaggaaagagtcgagagcactcgtcgcgcttgagatccaagtatgctatgcactgtgggtaggggccgatcaaactcaacaactttgagt

SEQ ID NO: 12855 - DNA, 610 bp, Zea mays
  Clone ID: cC-zmpo14820013b06d1
ggtgatgaacatccgtcgtgctggaatcgaagccatcttttcaatttaatgacctccaggtggcatctgaagagaccatgtatgacttcttactcagatgggcccgtgcacaatacccgaaatcagaagagagacgtgaggtccttagttctcggctgctccctcttgtgcgattcagtcatatgacgtgtaggaagctgcggaaggtcctagcctgcacagatatagaccacgagcaagcaaccaagtgtgtcaccgaggctcttctgttcaaagctgatgcaccacaccggcaacgagctcttgcagcggacgcaataacctgccggaaattcgccgagcgggcttacaagtacagaccactcaaagttgttgagtttgatcggccctacccacagtgcatagcatacttggatctcaagcgcgacgagtgctctcgactctttcctgcagggcggatatactcgcaagcgttccaccttgcagggcagggtttctttctctcggctcactgtaacatggagcagcaaagcgcgttctactgcttcgggctcttcctggtgatgcaagagaagggcttcacgagtgtgacagtggactacgagttcgc

SEQ ID NO: 12856 - DNA, 471 bp, Zea mays
  Clone ID: cC-zmpo14820013b07a1
atacgcgatgattgattaaatcgaattgttgaatggattcaaacaaatggcaagcgatgatacaagtgttaatccctctctcagggggaagaacatcagcggcatgcatcaattcgttaaattaaggagaaagagggaacaaagaaaaagaggacaaaaggtgtgtcgaatcaaaaacatgcccacgcatcggaatgcgcgcagccatgtcactctctctcccgcttcgtctcttcctcggcctccgggcgaccggccgcggccggctcactgaatgtagtaggcgaagaaggaggcgacggcggccccgagggcggcgccgacggcgggcgcgacggcggaggagccgctggtggggcccggagccggagcctccgcggcgagcgccacggtggccgccgaggcggcgacgaggacggcgcaggcgatcttcttcatctccatccctgaatgcggcggcggcggcgggcg

SEQ ID NO: 12857 - DNA, 586 bp, Zea mays
  Clone ID: cC-zmpo14820013b07d1
gcggacgcgtgggcgacgggagcacagagctagctagcctgccattcagcagccagcttgctcgccgcgcccgtccttgttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattcgacacaccttttgtcctctatttctttgttccctctttctccttaatttaacgaattgatgcatgccgctgatgttctttcccctgagagaaggattaacactctgatcatcgcttgccattagtttgaatccattcaacaattccgattaatcaatcatcgcgtataaaaa

SEQ ID NO: 12858 - DNA, 388 bp, Zea mays
  Clone ID: cC-zmpo14820013b08a1
accccatggtgaccgttctttatttttgaaaccccacccaattccaaaaaaaaaacccccaaaagatttcgaaaactaccgacaacggcgaacggaaagcccactgcccccgggggtaaagggcttccgcacacaaaaaatccaaaaaaccggcccccatgggggggaaggcacatcccccttaaagagacaaaggcccaatgggcccccaaaaaaaaagggtgggcaggccccaagaaacaggcgggcctcccccatcgggggcccccagctgggttaattttgaaagaacaaaaagcctggtcagaaaagaaaccccgaggggccccaccggtatcccaaaaaagctctgggtcaccaaaccgaaaggggggaaaaacccccccgg

SEQ ID NO: 12859 - DNA, 544 bp, Zea mays
  Clone ID: cC-zmpo14820013b08d1
cggttccaccccaaaacgaagcaacacgccttgcccggtttgcactttcgaaaccagcgacagcagcacagaggggaacggcgtggtatcctcctgcctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaggtgctacaacctgttcaagagcaactgcgaggacttcgcgatatactgcaagactggccttcttgtcgctgagcagggcgttgtcgggcagagcgggcaggctatctccatcatcggtggacctctcgccgcggtggtctcgaccccattccgcttggttaccacgaacatctatgggatggcggtgatggccgtcggggtgtactgcgcgagcaggatatgtgctgtggagaacatcgcccagctggtggctccggaggcagaatgcccggccgatgccacg

SEQ ID NO: 12860 - DNA, 420 bp, Zea mays
  Clone ID: cC-zmpo14820013b09a1
gatgtatgcataatgatttcttatatctgacaatgtgtataagtgacaatatttaacattaatagcaaagtacgtatgtcttaattgtgatttaaacggggatgagatcccgttggggatttatccccgcgaggaacagggataaggaagaaatattcttcgcaaagcgttcgtaggatccctgcagggaagttttttcgtcgcggggacggagacggtgagctatttccggcggggaactccccgttgccatcagttgaggagccagaccccccggctggtgcaacgtactcggagaggagctcgcctaccgctacggcggcgtgctagctgcgctctttcaactccggacgcgtgcttaccaccttcgccgatggcatcctgctcccgcgcaccgtgatacttcccaggtcctacccg

SEQ ID NO: 12861 - DNA, 582 bp, Zea mays
  Clone ID: cC-zmpo14820013b09d1
ggttccgatcctctgcgccgtcgcgatggcggcctccattcgcctttcgccgtcacacgccaccgcagagctagctacggtctaagacaaggcgggcaatggccaaggcgcccctgccgcttccgtcgctgctcgtcctcgccgccttcttcttccaccacccctgctgcacggcgcagggccgcgccgaaaacatctcggaggtcgaggccgcggtccgcgcccgcgcgtccgagctgctccgcgacgccaccagccagctcgtcgacctgcccctcccggccaacctctccggcgcgggcgttcgggcctcggccctcagcgtgcgcagcaacgcgctctgggccggcggcgtcaacaccaccggcttcaccgtcccgccgcgcgtcgtgccggccccgttcgcgcgccgtctcgccatcgtcttcgagctcttcgtgggaaactcgacggccgcgttcgccgcgccgcgcggctacgcgctggccacgcccgttggccgtctcctcgcgtacgacgcgtcggcggggcccgacgcgcgcgtctcgctccgggcgctcggcgcgccggtgcgcgttgagt

SEQ ID NO: 12862 - DNA, 322 bp, Zea mays
  unsure at all n locations
  Clone ID: cC-zmpo14820013b10d1
ctcgccgccgccgccttcggctacctcttctgctagtttcgcgttttatacgnggnacctgctccaaaataggattcgggtggtctggcgcgcgtgagtccacctcgcgtgtcgngcgtgtctctgtgtgaagtggccgccggcctgtgtgtatgtatggagtcggccgcggcggcggcggaggaagaggtgtgcgcgtggtgggtggtacgtgcttcgacgcgccactgtttgtcgcggcgatcatgtactaccctgctgcgtattctgggtattaatgagatgatttatttgaatcaaaaaaaaaaaaaaaaaagggcgc

SEQ ID NO: 12863 - DNA, 308 bp, Zea mays
  Clone ID: cC-zmpo14820013b11d1
gaagacctctgtcccccgcggcaacaactattcccgtttccgcaatcagccatgggcgcctggcaaccgagcccaagacgctcgagggcacgcccacctgaggccgccgactccacacccaaagttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggacgtcgccgaacccgaccacaaggaagaggaagccgtggagaaaac

SEQ ID NO: 12864 - DNA, 387 bp, Zea mays
  Clone ID: cC-zmpo14820013b12d1
cgcctgcaaggacgctgcccaagaacggcgacaaggactacgtcgttaacttcagcctcgacttcgagaaggtgcagcgggtcacgctggacctcatcaccgaggcatccggatccatgtccgcaggcatcgccctgccaccctccaacgccggagcgccctcctacggggcggcggcgccgttcggaggtgccgcggacgcacccgccggcaccttcgagggccctgccagcgccagcgggccatcagctggtgacgcgccggcgtatggcgccagcgccagcggcccgactgctgatgctccggcgacggcggcggcggcggcgtcgtccgggccctctagcgcacccgcgccatcgtcgtctgagtcctacggcgcaccagggc

SEQ ID NO: 12865 - DNA, 174 bp, Zea mays
  Clone ID: cC-zmpo14820013c01a1
gagcttggattttttgatcggggcttggaggtatttgcctgtgccccccgagagaggcccttaaatatcgagcgaagcagggggggaccggcaacttatgctaaaagggtcatcgataaaaattgcgccgaacagataacgaggaatgttaaggggaaggggctacaggggcca

SEQ ID NO: 12866 - DNA, 445 bp, Zea mays
  Clone ID: cC-zmpo14820013c02a1
agacaggaacagttcaatcacacacatatatatattgttctgggtttacaaaccatacgacaaccaaactttaatttgggggtggaattacaaaattatttgccaaaatgcatggtaccaacaaggaacaaaaatctctggtgatcggcgacgggcaggggagaaatggcagacgaaggatgagagatgattaacagagccacgcacaatccaagggcgtgtaggggactaaaatgcgtgcgtagctagaggaggctaccaattaaataatgctgatgttggtatcgttgctgctggatgctcgaaccatggacaagcgagcgagcgaggttaaatgaatccattcacaggccttgctctacgaggtagtcgccgagcctctcgaccaccatgttgcactggccgggggtcatgggctcgtcgtagatgccgaccaccatcgctt

SEQ ID NO: 12867 - DNA, 587 bp, Zea mays
  Clone ID: cC-zmpo14820013c02d1
gcccacgcgtccggctttcgttatcctcctcttacattataggtcttagctaagcaggtctgacaggatgtgggggcggtcatacttcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggtcccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctgtgaatggattcatttaacctcgctcgttcgcttgtccatggttcgagcatccagcagcaacgattccacattagcattatcaattggtagcctcctctagctacgcacgcatttaatccctacacgc

SEQ ID NO: 12868 - DNA, 504 bp, Zea mays
  Clone ID: cC-zmpo14820013c03a1
gccaacatgcaaatcattttaaaactgaccagatgcagaggcaggaattctcgaggcgggctacacaagtgtgcaccgtgcactgcaatgcccaacaacaagattgtagcagcaaacatggaagagaaaggcgcggggggcaaggcagcagttccgcatgacgagttaccgcggtttacaatcttcctgatacccaaccgtagggaaccccccctagatcttgtcgagcttgtctgccttcaccaccggattagccttggcaatggcgtccctggcagcagtccggtagtcgaacttgcagtcgtgcttgtcggagtagcggtggagtgcgcagtacaagttcccacaccggcagttgaatcccgtaagtccaaccctcttcctgcaggcgctgcaccggttcggccctaccttcccccctttggagatcgccgccaccccctcgctgggtaccgcaacatcaacgggctgctgcacgttcattgtttgcaactcaacttgggc

SEQ ID NO: 12869 - DNA, 562 bp, Zea mays
  Clone ID: cC-zmpo14820013c03d1
gagcccaccgaattccctgcgattcctctcccctcgccttttcgtttccccctaggggatcgtcggagaggagtcgcggagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcatcccgctgatgttgccggacccagcgagggggtggcggcgatctccaaaggggggaaggtatggtcgaaccggtgcatcgcctgcaggaagagggtaggacttacgggattcaactgcccgtgtgggaacttgtactgcgcactccaccgttactccacaagcactactgcaagttctactac

SEQ ID NO: 12870 - DNA, 412 bp, Zea mays
  Clone ID: cC-zmpo14820013c04a1
gttaccatataccaatttcttcttattcaacgaccagacatatccattgtacacacaacaaaacggcagcacacgtcatccattgtacacaacaaaacagcatagcgatagggttgttccatggggcatgtcacaaccaacacatatcaaaaccatacacaagacagatgcgaaccagatcatctgaaggaccggagatgggacacatggcctgaccacgaaaacaagaccacagactgacggaccaaccacccgtgcggcggcggcatagggcaagattcatgtgcacgctagcccagcaaaatgctgctgtcgccgccaggaggctgccgggtacgacggccttcatgatctccggttgttgaggttgaggccttcccgtctgcaaaattgctgctgccactcattcctt

SEQ ID NO: 12871 - DNA, 564 bp, Zea mays
  unsure at all n locations
  Clone ID: cC-zmpo14820013c04d1
ccggagaggggcagggagatggagagagcggcccccgnattagctttacacctcgacggctggcctgctcggggggccgtacccctatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggtcgagagcgccgtcgcaactgcctcccgtgatcgtcaggctagccagatcaccttttcccaggacgggaccgttcctaccaggaaggcaacctcagtggctggggtggcaaggcagcgtgagcttagccataccgtcgagagtgagggggacagtaagatgaaaaggcaggtgtccagtacgaaatccaaggagctcagtggtcacgacatctttgccgatcacgaagatcccaagcccaacaggtcaaggagatcagactatggcagctctgctgctcagtaccagtgaaaaatgcaaagtgagct

SEQ ID NO: 12872 - DNA, 351 bp, Zea mays
  Clone ID: cC-zmpo14820013c05a1
gggtggggtttttttttttttttcatttcattttttgtgctagtttgatatggtaggtgagccccatataggtgacaagaggattccacctccatgaccaccgggaagcgggggggaaaaaaaagggccccccagggggctaaaaaggggaaaaaagggaaccccggggggggccccagcccaaaaaggataaccagccccgcccaccaaaaaggaaaaagggggagggtccggggcccgggacttccccccccaaaccccggggccgaacaaggggggaaagccccccccggggggggggggggaaccccccccgccccccctatcaggggggggggaaaaatagagggg

SEQ ID NO: 12873 - DNA, 570 bp, Zea mays
  unsure at all n locations
  Clone ID: cC-zmpo14820013c05d1
gcgaaagaagtcgcctaattgtttcgatcgaattaggcttcttctttgtcccacgctccgtctttatttgtagtctgaggcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcacgttcgcgcaggacatgatcctncgtcttaggaacgttgatagcggtgagattcagctgcagctgc

SEQ ID NO: 12874 - DNA, 354 bp, Zea mays
  Clone ID: cC-zmpo14820013c06a1
tctttttttatcatcttgaaacccttaaccttgcttacatcttggcgggcatgcatagaaagctttatttaggatatccccatcattgcgtgtgcactactattgaccctgaagcacaggccggatgtcatttctaaagggcaaatggttgcacttcaagcgaaagcttgtgggggaccataagtagtcagtatcggccttggtttggttatttgctctagggggtccttttgcctgactttagtatcacgatactttgggatccgctctgagaacattctccaccggttatgctcgctaggaacatctgagggatggaatgacctttcactgtgttgtacaaacacctctttg

SEQ ID NO: 12875 - DNA, 225 bp, Zea mays
  Clone ID: cC-zmpo14820013c06d1
aaaaaaaaaaagcacccaaaaaagacagcaaaaaccaaagacaaacaccgaccaagaacaggaacaaaaagaaaaggcacaaagaagacgaagcgaaaaaaaaaagagaggacaaagccaaccacaaccagacaacacaaggaagctagaccgaagacacacaaagacgcaaaaacacacccagcatagaacaccgaacaaacagaaaagacgagacacccgaac

SEQ ID NO: 12876 - DNA, 540 bp, Zea mays
  unsure at all n locations
  Clone ID: cC-zmpo14820013c07a1
ctggataataagggatactaattatatgcagacattggtgaaaaccaatgttgggatgagttcagacccgacaagagatctatattactatgtattcatcgtttaccattatgccattgttgttggctcatccagacattcaaccatcataattgtcattatcgcaatgcttagtttaggaatgagcactaacacaactgaaaaggtcttcgttcagcttgggggttcagtgtgaaggtcaacccaaacatttccttgatgacctgccccttctccaggggttctactagttttgcgacaagagcgacactttccctcacgtgttccatgtcagtctgtgtccagatgcgacgtgatagctgtagtcttcgttgtttggaattaagatcgatcccccatttgttgtaaaggctctctctttccaaaagattgagtctccttagcatttgcctgtacaacatgtctcttttatgccgaagatttctcaaacttgatgtagcagcagcattagcctcagatgcaacactgnaagaactttta

SEQ ID NO: 12877 - DNA, 549 bp, Zea mays
  Clone ID: cC-zmpo14820013c07d1
gcagaaagaaaccgttcagtctcaacttgacaattttctttgagtttcaatagatgaaaattttgatgaccgggcaatgtgacaatgggatcaacggaataggtcttcagagtcccttccacataatgtgtctgaagatgctctttcttcttttgatacttacgatgttgtttatggagaacaagatggtctatgcccaaaagcatttgatgtacatccaatatctatcttgcatcaaccaagaaaccatatttctgacaacattcatatatatcaaccaaataaggaggcttcctcagaggtctctgaggagcattgcaaggaagtccagtgcatcgaaacaaatgagcttaggaggagtccattattctttcctgttgatcgatatcatgttggcacaaacattgatgaaggaaagcatgatgaaaacataacggacacatcagacagtgccatcaaattgtacacatgtgattctgagccatcttctgataccgaaaaaacaaataatgatgaatctttagccctgagaggtgcgtgataagctct

SEQ ID NO: 12878 - DNA, 275 bp, Zea mays
  Clone ID: cC-zmpo14820013c08a1
gggaacaaacccctccctttacagttactacccaaggggcacacccattggggaaccatgtttacccttggatataaaccgctcctttgcaaaaaaggaaaaacagatctggcatttgggtttctaaactctttttgccactgagtacttacgtgctttccacccaacgaaaagggtaaagggcttcccttaacaaacgggtcctggatgaagtccaaattcataattaatgaacatttttgccactcctgggcttgaaaaatgcaaacttttgc

SEQ ID NO: 12879 - DNA, 412 bp, Zea mays
  unsure at all n locations
  Clone ID: cC-zmpo14820013c08d1
ggcaaagagtctgcagtgtctcgagcgcaggaagtggcagattatgtttttttaattanntgaacttggancttcatgcaggggaacgggttgttgataggcatgcgccttagcccttctcgtctcggtggagagcaccgtaagtactcagttggcaaaagagcagtttatgagaagacaatatgatcagatactgtttttccctttaattggcagaggtagtcagtttaatatacatagtgtataccatggattccccaatgcggtgtgactccttgggtcagtaacctggctaatggaatgggctttgatcacagaaaaattaaataaaaataaacataataagaaataataataagaaaaataaaataaagaaatatctaaaaaaagagggcaggcctgttctaagagt

SEQ ID NO: 12880 - DNA, 532 bp, Zea mays
  Clone ID: cC-zmpo14820013c09a1
cccaatcgcaacatcggcatgcatggtagcatttgattgaacgcaagggtgcttttacatcagagaagatcatagagcactataacagcgcaatttaccatggttattattcttcaagacagaaaaacaaaaaacacgcagttcgttgtttgtttagtcattcgatggcggcggcggcggctgagatcgacggaccgatcgatcgatctcccatcactcgccctcgccggcggcggcggctacaccgctacacgcagttgccgctgcacccgtccctcgtttcgtagcactggttgggcttcaaggccccgcagcagaagcacggggcgttgccacggccttcgtacacgcaattcctctggatgcagaactgcagcttcagtacggcgccggggccggggcccgggccgccgccgttgactggcggcgccgtgccattgccgttaacgttgccgccgccgtcgagtggctcaggacgacattttgcagacgacgcgaagagcgcaacgagcaggacgactgccaccaggta

SEQ ID NO: 12881 - DNA, 565 bp, Zea mays
  unsure at all n locations
  Clone ID: cC-zmpo14820013c09d1
cgtccgcatgtcttagatcgacagccgtgctcatcgttggcgtttcggcatccgggcatggacaggtgcggggacggcgccatggcgtcgtacctggtggcagtcgtcctgctcgttgcgctcttcgcgtcgtctgcaaaatgtcgtcctgagccactcgacggcggcggcaacgttaacggcaatggcacggcgccgccagtcaacggcggcggcccgggccccggccccggcgccgtactgaagctgcagttctgcatccagaggaattgcgtgtacgaaggccgtggcaacgccccgtgcttctgctgcggggccttgaagcccaaccagtgctacgaaacgagggacgggtgcagcggcaactgcgtgtagcggtgtagccgccgccgccggctagggcgagtgatgggagatcgatcgatcggtccgtcgatctcagccgtcgtcgccgncatcgaatgactaaacaaacaacgaactgcgtgttttttgcttttctgtcttgaagataataaccatggtacattgcgctgatatagtgctctatgatcttctctgatgt

SEQ ID NO: 12882 - DNA, 431 bp, Zea mays
  Clone ID: cC-zmpo14820013c10d1
gcacgcctggcctgggctggccgcttcacttccctgtgtctctttttcaccgcgtcgcgtgggccctctgcgctacgagggctttaaatggccctctgcgccgacccttccgtctagcgccctgccataatgcacacccagccatcttctgatcctactgacacctccaacatgaaggtcaagctggagatccctaggcagcacgccatgccgacatcacggtccctgccactgagcgcaagcgagctgccctacccgccgacgcctgacagctacaacccggcgcaccacccacactacattccgaccacgcccggactctcatcgccgtcgtgctcgccgatcggccgcatgcggtcaccgtccaccgactcgccgacgatcacgcccaccaagcagcatggcggtaagcccaaaccgacgccggcaga

SEQ ID NO: 12883 - DNA, 529 bp, Zea mays
  Clone ID: cC-zmpo14820013c11d1
ggacgcgtggcggacgcgtgggtgccatcctctcctttacgattttggcgtccatcagcaatgtcgcagggaaggctgcgggcgtggccgcgctgcttgcggtcgccgtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcaagaaccagtgccagcattcttacaattgcaagat

SEQ ID NO: 12884 - DNA, 621 bp, Zea mays
  unsure at all n locations
  Clone ID: cC-zmpo14820013c12d1
gagggatcggatgggaactcgatcggaaggaaggtcttgcaggttggctggccggacgacgatcgaggaggcaagctggtgctgttgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgcttccacgccaacgtggatgcacgcgcgtatggtcgccgctccaacctgcagctgcaggaggaggaagcagcagctaccgcggggcgtgtaaccaaagcagaagaacaggaggcttctactcaaggtggagattaaccgcccaattattgcaattgcaattctcatcacccatttatattttctgccatcatttattcttcttttacacgcgtacgtgtgcgtaccccgacccattctttntggattataagcattgtcgatggatacttatattactctctctttctctatgngataaatatatgtaacaagccatattggtgtttataatatag

SEQ ID NO: 12885 - DNA, 518 bp, Zea mays
  unsure at all n locations
  Clone ID: cC-zmpo14820013d01a1
aaacataacacaggcaaggcagctgagctacctgcttcttttgttacatacagcgaagtgcatgcatggtctggtcctttaattttgtagagatagagaagagagaacgaattaattgacgcgatgcacgacagtagaggaggaattgccattattattattatagacctctccgcctttgctgttgtggagatgatgggtgttgcacttgtccttcctgaacctcatcttcccctttccgtggtcgatctcccagatgtactcctgcatgagcacgttgcccaagatcccgggccctccccgcggcagcttcctaaaggccaggcacgccaccccgggcactacctccggtattaccacgctcttggcttccggctctagcctcgcgccaccggccatctgcaccgtcaacctgggcaccgtcacgttgtgcgccaggtccacgccgtcgccggcgaaggtncacctgtagcagtactcgaagccgtccagctcgtacacccgcggnaggtgggaca

SEQ ID NO: 12886 - DNA, 555 bp, Zea mays
  Clone ID: cC-zmpo14820013d01d1
gacctcaccttcgggcccaacccggcggtgatggggccgtgcactttggagacggacatcgtgtacaacgtggacgtggggccggcgtacgggcccttggtgacgggcatcttcgtgggcggggagcgcctggacatcccgcaggagatctgggatgccgagaaggtggtcggcggcggcgtcatcctggacacgagcacgtcggtgacgtcgctggtgccggaggcgtacgcggcggtgacgagcgcattggacaggcacctgtcccacctgccgcgggtgtacgagctggacggcttcgagtactgctacaggtggaccttcgccggcgacggcgtggacctggcgcacaacgtgacggtgcccaggttgacggtggagatggccggtggcgcgaggctagagccggaagccaagagcgtggtgatgccggaggtagtgcccggtgtggcgtgcctggcctttaggaagctgccgcggagagggcccgggaatcttgtgcaacgtgctcatgcatgagtacatctgggagatcgaccactgaaaggggaagat

SEQ ID NO: 12887 - DNA, 452 bp, Zea mays
  Clone ID: cC-zmpo14820013d02a1
gtcgtcgctgtccttcttggtgtcgatgacagtctcgaaggcgccgacgagcgccttgaccttgctccgacgcttctccagcagcttcgtgcgcgcctcctcgatcacgtcgttgctccgcgccacctctcggcgacgcggctgctccgactccgctcgcgcctccaacgccgtcctcacacggctgccctggaacctccgcattgcctcctccttctcgtcctcctccgcctcctgcttcttgatcgcctccttcacaaccgtcacgaacttgtccgccaccacgtcttccactgctgctacggcaacgatggcctccggcgccggcgccggcgacagagccgcttcttgcttgggcgattccaccacctactcctcctccttcgaggttgcggcggcggcggcggcgataggctccggcgccggcgacagagccgcttctttcttgggcg

SEQ ID NO: 12888 - DNA, 521 bp, Zea mays
  Clone ID: cC-zmpo14820013d02d1
gcctggcctgggctggccgcctccgaccaccgtacgttttccactttgtcgccgccggccggcctctgcccagcccgggctgactgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggatgccgacaccgcggcgaactacgcgtcgttgtggtcgcccaagcgccttatgcagcgcgctgcccgcgctttccgccgcag

SEQ ID NO: 12889 - DNA, 497 bp, Zea mays
  Clone ID: cC-zmpo14820013d03a1
tcgcgatctagaactaggctgagagattggttctcagcatccaacaaccaaacacattgtataactagagagatgggtcgatggtggttctagaagcatgcgagctccttgaggcaacccttggcgctgcccttagcgttcttgcatacggccatggtcttgttgttggtgccactgtacttgatgttgacgtcgtccatggtgacgccggtgcatgggatcttggcagagcagagcaggttgacggcctccggggtggaggaggtgccggtgatgttcttgaaggtgacgtccttgacggtgaccttggaggcaccattggcggtgcataacttgttggggcagtacttcatgtcgatgatgatggggtagcccgagtcctccatcttgatattctcatagtggatcttggaggcggtgagcacggaggcggcgtcctcatacgccttgatgcggacgccgttggccgtcttcttaagcgtgcagtccttgacgtt

SEQ ID NO: 12890 - DNA, 441 bp, Zea mays
  Clone ID: cC-zmpo14820013d03d1
cgaacgtaaggactgcacgcttaataagacggccaacgttgtctttatcaaggcgtatgaggacgccacctcgatactgaccgcctccaagatccactatgacaatatcaagatggaggactcgggctaccccatcatcatcgacatgaagtactgccccaacaagttatgcaccgccaatggcgcctccaaggtcaccgtcaaggacgtcacccttaagaacatcaccggcacctccttcaccctcgaggtcctcaacctgctctgctctgccaagatcccatgcaccgtcgtcacccatggacgacgtcaacaacatatacagtggcaccaacaacaagaccatggccgaatgcaagaaccctaagggcaatgccagggttgcctcaaggagctcgcatgcttctaaaaccaccatctacccatctctctagctataca

SEQ ID NO: 12891 - DNA, 512 bp, Zea mays
  Clone ID: cC-zmpo14820013d04a1
aagtattaagggcagcgttgttaggatcatatattcaaagaagtggctctgcttacaaagttacaatttttttccgcgaggctaagacaggtccatgtcagattttccattgtcgtgagcctcagacgtaacgaaggcatctggcacacttgattgcagcgtgatgataaaccgggttcacagagagattaagaggaaaaaaaagggaggagggaataaagaagcgtcgtcgtcgtaaagaaatatggcaaacgtgtagacttcagtctgcgtgatatatatgcatgggtggttgttggtcgctccgatcctagttgtcctcttctttctcatcttgcggtggcgctggttccggcggttgctcctcgtcagccacgtccggcagaacctcctgggacgggctcttcttgttcatgtggttgtagctccccttctccatgaacagctgcgcgaagtggatcttgcagtacaagacgccgttgagcgcggcataagaggaggtggtcaggatg

SEQ ID NO: 12892 - DNA, 585 bp, Zea mays
  Clone ID: cC-zmpo14820013d04d1
gattgtgggcgagtgcgtgcgttcgtgcagccacagacttgcgttttggcaccatgtctttcaccggcacgcgagacgggtgcactgcgtgcgacaagaccgtccacttcatcgacctcctcacggtcgacggcgccatctaccataagacatgcttcaagtgcagccactgcaaaggggtcctctcgatgtgcagctactcctccatggacggcgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactctggaaggcgagtcctaccacaagagctgcttcaagtgctcgcacggcggctgcatcctgaccaccttcttttatgccgcgctcaacggcgtcttgtactgcaagatccactttatgcagctgttcatggataaagggagctacaaccacatgaacatgaagagcccgtccc

SEQ ID NO: 12893 - DNA, 383 bp, Zea mays
  Clone ID: cC-zmpo14820013d05a1
cccacccccaaaaaaaaaaaaaaattttccggggaaaaaaaccccccccgggggggtaaacgaaccttaatccccccccccttagcgggggggcccccctaaagagcgaaataaacttttccccccttttaaatcccagggcaatagggcttttttggggggggaaaaaacaaaaggctaaaaagccgcccccaaccggggacccccgggggggggtttagtaaaaggggggccccccccccaataagttcccccccgggaaaaaaaacgctcccccccaaggggaaggggcccaatggggcccgctccctttgggggcctggaccttcccgggaaaagataaaatcccaaagggccggcccccttttttggggggggttttt

SEQ ID NO: 12894 - DNA, 533 bp, Zea mays
  Clone ID: cC-zmpo14820013d05d1
gcccacgcgtccgggacgaagctacgcgctgcaccgactttccattccctaggcgttcggcgggcgtcaccagggcggggaagaatgggtgcctcgcgtcgccttggcgtccccgaagtcgtcgacggtgcagctcgatccgcctcgtcgagcatgtcgaggagggtcccttgcaaattcttcttgcatggagcttgcttcaaaggagattactgtgaattctcccatgactgcaatgatcaaccagataatgtttgcactttctaccagaaagggacgtgcacctttggtagccgttgcagaaatgaacatgttgaagttcattgtaactgcccccaaccagcaaccactgtagcgcgtgcattctccaattcttctcatctagttgcttcttccagagatccccattgcagcgaatgccaaacggacttatgtgaccaaacacagcagatttgcatgtcaacagcagcactttctgcacattaacctgcatgggttcgtgattatcatgaccatgacacttcagatgatac

SEQ ID NO: 12895 - DNA, 93 bp, Zea mays
  Clone ID: cC-zmpo14820013d06a1
ctattgagcttttttacctgtttaattttcggaccggcacccgctagcggaccagatttgcctaaactggttaaaatataactggacgcgtgg

SEQ ID NO: 12896 - DNA, 360 bp, Zea mays
  Clone ID: cC-zmpo14820013d06d1
ccgacgacagccgaaccagaggagaccaacctacaccccctttccattcacaaaaaaacaaaaaaaaaaaaaaaggcaaagggcaaggcacaccccgccagagcgacccaagccaacacacgcaaaaccccgacgacaccacaaccaaaacagcagagacccaaaaccaacgcacggcaccacgcgaaacaacgacgagacccgcacaacccggccgacccaaaacgcaaacagccagaaacacaaaccccacacgccacaaagcggaacaccaaacacgcccgaaccgagcgccccgcccaacaagaccccaacacgaacgaccaacggaacgccccctgcacccgcccactaaccgcc

SEQ ID NO: 12897 - DNA, 486 bp, Zea mays
  unsure at all n locations
  Clone ID: cC-zmpo14820013d07a1
agacagatagagagttagagaccagattaatcaaatccattagttacataacgggtgaccccataatgttacaagagcaaacgaagtgagcaaagcaaagaaacacttggtccctccctccccaccagacgagagcgattacagcacagccaattacgtgtccaccctaatgtctcaccgcgacacgaccatcgtcggtgagtttagtagaagaagatcatggtagcaacagcagcggcaacgccggcgatggcagctccacttccaagggcagcagcaccggcggagtcatcagcagccggtccctcaaccgcaggggacgccgcggcggtggatgctggcggggaagggctcaactcctcgtccgtggaagaagggggtgtataggcggtggctggcgcggtaactggaccaaacttcctagacgacnatgatggggcagcggcggcgacgggggtggacgcggctccgggtgcttcagcgggg

SEQ ID NO: 12898 - DNA, 523 bp, Zea mays
  unsure at all n locations
  Clone ID: cC-zmpo14820013d07d1
cgccggccctctcctttcgtcaccatcacatccagccagcttacattttatgtcgcgcgtcacagctgcggtgcgcttttgcatcctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgaaggaccggctgctgatgactccgccggtgctgctgcccttggaagtggagctgccatcgccggcgttgccgctgctgntgctaccatgatcttcttctactaaactcaccgacgatggtcgtgtcgcggtgagacattagggtggacacgtaattggctg

SEQ ID NO: 12899 - DNA, 171 bp, Zea mays
  Clone ID: cC-zmpo14820013d08a1
ggagaaaaagggttttttcccccccccccccagggggggttttaaacccccctccccgggggggggggggggccctcaggatccccccaaaagattttcccggggggtccttttgggggcccccccccccagggggctttttccttttcttgggggggggggggggggccc

SEQ ID NO: 12900 - DNA, 445 bp, Zea mays
  Clone ID: cC-zmpo14820013d09a1
atcatagtaaagatggcctttttattgcaagcgatcaatcacaataagatgggtgaatgaaacacgttaaaatgaaaaaacataaagaaaaaagggggaaaatttagtagccatcttgaggcgcaacccttggccatgcagcattgttggtacgccgtccggttcacgcgcgtgagtcagtcagtggccgccggtcaccgcgtcattggcgcctgccgccgcgcccgccaccgtgtccttgacgggcgccgccgcgcccgccaccgtgtccttgacagctgccgccgcgcccgccgccgtctgcgccacctgctcaacagcctgctgaacggtgccggcagcgcggtgctcctgcagctgtgcgctgtctgccgcggctccggcggtgtcggtcacggcgcaagcggtggcgccggcgccgtacctgacacactgcgctgcgcgc

SEQ ID NO: 12901 - DNA, 555 bp, Zea mays
  Clone ID: cC-zmpo14820013d09d1
ctgaagtgatcttaattaatcgtcgagaagttatttgctttcggagatcatcggcaatgtcgaacatggggcagtccttccaggccggcaaggcgcaggcccagggcgagtgccaggcggagcgcgcagcgcagtgcgtcagggacggcgccggcgccaccgcctgcgccgtgaccgacaccgtcggagccgcggccgacagcgcgcagctgcaggagcaccgcgccgccggcaccgttcagcaggctgctgagcaggtggcgcagacggcggcgggcgcggcggcagccgtcaaggacacggtggcgggcgcggcggcggccgtcaaggacacggtggcgggcgcggcggcaggcgccaatgacgcggtgaccggcggccactgaccgactcacgcgcgtgaaccggacggcgtaccaacaatgctgcatggccaagggttgcgccttaagatggctactaaattttccccctttttctttatgtttttcatttaacgtgttcattcaccctcttattgtgttgatcgctgcaataaaagccattttctatgat

SEQ ID NO: 12902 - DNA, 485 bp, Zea mays
  unsure at all n locations
  Clone ID: cC-zmpo14820013d10d1
ggacgcgngggcgacggctacctctcgctcgcgctcatggcgcatcttcatgggcctcaacaccgncatggggctcgggcaggattaggagctcgacattgtcgtccccgccagccgccgcctcggcgtgcgccccgtcgtcggcatgcgcgccaagctgcgcaccaagcacgccggccacttcggctccacgtccggggagaagggcaagttcggcctcagcgccgcgcagatactggccgtggacaccaagctcaaggccatcggtatgctcgactgcctccagctgctgcactaccacatcggctcccagatcccgaccaccgccctgctctccgacggcgtcggcgaggccgcgcagatctactgcgagctcgcccgcctaggcgcggacatgcgcgtcatcgacgtcggcggcggcctcggcattgactacgacgggacccactcggtgcagaccgacatgtccgtggcgtacagcctgg

SEQ ID NO: 12903 - DNA, 168 bp, Zea mays
  Clone ID: cC-zmpo14820013d11d1
ccacgcgtccgccttgcgacagaaaaaaaaaaaaaattaaaaggttggccgaacaaaaagagccaaccgcgcgaacgcagccaagctaacacacacctgcaccaaacccgaaaccaaatacaaagcaccacccaaactcaaacaacgggccgacgggaacaaccccgc

SEQ ID NO: 12904 - DNA, 447 bp, Zea mays
  unsure at all n locations
  Clone ID: cC-zmpo14820013d12d1
tccgacgccatcggcggcagccggaaccccaccatcatcatttagggttttcgcttccgcgccgncgacgacaggaggttcgaggaggttaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgcctttgcctg

SEQ ID NO: 12905 - DNA, 252 bp, Zea mays
  unsure at all n locations
  Clone ID: cC-zmpo14820013e01a1
aacgaaaacaaaaaagaaccttttttatccagaagattgtagaacaacaatcttggcgagtgtataatatatgcgcatgcatggtgttcggcggacagcccgtattataacctgcgcggcgcatatgtgcgcacggcgctcggcgaggcgagatcagtcgctgtcgctgctgctgctgctgtggccgccgtcaccatcaccatggtcatggccctcgccgngcttcttctctttcttcttcttcttatcttt

SEQ ID NO: 12906 - DNA, 260 bp, Zea mays
  Clone ID: cC-zmpo14820013e01d1
gcgtccgaaagataagatgaccaagaaagagaataagctttgcgtttgccatgaccatggcgatggtgacgggggccagagcagcagcagcagcgacagcgactgatctcgcctcgccgagcgccgtgcgcacatatgcgccgcgcaggttataatacgggctgtccgccgaacaccatgcatgcgcatatattatacactcgccaagattgttgttctacaatcttctggataaaaaaggttctttttctgttttcgtt

SEQ ID NO: 12907 - DNA, 349 bp, Zea mays
  Clone ID: cC-zmpo14820013e02a1
gggggaaaccgagtatttattttgtccaacgggcgaaagacaaaaaaaaatccccttatattttaacctttttttttttgggggggggggggggccccacaaaagggtccctgggccatttcctcccaagggaaaattggccccggggggccccgcatcccttaacggggggccccccccttttacaaaagaaaacccctttcttgcattaaataaagggcccccccgggggcctcttttgatttttttctcccaggggaaaaataaaaacactgtctcccggcggggggtataaaggggcggggccttttcaacccgagctgaggacccccccctacaaaggattccc

SEQ ID NO: 12908 - DNA, 433 bp, Zea mays
  Clone ID: cC-zmpo14820013e02d1
cggccgacaggcccgggttatcttttgaaatttcatcgtgatggggatagagcattgggattgttggtcttcaacgaggaatgcctagtaagcgcgagtcatcagctcgcgttgactacgtccctgccctttatacccaccgcccggaatctatctatctatctatctccttggaaacatatatcagacgatgccccagcgcgtgccgctgatttgatgcaagtatgcggttttcatttgtaaatcggagtcgatccatactaagcgatacaggaacaccctgtatcaattttcacttgtgatgaaattgcacatgtactcatttgttgtacacacatacacacacagaaaaaaaaacgttagaatataagaggatatatgtttgtcaatcgaccgttagacaaaatgaatactcagattcctcaaaataaaa

SEQ ID NO: 12909 - DNA, 233 bp, Zea mays
  Clone ID: cC-zmpo14820013e03a1
atgtaaagccttttggggcgacaagaacatattaatgaaaaattcagggggggggcctttcccccgttgaccgtcaaaaaaaaaaaaattatgaacaccccaaatttacactgccggaaccgcaaccacaccatgtagctagcccccaaaggattaattaatgcacgggctacatattgagctccttacaaaaaaagggcatgaagccccattcatttgggtggccggccttc

SEQ ID NO: 12910 - DNA, 282 bp, Zea mays
  Clone ID: cC-zmpo14820013e03d1
gcgtccggaaggccggccacgcagatgaatgtggcttatgcacttattctgtaaggagctcaatatgtagacggtgtgttaattaatcctttgggggctagctacatggtgtggttgcggttgcggcagtgtaaatttggggtgttcataatttttttttttttgactgtcaacgggggaaaggctccccacctgatttttcattgatatgttcttgtcgcccctaaaggctttacataaaaaaaaaaaaaaaaaaaaaaaaaaaaaataaaaaaaataaaa

SEQ ID NO: 12911 - DNA, 321 bp, Zea mays
  Clone ID: cC-zmpo14820013e04a1
cctcaaggggtttttttttttaggttggtgccctgattgaaagtattaaacatgcaaggaaagcaatccgcacccccgggtggccgtccaaaacccctgagacccaaaaaaaaaaccggaacccagggaagacccgggaaccccggcccggccccggaaaacccaccccctccccctaaagggagccagattacaccaagggggacccaaggacaccccgggcccccccgggaaaaggttatccccctggcaaaaaccggcaacaaacgagccggacgcaaaaaaaacaaaccccggggggccaaaagaaagagccaaccc

SEQ ID NO: 12912 - DNA, 452 bp, Zea mays
  Clone ID: cC-zmpo14820013e04d1
cgtccgatcacgttctttgtactcaagaattttgtactttcattttgcggtgcggatagcatgccttgcatgcataagaatttcaatacaggttgaaaacttgaaatcaacacaccttgcgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaataaaatagagaaaattatatataaaaaatggatactcaatgtttaaacactggatattgaaaatacctcttatttatcttaaaattatcatttcttttaccaaaaatttaccctatatccatacttatgtactatttataagaccctttaaaattcaaatttcatctaaatatatattcacttttacacataattttacttacacattttataagtaacattttctgta

SEQ ID NO: 12913 - DNA, 436 bp, Zea mays
  Clone ID: cC-zmpo14820013e05a1
gaactaaatgtagccagtacatgtaaccattcatagcatatattcgttcgacaacattcttgcatgctccatgcatatctggtcggtctcgtaattggtatttaatttagttcatgctgccttctggagtggggtcaatgggtaggccgtcttcgctaccagatggaggtgcgcttttaaagaaggggttcttgatgaccatcttgacgaactcaggcccgccatccggccatgtcatgggcgctcccgcagcaggcccctcggtggctgcagcagctggtgccttggcaggcgcatccgtctcttctttggctgcttcgtgtttccttgtggtcgttgtgctcgccggagatttgaccgcacagacggtcggtgccgccgtcgcggcgacataggccgtcagaatgaacaatgtgacagacaggttgcgcgccat

SEQ ID NO: 12914 - DNA, 443 bp, Zea mays
  Clone ID: cC-zmpo14820013e05d1
gcgtccgatggcgcgcaacctgtctgtcacattgttcattttgatttcctatgtcgccgcgacggcggcacggaccgtctgtgcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaaccccttctttaaaagcgcacctccatctggtagcgaagacggcctacccattgaccccactccagaaggcagcatgaactaaattaaataccaattacgagaccgaccagatatgcatggagcatgcaagaatgttgtcgaacgaatatatgctatgaatggttacatgtactggctacatttagttc

SEQ ID NO: 12915 - DNA, 516 bp, Zea mays
  Clone ID: cC-zmpo14820013e06a1
ataagaactgtacgcatctattgcagtcgcagggtaaattcgtgctcaaatacatattgctcaaggtacaatgttctctcgtttcttgaaaaaaaaaagggaaacagaaggacagatgaacagcacgtttgaaagcctgaaatgtgcaattggttgggcacacgcatgttctgaaatccatcttctagctctagcctctcatcaggtgcagcagtctcgtggatccacggtgatatcaaacaatgaacagcaggctgggtagtaatatgtacgtacgctccgggtacagcattcaatctttatgaagagactaaattaccatcactagcccacacatagcatgcttatataaattctgaccctagggtgtgggcacatgcacacttgctaacatgagatggcactagtgccgagctatgtatcgtgttggtgaaagccgcactcggttcagttgaggtggttcctgtcctcagggtgtacttcacgtcaggcagcgcctgcacaacgtcaggatgc

SEQ ID NO: 12916 - DNA, 560 bp, Zea mays
  Clone ID: cC-zmpo14820013e06d1
cgtccgcgttcctgccactactactactctcctccgcctcggttttcctggccaatgccgccggcagggagggcgaggatggccgcggccagcaagcggccacgaccgcgagcgtgtacgtggtgatggtgaaggctcctgcccagggcgtcgactccgaggcgtaccacatgcgcatcctcgccaccgcgctcggcagcgaggagaaagccaagcgggcgctgatctacagctacaaggccgccgctagcgggttcgccgccaagctcacgccggcgcaggtcgccgcgttgcagaagcatcctgacgttgtgcaggcgctgcctgacgtgaagtacacccttgaggacaggaaccacctcaactgaaccgagtgcggctttcaccaacacgatacatagctcggcactagtgccatctcatgttagcaagtgtgcatgtgcccacaccctagggtcagaatttatataagcatgctatgtgtgggctagtgatggtaatttagtctcttcataaagattgaatgctgtaccccgagcgtacgtacatattactaccca

SEQ ID NO: 12917 - DNA, 410 bp, Zea mays
  unsure at all n locations
  Clone ID: cC-zmpo14820013e07a1
gaagctgcagaggatcttgatgcggcctcccccaccagctccgcccgcgccgccgcagatgcaggtcggcgaaagatgcacgtcctcatctgtggtcgtgccctcggactccgtcgtcgtcaccattggcggcgcacccatcgcgtcttctatctcggccatggggtgccttcacttgaatcccagcagaagcagagcacgcgaaggaatatcccgtaaatatcagaccagagataacggaacgaagcgggagtggagtactaatccaaccaaccggcggcggcggcggtacgggcgacggacgaacagccgccgagcgacccagatcgagccggacaaaggaacaacaacaagggggcggaagcaagcgaagggcgacccccgagcccacgcgtccgcccacgcgtncg

SEQ ID NO: 12918 - DNA, 286 bp, Zea mays
  Clone ID: cC-zmpo14820013e09a1
ggagggaccggggttggatttaatgggggccccaactgtccttttatagggaacaaatgaacttccctgactggcccaaaccccattaagtttacaacccccctttcacaaaaggggaaaatgggattggtttggggcccctgtttttcctttcttcacctggggggtgaaaaaggagggatgctaacccactggaggtggaggtgaatttccccgttttccacgttcctgagggggaggaaaattttctggggaaaattggcgttcctccaaaaaacgtggtttt

SEQ ID NO: 12919 - DNA, 564 bp, Zea mays
  unsure at all n locations
  Clone ID: cC-zmpo14820013e09d1
cgtccggtcgcctaattctttcgatcgaattaggcgcttcctttttcccacgctccgtctttatttgtaatctgaaggttacaggaacatttgagtggatcatggacggattggtaggcctcttgaaagtccgggtggtgaggggcatcaaccttgcctaccgcgacgcatgaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcatgacatgatcctncgccttaggaacgtggagagcggtgagattcagctgcagc

SEQ ID NO: 12920 - DNA, 493 bp, Zea mays
  unsure at all n locations
  Clone ID: cC-zmpo14820013e10d1
cgcgtccgcggacgcgtgggcggacgcgtgggagcaatcaaccgtttgcctttaggagacgcgatgtcggggcggcaacgagatcatcgtggccttgctgagcgtggccctagtgggcctgctcctctgccaccttgacaccaccgncttcgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagccaaggtggtcaaaaccgagaactaattaagggctcgattgtgtgtccggctactactgntcttgccataattatatatagatacgcagagtgtggccaagcctacccacatgcatgctattgcatgcctgcgaatatatattatccgactcgat

SEQ ID NO: 12921 - DNA, 544 bp, Zea mays
  unsure at all n locations
  Clone ID: cC-zmpo14820013e11d1
gcgtccgngaacattcctcgggctggaattgaagcttttttgttttgtaatgacctccaggnggcatctggagataccgtctatgacttcttgctcagatgggcccgtgcacaatacccgaaatcagaagagagacgtgagatccttagttctcggctgctccctcttgtgcgattcagtcacatgacatgtaggaagctgcggaaggtcctaacatgcacagatatagaccacgagcaggcaaccaagtgtgtcaccgaggctcttctgtacaaagctgatgcaccacaccggcaacgagctcttgcagcggacacaacaacctgtcggaaattcgctgagcgggcttacaagtacagaccactcaaggtcgttgagtttgatcggccctatccacagtgcatagcatacttggatctcaagcgcgaggagtgctctcgactctttcctgcaggccggatatactcgcaagcgttccaccttgcagggcanggcttcttcctctcagctcactgtaacatggagcagcaaagcaccttctact

SEQ ID NO: 12922 - DNA, 617 bp, Zea mays
  Clone ID: cC-zmpo14820013e12d1
gcgtgcggctcgtcgttcggccgcatgcggtcaccgtctaccgttatgccgccgatcacgcccaagaaaggagcggggtcggtgtcagagcccatcgtcgttgtcgccgcagtggaggacgtggtggcggacaagttcgtggcggtggtgaaggaggcgatcaagaagccggagatggacgagaaggaggtggcgatgcggagattcctgggcagtcgggtgaagacagcgatggagccgcggtcagagtcggagcagccgcggcgccgggaggtggctcggagcaacgacgtgatcgaggcggcacgcaccaagctgatgcagaagcgccagtgcagcagggtcaaggcgctcgtcggcgccttcgagactgtcatagacacccagaaggacgccgccgtcggcaggccacaacacatctaccgcaagtcagcttaaaacatactgcggcggcggggacgcatcgatcctccacgcttcgtgtcttcgccttaattaattaattaattgttatgatcatgtcggccagcccaacgccgtatgcatgcatgcacacggcgctaattaatccctgtttattactactccgagaaatgtagtttctccgtttacacgga

SEQ ID NO: 12923 - DNA, 466 bp, Zea mays
  Clone ID: cC-zmpo14820013f01a1
accttcctggacgtcgaccctggctgcgacaggccggccatctggtcggcgtcgatggagctgatccgtatcaccgacgtgctgccgctggtgttctgcgggttgttgaactcggagcacgtcttcctgatctcgccgtccttccccgtgagaaccttgagggcgctgagcttctccatggccttggcgaagatggggacgaagtcggtagtcttgtccgacatggccttcactatgggctcggtcgtcttgtccatccccagcaggcggtcgatggtgaggggcatcttcttctccagcaccaggccgaagtagctcccgtccatgtcgttgggcgaggtggagtccatggggacggagcccgagtccttgccgtcgcaggcgtcgctgatcttcttcttgaacgcctcgtcgatgggcgcggcgtcggtctcgatgaagaagcacctgcagacgccgatgctgt

SEQ ID NO: 12924 - DNA, 436 bp, Zea mays
  Clone ID: cC-zmpo14820013f01d1
gggagatgatcgcgatgctgggcggcggccacttcaacttcgactgcaggtgcttcttcatcgagaggcgacgggtcacccatcgacgaggcgttcaccaagaacatcagcgacgcctgcgacggcaaggactcgggctccgtccacatggactccacctcgcccaacgacatggacgggagctacttcggcctgctgctggagaagaagatgcccctcaccatcgaccgactgctggggatggacaatacgaccgagcccatagtgaaggccatgtcggacaagactaccgacttcgtccccatcttcgccaaggccatggagaagctcagcgccctcaacgatctcacggagaaggacggcgagatcaggaagacgtgccccgagttcaacaaccccggagaacaccagcggcagcacgtcgctgatacggatc

SEQ ID NO: 12925 - DNA, 454 bp, Zea mays
  Clone ID: cC-zmpo14820013f02a1
aagggcagcgttgttaggatcatatattcaaagaagtggctctgcttacaaagttacaatttttttccgcgaggctaagacaggtccatgtcagattttccattgtcgtgagcctcagacgtaacgaaggcatctggcacacttgattgcagcgtgatgataaaccgggttcacagagagattaagaggaaaaaaaagggaggagggaataaagaagcgtcgtcgtcgtaaagaaatatggcaaacgtgtagacttcagtctgcgtgatatatatgcatgggtggttgttggtcgctccgatcctagttgtcctcttctttctcatcttgcggtggcgctggttccggcggttgctcctcgtcagccacgtccggcagaacctcctgggacgggctcttcttgttcatgtggttgtagctccccttctccatgaacagctgcgcgaagtggatc

SEQ ID NO: 12926 - DNA, 548 bp, Zea mays
  Clone ID: cC-zmpo14820013f02d1
cccacttggagcagctcttcaaggagaccgggtgctttttcaagaacttcacgccaggtggcaagggatcgggcaaggttgaactgacaagggccccaagcaagctgtcgtctgcattttctggtacccaggataagtgcgcagcatgccagaaaacagtgtacccgctggagaagttaactctggaaggcgagtcctaccacaagagctgcttcaagtgctcgcacggcggctgcatcctgaccacctcctcttatgccgcgctcaacggcgtcttgtactgcaagatccacttcgcgcagctgttcatggagaaggggagctacaaccacatgaacaagaagagcccgtcccaggaggttctgccggacgtggctgacgaggagcaaccgccggaaccagcgccaccgcaagatgagaaagaagaggacaactaggatcggagcgaccaacaaccacccatgcatatatatcacgcagacttgagtctacacgtttgccatatttctttacgacgacgacgcttctttatatccttcttccttttt

SEQ ID NO: 12927 - DNA, 493 bp, Zea mays
  Clone ID: cC-zmpo14820013f03a1
gatagttgaactgtgaagaatcatgtattggtactgtacgtgtccatggatctttaatggccacaggtgccatgaaaataataccgcacaggattagagggggtttcaatgagtgatcgacatgccgacggacacatcgatcatcggccgcaaccgttcatccttcatcggccggcgaggcagccaggacgccatgcgacgcagctgttcgcgcctattggcagtccgccaacaggcactggcaatacggcctccacgaccatgcccagttgcagcggccgtccgcgtggccgtgatcctggcaggtcgccacgcagtcttcgggaaagcagatagggtggtggtcgtcgtccttccagcagctctcgtcatgagcagtcgacaccgttgcgctggaggcgacgatgagcagcacaagaagggcacagcacaccgcgggcttcctccgagcctccatggcggaaagaacgaatcgaacgaacgggacgggtcg

SEQ ID NO: 12928 - DNA, 513 bp, Zea mays
  Clone ID: cC-zmpo14820013f03d1
gcgtccgccaaaagtaagctgctgctgctcttcgaccctttccgttcgaacgattcgatctttccgccatgggggctcgtatgaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgaggaggccgtattgccagtgcctgttggcggactgccaataggcgcgaacagctgcgtcgcatggcgacctggctgcctcgccggccgatgaaggatgaacggatgccgccgatgatcgatgtgtacgtcggcatgtcgatcactcaatgaaaccccctctaatcctgtgccgcattattttcatggcacctgaggccattaaagatccatggacacgtacagtaccaatacatgattcttaac

SEQ ID NO: 12929 - DNA, 446 bp, Zea mays
  Clone ID: cC-zmpo14820013f04a1
aaaaaaaacccccagaatgttgttttatcaaaccccccgggggggaaaacgggaaaccccaaaggtttgtttttttaaaaaggggaccgatttttttccccgattaaaaaatgtttgccaaaaagggggggatttttttttggcccatggaaaataaggcttaacccaatggacaggcggcaaattagttaaggggggggttccccttcccaaaaaaaatcccccccgggggggtttttttaaattttggggggggcccgggtgcccccttggggggggaaaaatttcccttgggagggacgggggaggggttctccttttgaaaaaggggtttttaaaaaaattcctccccttttttggtcaaagggtaaaaaaaaagaaccgccatttccaaagggggccccccactaccaattgggggggggcaaagggggggggggggtttt

SEQ ID NO: 12930 - DNA, 552 bp, Zea mays
  unsure at all n locations
  Clone ID: cC-zmpo14820013f04d1
gcgtccgcaagaacctcctcgcctcctccattgaccaattttnattcctccccgaccgccacatctattaggggcaggcgtgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaagagatatagatggagaatgagaagccatcgctaagctaattgactgcatgtccattggctgatgcctg

SEQ ID NO: 12931 - DNA, 484 bp, Zea mays
  Clone ID: cC-zmpo14820013f05a1
gaaccactgaatatggattgaatgaatctggttaatatatacagggattggactaaatgcctgtcctatccgaacagcgctactcgtttacacatcagagcagctcgtctacaggcaattctgcttcccaggttcattcattaataatgtggtgaatggctaccgaatcatgttctgatgatggcaacacaggcgcctctgtaggccagcagtggagggagtttaggccgaggtcccgccaagctgtgtggccatgcgaaccatttttatcatccagccacaagggcccgttgatccgaactaatgaagccactgcatgctggatgttgacatatatacaggtgacgtggacaccgctaggtgctttggtgatcatgacgcgcctaccgccatttctggtgggttctcttgtgcctcatccttgcccagcaatgctggtgtgactgaaacaacaccgatcaggaatagcagtgctatcgactgg

SEQ ID NO: 12932 - DNA, 507 bp, Zea mays
  Clone ID: cC-zmpo14820013f05d1
gcgtccgaaggcaaggaaagtgggaaggtaggagagagatggagttagggaaagctctcttcctcctcctcctgctgtggaattccgtctcttgtccctgtcgtcctcgcccggtttccccggtttttgagaggggaaagaggaggcggaggagagggatggggagggacgagaggttcccggtgtgggaggccgcgctcggcgccggagtcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgcttgctggtgctctgtttgggcactgcgtggccttgcgctggtgggctttgctggcactgcatgtgcttcttt

SEQ ID NO: 12933 - DNA, 173 bp, Zea mays
  Clone ID: cC-zmpo14820013f06a1
gataaacaaacggcacacacctcttatttaggcagggggcaagccaaggcacccttttacaatatatattgcttgcttctccccgcataaaaaatgtagaggtcaccaaacagacagacagaccagagcggatcaggttcctctcctccctgtggccatgacatgagacgtca

SEQ ID NO: 12934 - DNA, 179 bp, Zea mays
  Clone ID: cC-zmpo14820013f06d1
cgtccgtgacgtctcatgtcatggccacagggaggagattaacttgatccgctctggtctgtctgtctgttgcgtgaggtctacattttttatgcggggagaagcacgcaatatatattgtaaaagggtgccttggcttgccccctgcctaaataagaggtgtgtgccgtttgtttatc

SEQ ID NO: 12935 - DNA, 456 bp, Zea mays
  Clone ID: cC-zmpo14820013f07a1
aaagaaagggttaagtctttattcatcttttaccacgtatgagtttagtactccgtacaacacttgcatatagccacgaagcgagcggaacagcgctgtaaaacatgtctacaaagacggagtggtagtagttgcagtagccctggcagtgacaattgctccagcctcggggagcagaggcaccagcttcccaccgtcgggcatcgccatggttgggtcacagccaccaatccgctcccctttcacgaagacattgggaacagttctttggccagtccattcagcgagagctgactggagctcagcgccatcactttccacatccaactcaatagccttgtaacttgcccccaactttgctagcaattgtttcactcgggtgcagaaaggacagtaagttttgctgaagaccaccacggggtgggaggcgacggtctccttggcctttcggagagc

SEQ ID NO: 12936 - DNA, 570 bp, Zea mays
  Clone ID: cC-zmpo14820013f07d1
gcgtccgctccccacaaaaccgtcagttctcttttcccttttaatttgcaaattcgtcttccctgcccatctagcgctgggacacctctgcaagggagcacatggctctcgagaaggccaaggagatcatcgcgtcctccccggtcgacctagctctccgaaaggccaaggagaccgtcgcctcccaccccgtcgtcgtcttcagcaaaacttactgtcctttctgcacccgagtgaaacaattgctagcaaagttgggggcaagttacaaggctattgagttggatgtggaaagtgatggcgctgagctgcagtcagctctcgctgaatggactggccagagaactgttcccaatgtcttcgtgaaaggggagcggattggtggctgtgacgcaaccatggcgatgcacgacggtgggaagctggtgcctctgctcaccgaagctggagcaatcgtcactgccagggctactgcaactactaccactccggctttgtagacaatgttttacagcgctgttccgctcgcttcgaggctatatgcaagtgttggacggagtacttaactca

SEQ ID NO: 12937 - DNA, 208 bp, Zea mays
  Clone ID: cC-zmpo14820013f08a1
gacgacgttcatgctgaagctagtcttttcctttctggggccgtcgctctcggcagcatcgacgggcgccgcgtgctggctcagcagcagcagccctagcagggccacgcccagcagcgtcatgcgcagctcgacggacttggacgccatggacctctgcggacgcgagctcagattttggcagggatgacagtctgccgtttattcg

SEQ ID NO: 12938 - DNA, 215 bp, Zea mays
  Clone ID: cC-zmpo14820013f08d1
gcgtccgcgaataaacggcagactgtcatccctgccaatttcagttctcgcgtccgcagaggtccatggcggggaagggggtcgagctgcgcatgacgctgccgggcgtggccctgctagggctgctgctgctgagccagcacgcggcgcccgtcgatgctgccgagagcgacggccccagaaaggaaaagactagcttcagcatgaacgtcctc

SEQ ID NO: 12939 - DNA, 410 bp, Zea mays
  Clone ID: cC-zmpo14820013f09a1
gtcatcctgcgaaagaaacgatacattcccaaatctcagcgaaaaaacataaccaccagtccaactcacatgcacttagagacaaaatacaaatattgcaatccacaggacaaacccaatgaatcatcatcagcatataaaagccgcactggcattctcatcgctgcagtagagcccaggctgttgggtgtagccctgtttcgacagcatcttgcgcgctttcagcacgagctccttgttcgttaccgacccacgctccgcgaggatggcctggatggcattgctgaacgcaccgtaagacccccccttcgcgtggtcgcgtccgcagacgtctggtcggtctggcacccactgatcaggacaccgttgctcggcacccttgccgtggtcccggcgtacacctcttgatc

SEQ ID NO: 12940 - DNA, 537 bp, Zea mays
  Clone ID: cC-zmpo14820013f09d1
cgtccggaacggtcgaaccgacgaaagcacgcacccctttgccttgtaccctcccctcacccgctcaccatgggcgtgcgccgttcggcgcgacgcggattcgaatccggaaagcgggcgatgggggcgaagcgcgcggtgctggtgggcatcaattaccagggcaccaaagcggagctcaagggctgccacaacgacgtcgctcgcatgcgccggtgcctcgtcgaccgcttcggattcgacgagtccggcatccgcgtcctcatagatgacggctccgcgccgcagcccacgggggccaacatccggcgggaactcgcgcgcctcgtcggggacgcgcggtccggggacctcctcttcttccactacagcgggcacggcatacggctgcccgccgagaccgggaaggacgacgacaccggctacgacgagtgcatcgtgccctgcgacatgaaccttatcacagaccaagatttcacggagcttgcgcaaaaagtccccagtggctgtctctttaccatagtttctgatcgtgcc

SEQ ID NO: 12941 - DNA, 377 bp, Zea mays
  unsure at all n locations
  Clone ID: cC-zmpo14820013f11d1
gcgtccgagaggaactatggacaagaaanacatattttagngctttagncacactctacatctngctatggggcgacgcgccgatctgggcagagactgacgagggcatagcacaggctatcatccggtccaacatcgacttccgcagagagccttggtcaaaggtgtccgaaaatgcaaaagatcttgtgaggaagatgctcgatccaagcccctactgtcgggtgactgcccagcacgttctagaacatccctggatacagaatgccagtgcagctcccaacatcccacttggagaagcagtgaggcccacgctgaagcaattcactgttatgaacaagttcaagaacaaggccctgcttgtggtggcagagtac

SEQ ID NO: 12942 - DNA, 350 bp, Zea mays
  unsure at all n locations
  Clone ID: cC-zmpo14820013f12d1
cacgcatccggacaanacatgagaagatgacgactaatcgctggcggatccggaaggtctggcctggtgggtgataaacgccgcgtggcatcacggactaccgctctgtatcgagagcgctcttacctgccgtagtggcgaggcgtattccaccatgctcgacacggagaatcctaaggacgatcctgatcgttaccatgccgctttcattgattaccgacagcagaagcagtccacgctccgagaacctagcctatctgagcagtgcacttttttaaagtgcatgcacggagaggctccccatagggtggagggttgaatgatagtagaaactgacgcgctgactctac

SEQ ID NO: 12943 - DNA, 490 bp, Zea mays
  Clone ID: cC-zmpo14820013g01a1
gtaacgagcggtgatatttacatgctgtctgcttacataaaaaaaactaccaatcaacttgagttgaccagcaggatacataaaatccattagataaaatgtacagacaacaacatatactcctgtataaatggatcaaccacgaactcgccaaaaaaatcggcataggtggtttgtgatcattctgcttaagtaactagtaactagtgccagcttctgtgacgaacaattacaacaagttgaaggagcgttgcagcttttgggtcaagaacaggcatggaactacacaagaacctgcgacttggccgcacgacgtgagcatttggtgcgagcattcttattcaagctgcaagcacaaccttccagcagctcgaagtcttcatcgcatactagtatggatgccatctccggacagtccaataacatcttagagctaagatatccagcaatgctccaagtttgatatagccgcgattgcttcccaatgaac

SEQ ID NO: 12944 - DNA, 496 bp, Zea mays
  Clone ID: cC-zmpo14820013g01d1
gcgtccggttcattgggaaggaatcgcggctatatcaattttggttcattgctggatatcttagctctaaggggttatgtgactgtccggagatggcatccatactagtatgcgatgaagacttcgagctgctggaaggttgtgcttgcagcttgaataagaatgctcgcaccaaatgctcacgtcgtgcggccaagtcgcaggttcttgtgtagttccatgcctgttcttgacccaaaagctgcaacgctccttcaacttgttgtaattgttcgtcacagaagctggcactagttactagttacttaagcagaatgatcacaaaccacctatgccgatttttttggcgagttcgtggttgatccatttatacaggagtatatgttgttgtctgtacattttatctaatggattttatgtatcctgctggtcaactcaagttgattggtagtttttttatgtaagcagacagcatgtaaatatcaccgcttcgtac

SEQ ID NO: 12945 - DNA, 254 bp, Zea mays
  Clone ID: cC-zmpo14820013g02a1
aaaaaaaacccccagggggtgtttttataaaacccccggggggggaaaaggggaaacaaaaagggttttttttgttaaaagggggaccggttttttttcccaattaaaaaatgttggccaataggggggggattttttttttgcccattgatcatggggcttcacccaatgggccggcgggaaattagcttgggggggggttccccttcccaaataaaatcccccccgggggggtttttttaaaagggccccgg

SEQ ID NO: 12946 - DNA, 451 bp, Zea mays
  Clone ID: cC-zmpo14820013g02d1
gcgtccgattgaagaaagacaccgaggaggagatatagtttgagatggagaagccatcgctaagctaattgagggcatgtcaattggctgatgcctgatgatcaatgtgcaagaaagagatcgaccactaattggcatacatgtttaagtcgggagagagactcggtcaccttgtaaacaaaacaaacctttgatgtctcccgttttccctccatggggttctgataatacaacatcctggggcttattgaaaaaaaaaaaaaaaaaaaaaaaaaaaaaaaaaaaaaaaaataaaaaactaaaaaataactaataaaaataaaaaaaaaaaaaaaaaaaaaaaaaaaaaggggcggcccttttaaaggttccaactttactacccccttcttgcaacttaatacctcttttttggggtcccctaaattcaattccatgcccgtctttttaa

SEQ ID NO: 12947 - DNA, 572 bp, Zea mays
  Clone ID: cC-zmpo14820013g03a1
aatacagcattcccttggtatacaagtttatccttccgtatgacagaattccagcttatgttggaacacttctaagtatgtgccgcaatcaacactgcacatctcattcaaaaaacaaaaggcctaatagatgtagaaattaaactaaaatgtttgtatcggctcctctagcattttggtgttgtaaaccacacctctggttacctagaaacaagcaactaacctgtatattaatctgacatcaccaattcacagtcatgcacctgaaagcctgatatagtagtgggtgtttcacctatcccaagtcatatatgaatataatagtactctccctaggaagtgatacctctgcttgtctgattgttattaacagtatagttgcccatatagcttgctgatatttctgatttgatatctggatcatcatttccaagatcatgaccaaaaggaggcatatcaacctcagatgagttgaacctccaggttgagtcaccataaatagagctgctgccatatgcacctggattgttcgattcatatgcattggctgatgcagaaaatggctcaccaat

SEQ ID NO: 12948 - DNA, 547 bp, Zea mays
  unsure at all n locations
  Clone ID: cC-zmpo14820013g03d1
gcgtccgcatgaattcttttgctcaacctggaagtggttttggtttttctggtgatgaaattagttggggaaggcttagttctgctcatgggatgggcaacatttcaagccttggatcaggaaaccttggccgtggaaccggagataacaactttggcttgccttctggaaactatgttaggagcaactcaactggtacaattggtgagccattttctgcatcagccaatgcatatgaatcgaacaatccaggtgcatatggcagcagctctatttatggtgactcaacctggaggttcaactcatctgaggttgatatgcctccttttggtcatgatcttggaaatgatgatccagatatcaaatcagaaatatcagcaagctatatgggcaactatactgttaataacaatcagacaagcagaggtatcacttcctagggagagtactattatattcatatatgactngcgataggtgaaacacccactactatatcaggctttcaggtgcatgactgtgaattggtgatgtcagattaatatac

SEQ ID NO: 12949 - DNA, 384 bp, Zea mays; identical to SEQ ID NO: 12400
  Clone ID: cC-zmpo14820013g05a1

SEQ ID NO: 12950 - DNA, 392 bp, Zea mays
  Clone ID: cC-zmpo14820013g05d1
gcgtccgaatgccgccatgggatatggccacgacgtctttcttattttgtgtacgaggggtggtgtcttgggaggcctcgccgtcgcatgtgcctggttcagtcaactcgggcttggcgcgggtgccgcgcgagagctaagacttgttcatccacgtttgtcgctgcagtgcgtccgcttctcagctaggcctgctctaaccattgcttaattaccggtcaagaacaggtaccataggatgaggctcatggaggatgatgcgatgtgttcatgagaggtctaggccgtcgtctcccagtcaactttaggttgctagaccgttgtctccttttgatgtaattatttattttgtatagaactcttattatatagtaaagatgtgacatttgatc

SEQ ID NO: 12951 - DNA, 384 bp, Zea mays; identical to SEQ ID NO: 12400
  Clone ID: cC-zmpo14820013g06a1

SEQ ID NO: 12952 - DNA, 391 bp, Zea mays
  Clone ID: cC-zmpo14820013g06d1
gcgtccgaatgccgccatgggatatggccacgacgtctttttatttagtgtacgaggggtggtgtcttgggaggcctcgccgtcgcatgtgcctggttcagtcaactcgggcttggcgcgggtgccgcgcgagagctaagacttgttcatccacgtttgtcgctgcagtgcgtccgcttctcagctaggcctgctctaaccattgcttaattaccggtcaagaacaggtaccataggatgaggctcatggaggatgatgcgatgtgttcatgagaggtctaggccgtcgtctcccagtcaactttaggttgctagaccgttgtctccttttgatgtaattatttattttgtatagaactcttattatatagtaaagatgtgacatttgatc

SEQ ID NO: 12953 - DNA, 476 bp, Zea mays
  unsure at all n locations
  Clone ID: cC-zmpo14820013g07a1
ctggtaaaaacagccagaaaaaccccccaaccaaaccccaggaacccccccccccggcgacttcataaaagggaggggaggggagggggggaaaaggaccccgccgcccaaccaaaccgcccgggggggaaacccgggccaaggaccgccgggggggggcaacaggcggccggggggggggggggggggggggggcaacacccccgggggaacaacggggggagccccggggggcatcttcccagaccccaaaaaaaaaacaccccaaaaaagccccccccgggggggaccccacagggggggatgagggggggggggcttggggggcccgagagggcgggcgggggcggccccgggggaccacccggaacccgggggggggccccccgggggcaaaaaaaggggcaaagaagggggggcgaaaaaaggggggggcaagccggggagagggggaattgggnaaaaaaaataccccc

SEQ ID NO: 12954 - DNA, 378 bp, Zea mays
  Clone ID: cC-zmpo14820013g07d1
gcgtccgatcaggcgcagacgaagagaccaccaatgacttaaacttctaattacctcctgtagggatccctcgtgcgggtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgcagaatgacgaatagggctggtgtgtgttacagtatggtccttttcccctcctttccattaagctctgtgatgtagctgtccgtgctgttgattcatgagatcatgctagagatttttcctggcaaaaaaaaatataaattaaaaatctaaaacataatt

SEQ ID NO: 12955 - DNA, 506 bp, Zea mays
  Clone ID: cC-zmpo14820013g08a1
agtaataaagaagcacaaattagcatgttatagaatcatatatataggctgccctacacgcgtgcctctcaagtctcaacgagccgtttcatcccacggtctcaagacatgtgccacgccgcaagaggcaacaccgaaaagaaggacacgcgctaggtccgcatgaagtcggcatgcgtccagtctatcgactgacagacacacgcgaccagcatcaaattacatatgttttaggccggacgacgacgacgacgacgacgttaccgaacgtagtagggggtcgggaaaaagaaacaaacaaatcaatggacatgttcgtaagggatcatgttggagagcgtgcggcagatctcggacatctcgatgagcgacctgttgtggtcctccatggggttcttggagacggccttcctgaactcctcgtcgcagttctgcgtgtcctgcgccaccatgctcatcgtggcgcggatggtgacggcgtcgcggtagccgatggcgcgcttgca

SEQ ID NO: 12956 - DNA, 537 bp, Zea mays
  Clone ID: cC-zmpo14820013g08d1
cgtccggtggacgcggtgacggtgctagagatgcaggttgactctgttcaagaagcgcgtgaaggcggcgcggaggctggccaatgaggaggtcaagacggccgcgacgcccgaggcgcggagggcgctgaacctctgcaagacctactacctggacgccgacgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtgtctttttcccgaccccctactacgttcggtaacgtcgtcgtcgtcgtcgtcttccggcctagaacatatgtaatttgatgctggtcgcgtgtgtctgtcagtcgatagactgtccgcatgccgacttcatgcggacctagcgcgt

SEQ ID NO: 12957 - DNA, 420 bp, Zea mays
  unsure at all n locations
  Clone ID: cC-zmpo14820013g09d1
ggatggcttaggttcagtggcctgtccctcgtttctacttcttggcacaacttgatcagccgacagggaagcgaacattcgccgcctcctgctgccgcaacctctcaaccatgaccaggcagcgctgtacgggatcctcagcttgtaaaaaacacgcacacacacgcatggctcatccatccatccatccatgctacatttgcagtcatttgctgttattttccaatcctggttagttcttgtaagctaaccccgcatccgataagctaatcctgtaaatggcgcaaggagcatcagctctggactgctcctgttgtagagaaaaaaaaatactacagctatnagttggggaaggagggcaatctggaaattcatccaaagctttgtggcgaaaaaaaaaaaaaattcaatcaaaaaata

SEQ ID NO: 12958 - DNA, 553 bp, Zea mays
  unsure at all n locations
  Clone ID: cC-zmpo14820013g10d1
cgcgtgcgcttcggtggtccaccatggcgcagcgagctttggcctttatgacgactaataagcccctcctggtcctcggcctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgnggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgccgtggtctggaacgacactgcggccacgaacggcaaggacggaagccggtgggcacagtggggagcgccacgctggcggtggagtcggactacttcacggcgtac

SEQ ID NO: 12959 - DNA, 325 bp, Zea mays
  unsure at all n locations
  Clone ID: cC-zmpo14820013g11d1
cgcgtgcggcaagggcaacatggcggcgaccagccgttttctgctttctgnncgacaccgaaacggagctagcganctggtcgactgtaacggtgacggcgaccacacctcagtcgcggcaggcggggctcagtacctcccgccaaagaggctctggattccgggcgtggcggagggatgtgctgaggccggacaggacggccggcgaagcttgggcgccaccggcgcccaaggccaacggcaacgtcccaggagggcccttcggccgccgatgactcatccagatccagtcgcccccgcccaatcgccatcgtttcatgacaca

SEQ ID NO: 12960 - DNA, 498 bp, Zea mays
  Clone ID: cC-zmpo14820013h01a1
gcctcaatgttccgaccatgtattaaaatttgacggaaggcaaagattgtggacatttggacaacggttgcagaatgcaaagcaagaactggagccctcgatctcaagaaactaagcagggagatctaccggttgcattgtagcagccagcccatacaagacgacgtgtgcgtggcggcagatcatctgatcagctgatcaattaagagcgctagctatcattcccttgccgttcctgcagtgtgccgcccccgcacggacgcgcgcgggcctccgggtgcatgaggagcttgaacctgccgtcctccttgcagggctgcagcagctcctgcgacggcaggcgcatctgccgcagcacgaggcgtccaccctcgcggtgcgcccgcaagcagagccacggccgcccgcccttgccgatcacggagatcggcggcgggaacgcccgcccgctcctcgtccgcctcaacatgatcacgtcgtgctggtagtggtcgtcgc

SEQ ID NO: 12961 - DNA, 422 bp, Zea mays
  Clone ID: cC-zmpo14820013h01d1
cgtccgcctccccttcccgggctcctcgaccacctcatttagcttctgctccgacgacgacgacgtgccgtggcattggcatggttgacgacgccgtcggcggcggaccggccgttcgctgcgcagggcctgcgcctgcctcgctgtcttctagcaggaagcagcatcagcagcccgacgacgccggctgccgctgctgcgacgaccactaccatcacgacgtgatcatgctgaggcggacgatgagcggtcgggcgttcccgccgccgatctccgcgatcggcaagggcggacggtcttggctctgcctgcaggcgcaccgtgagggtggacggctcgtgcttcggcagatgcgcctgccgtctcatgatctgctgcagccctgccaggaggacggcacttcacgctcctcatgcaccctg

SEQ ID NO: 12962 - DNA, 503 bp, Zea mays
  Clone ID: cC-zmpo14820013h02a1
agcacattggtgtcgtggcgtttcattcttgcaatgatcgtgagaagtacaggtgaaaatattgttgttggcgtggtatgtgaggacatatgtattatccacgaaactagaaaacctgagtctaggaaaaaatgattatcttgaaacgaaacaaagaatatacatgttgttttttcctgacttgcgagttcgatacatataccccagaaccgctcttgagacttgagagagccatgtccaaactacttactagaaatattaagcagtagctacgcacagcggcaactcttgagtgcgtagtgcgtggatgagatcacctggccctcttcttcccctcatctagaatcttctagaacgtagaggcaaggacaagaaagaaaccagttagagaggagagaacatggatcactaatgggtgcgcacgtgctccatgcgcctcagctatgtacacgacgtaagcaaggatcgattgggtcggatcggatgggaggagccgtcgtctc

SEQ ID NO: 12963 - DNA, 466 bp, Zea mays
  unsure at all n locations
  Clone ID: cC-zmpo14820013h02d1
gcgtccggctactcgcgcgtgctggagagcctggcgcatttcgttttgncccgcatcgaggacgtgctgagcgggggcgctgcgttacagaacctgacggcgaccgacgcggcgcggcgggcgctggagacggcggacctgctcgcgccgcggaagctggacgccaaggaggagctggagaagctgaacgaggccccggcgtcgatgacgctcttcgacttcatgggctggcacttcgaccaggacgagctgatgaagcgcagggaggacggcacgctggacgccgacggcgaggccatgctcctcaagaaggcgcccagcgtggcgcccaagaagttctcctacgtcgacagcctctcctccggcggcatgaggagcccctctgcgcgccactgattataatatatgatccgcgtcgcgccactgaactaacaacagcttagtcattcgttacgatccaacagca

SEQ ID NO: 12964 - DNA, 206 bp, Zea mays
  Clone ID: cC-zmpo14820013h03a1
ctggcgggaaaccccaaggcttaccgcgttcccccctaggggacctcccaatggcgggccacatgtacacctgtatttaaaaaggggcctagaaaaaaaaggaaaacaaatctgccaaatgggcgtctaaaaagactttagcgcagaaaccttacgggcctcccaccggacgaaaaaaacaaagagggggcaacaacaaagggctc

SEQ ID NO: 12965 - DNA, 93 bp, Zea mays
  Clone ID: cC-zmpo14820013h04a1
ccacccaagagcgcgggaagttcatacattggcccatttttgtttttttttaccgccttgatccatttcaaagaccattaacatgagcggccc

SEQ ID NO: 12966 - DNA, 92 bp, Zea mays
  Clone ID: cC-zmpo14820013h04d1
cgtccgctcatgttaatgggctctgatatgtatcatggttgaattttagaacagaaatgggcaaatgtatgagcttagcgcgctcttgcgtg

SEQ ID NO: 12967 - DNA, 74 bp, Zea mays
  Clone ID: cC-zmpo14820013h05a1
atacaaaaaaaagacctttttagtccatagggtcggagaactcctctctgtttacaaagtttccaaatttttcc

SEQ ID NO: 12968 - DNA, 481 bp, Zea mays
  Clone ID: cC-zmpo14820013h06a1
acttctcaagaaaaggaaacaactttcaacttggggatttacatagcgcaattgcaatacacagatgagggtggtaattctctctacagaaaacaaaacaagaacgaaaaactctgggcctctattttctttacaattgctgaagcacctccccccctccttttcctcagatggatggtagtagcagtccggtagtcgacacaggaaaccagattagtaccagctgttcatatatagtacacctgaaagaaaactagcgttacgggtttgatcctggccttggacctctcaaaatatctcgtcctccgcttggagcttttgaagcgctttctttgcataaatagagatagcagcagtggaagttgcaccaattgtaaagccgattccattgtagataatctgatccaccgacaagaatgacccttggctagttgctacagccaagctctgtagaagattcccactgtatattgcaaggaaa

SEQ ID NO: 12969 - DNA, 519 bp, Zea mays
  Clone ID: cC-zmpo14820013h06d1
gcgtccgattacccatacatggctggttccatggctggtttcatttatgaaactttccttgcaatatacagggggaaagttctacttagcttggctgtagcaactagccaagggtcattcttgtcggtggatcagattatctacaatggaatcggctttacaattgctgcaacttccactgctgctatcactatttatgcaaagaaagcgcttcaaaagctctcaagtatgatgactagatattttgagaggaccaatgacagcatcaaacccgtaacgctagttttctttcacgtgtactatatatgaacagctggttctaatctaggttcctgtgtcgactaccgtactgttactaccattcatttgaggaatacgatggtgtgatggtgctttatcaatttgtaaagaaaattgaggcccatagttttacgttcttgttatggtttctggatagagtatcaccaaccctcattgtgtattgcaattgcccttgtttatccccagttgaaagttgtt

SEQ ID NO: 12970 - DNA, 497 bp, Zea mays
  Clone ID: cC-zmpo14820013h07a1
gcgttgccggcgttgttctcctcgatgaagctgatggtggagttgatgaagaggaggacgacgatgccgacgaagtcctgccagtcgggcggcttgcccccgccgttggcgagcacgatggccatgatggcggcggcctccatgacccaggagagcgggttccacatgaagcccaggaacttgagcagcttgctctccgacttctcctccagcttgttgggcccgaagatcttgagccgattgtctccctcggcgctggagagcccctccttgctgcatttcaggtgctggaacacctcctgcaccgggacggtctcgaggtcgacggtctcgttgcggacgtcctcgagggagatggacgccattgtcgtttattagtcgacgccgctgctagctaattgtggtggtcggcgtcgtgcggtggtggcagccggcgcgcgcgcggcggacccgaggaccggggagggaggcggcagctagcgctggcttcgctcccg

SEQ ID NO: 12971 - DNA, 486 bp, Zea mays
  Clone ID: cC-zmpo14820013h07d1
gtccggggcaggcccggcgtccgtcccgttccatgaattccttttccgagcgggcaggcttttaagtagggggcgatgtagagctagcggccaatcggccgggagccaagccagcgctagctgccgcctccctccccggtcctcgggtccgccgcgcgcgcgccggccgccaccaccgcacgacgccgaccaccacaattagctagcagcggcgtcgactaataaacgacaatggcgtccatctccctcgaggacgtccgcaacgagaccgtcgacctcgagaccgtcccggtgcaggaggtgttccagcacctgaaatgcagcaaggaggggctcttcagcgccgagggagacaatcggctcaagatcttcgggcccaacaagctggatgagaagtcggagagcaagctgctcaagttcctgggcttcatgtggaacccgctctcctgggtcatggaggccgtcgtcatcatggccatcgtgctc

SEQ ID NO: 12972 - DNA, 498 bp, Zea mays
  Clone ID: cC-zmpo14820013h08a1
ggaccattaattacgggcggcattccaaacacaagagttatatacaacacaaccttgcattgttacgatcgatcgccaatgatgaaagctgcagcctagagctgcacacgcactagcacttcctgccgacgcggcagttgagcgcgccggcgtacctggtgagcgactcggcgtactggccgcccttggcctggatgaggtcgagcctgtcgtacttgcgctcgttctggccgccggactggttgaagaaggcgccgttgaggaacaggtcgtcctgcgacttccacacccagttcttgtactcgctgtactgcgtgtactcccgcttggtcacctccttgaacctgctgtcgtcgacggcgcggaagcggttgccctggctgatgatggtggggttccggctgccgccgatggcgtacatgagccagtgcgtgtagtcggtgttcaccacgtggaaaaagccgtgacggcagcgcgggatccgctgcaccaacccct

SEQ ID NO: 12973 - DNA, 585 bp, Zea mays
  Clone ID: cC-zmpo14820013h08d1
gcgtccgggggctggccggcaagttctacgtggtgatttacccttgcgacgacgccgccgacctcgtcaccgccagggagggcacgctccggcacgccgtgacccgggcccgggcgctgtggatcaccttcgcgcgcgacatggtgatcgagctctgccaggagctcatcgtgagcagcgacaagaccatcgacgggcgcggagcgcaggtgcacatcgtgggcgcgcagatcacgctgcagaacgtgcgcaacgtgatcctccacaacctgcacgttcacgacgccgcggcgcacggcggcggcgcgatccgggactcgcagcaccactggggcgtgcgcggggagagcgacggcgacggcgtctccgtgatggggtccagcgactgggcccgcgaccgcaagcgcctggccaggtgcgccatgggcttcggccacaggaccacttcggcaaggggctggtgcagcggatgccgcgctgccgtcacggcttcttccacgtggtgaacaacgactacacgcactggctcatgtacgccatcggcggcagccggaaccccaccatcatcagtcagggcaaccggtt

SEQ ID NO: 12974 - DNA, 298 bp, Zea mays
  Clone ID: cC-zmpo14820013h09d1
atgctgatgctgcgtgtcaccgcgtttttagagtatggccggagctacagggtgaccgtgggctctgcgagaattccggagctggcgccgcgagggtactacctgttgttcgtggtggcgaagggcgtgccgagcatgggtgcgtgggtgaaggtccggtgagatcgatcagctcacatccaccgtgtgggtcgctgcgggatcgtgtacacaagcggagagccagcctaactctctctctctctctctctctctctctatctctctttctgtctctctatttttctgtgtgtgtgtg

SEQ ID NO: 12975 - DNA, 290 bp, Zea mays
  unsure at all n locations
  Clone ID: cC-zmpo14820013h11d1
caagggcancagcaagggangcctcaattttctngtttgctnctagaccctccatcgactggcgcanctggctagttataattcttctctcgtccttgccccgcccattagatgctatccattggtaacgcacaacagtaaaacgacagacatccgacagctattatatgttcgacggtgtaacaccctgaatttgagggtataaaatttcttctccaaataccaaccaaattcaggggttacctcttgnctctctctctcttttcctttngattaaaagtaagtgaatt

SEQ ID NO: 12976 - DNA, 377 bp, Zea mays
  unsure at all n locations
  Clone ID: cC-zmpo14820013h12d1
caagcgnngaacgcgcctaagcagctactttccaactttagaaagctagacaccgaacccatgggtcgcggtagcgttgtctttgtcattgctgctctcctcttcgacgccatggacgtagcaccgatggccgaggcaaagtctgacgatgcccctgaggctgacgcgccggccaatggacctagcgggccggctgctgcacctggcccccaaagtgacgaaggcctgtcaagcaatgatgatgacgatgatgactccaccaactgaggccacacatgtcagaccggttaaatttcgaacacgacattgaataaaaatgagagcaatgtctttaaaaccatgaatccaaaataatgagtggtcatacatggatacat

SEQ ID NO: 12977 - DNA, 472 bp, Zea mays
  Clone ID: cC-zmpo14820014a01d1
agcccacagaatgggggaaaaatctaccgtaacggttgttctatatagcatagcggccgctatggcgcccttgtgtcacctgtcctttctttgatacctggctgccagggagaggggaagtcagaggcacggagtggcgcagagcaaactcccgtgaaccattgtagctgatcctgtcgtcttcttcgtcaacgaacccacacaaggaaaggatggagaagaagcctaccattctcatgaacaggtactagctcgggcgcacgcttgggcagggcaccttcgccaaggtgtaccactggcggaacctcgcgtcctgcgagagcgtggccatcaaggttattgacaaggaaaaggtgatgcgcgtctgcatgatcgaccagatcaagcgcgagatcttcgccatgcgcctttgtccggcatcccaacgtcgtgcagctgtacgagggtgatggtcaacaagagcaagatatac

SEQ ID NO: 12978 - DNA, 503 bp, Zea mays
  Clone ID: cC-zmpo14820014a02d1
cggacgcgtgggcggacgcttgggcggacgcgtggggaaaaggagcgatgagagagagagagacgcaggaccgccggcgacgatcgaggagggaggaaccagatacccggcggcggcgatcgatggctccgcgcagctcatcggcggcgacgtgcctgtgcctcgctctcgccgcggccacgctggcgctggcccacggggcgcatggaggaggaccatcggcatcggcggcggacctggacaagggcacggccgataccttcttggacatcgagaacgtgctgggactgtgtggggacaccgttcctaaaacagctaagaacttgcgaccactttgcacaggggagaaaggaattgccaagttcggctagcctttgtggtacaaggggtccacgttccacaggaacatcccggggttcatgatccagggaggcgaattcaccaaccgcaacggcacggggggcgaagtcttcttccggagcaccattttctttgacgagaac

SEQ ID NO: 12979 - DNA, 213 bp, Zea mays
  Clone ID: cC-zmpo14820014a03d1
atcctctgagcggcgcctttttattttttttttttttaacccctaaattggtggttttggagaaaaattttataccctcaaattagggtgttcaccgcgaacatatatagctgggggatgttgtcgtttactgggggcgtaccaatggatagcattaatgggcatcaaggaccagagaaaatttttactgagagatgggttagtcatggaggg

SEQ ID NO: 12980 - DNA, 360 bp, Zea mays
  Clone ID: cC-zmpo14820014a04d1
gatcacaactggttaagatgtcatttgagtttgcacattgatttacatttttttaactccggcaccatatcggaatgcatgagcgaaagaatgaatatgcatgcctgatgcatgttatcatctgcatggttgcttgtgggcatatgcgggttgaagaagaggaggaaaagtggctacttagaaatatttggatgcctggtacgtgacaccgaacttccagacaggggggagaacgtgccatgaggtggccttgcggtggatgctggtcatcacccggaacgtcagcgactcgcaggtgaggttcttcctggtgtgccacacttgccctcaaatgcgctttattctcgtgcacttgacacg

SEQ ID NO: 12981 - DNA, 454 bp, Zea mays
  Clone ID: cC-zmpo14820014a05d1
cagggggacccacgcgtccggccagacatctacatggttgatatatttgctgtgttcagcttacatctgttgcggccctagttagctatttgtcttttgtgtactatctgaggcacgagattgatcagctaggactgggcgaacacttgcctgtgttggctgttcatctgaaggggaaaatttgcacgagacacctcggatattacaacaatggatagattcatgttgattaatgaagttggcgatgggactttccggagtgtctggcgtgctataaataaacagaacggtgaagttgttgctgttaacaaaatgaagaaaaagcattatcctttcgaggaatgtatggggatgcgggaagtaaattctatccggcgcatgaatcatggtaacattgtgtagctaaaaaggttatgcgagaaaatgaattattatacttcataatggaatacat

SEQ ID NO: 12982 - DNA, 431 bp, Zea mays
  Clone ID: cC-zmpo14820014a06d1
aaacatgtaacccccgcttctctctcattatgaatgtaatcctcttacagagtgggtatatactccaagataatcagcaaatgaagaagtgaaataaacataacacaggcaaggcagctgagctacctgcttcttttgttacatacagcgaagtgcatgcatggtctggtcctttaattttgtagagatagagaagagagaacgaattaattgacgcgatgcacgacagtagaggaggaattgccattattattattatagacctctccgcctttgctgttgtggagatgatgggtgttgcacttgtccttcctgaacctcatcttccctttccgtggtcgatctccagatgtactcctgcatgagcacgttgcccaagatcccgggccctccccgcggcagctttctaaaggccaagcacgccaccccgg

SEQ ID NO: 12983 - DNA, 482 bp, Zea mays
  Clone ID: cC-zmpo14820014a07a1
atcaaaagtagttttgtttctcgtagccatgagacccatcaaatcaaattaatgaagcacccatcaacaattagcaagaccgatgaactagcaaggcttcttgcagaagcacttgcgcatggccacgttccgcttgcactcgccaccgggaaagctctccttcatgcacacctcggcgcatctgtcgctgttgaagcagaagccctcgaactggagactcggcgataagcattgactctcttccttctccgtgcttttctcctccttcttctccgtctcctgctgtttcgctttctccattatcaaggcatgcatgggcatggctactcccattttggcatcgatggttcccacctctgctgcgacgaggaggagaaacaagaataggacagctccctgaaacactgccatccttttctcgttttatcaagaacaggaacggctgaacctgctggcggccccaacctcgatgggtgggtgac

SEQ ID NO: 12984 - DNA, 441 bp, Zea mays
  unsure at all n locations
  Clone ID: cC-zmpo14820014a08a1
ctgtaggaaatcgatatattccccggacaaactccggcgatggccggagcctgaaacgtgacaaaacatctttgtcctcccctccctgctttccctcccggcttggtcacaatacaatctcatctacgccggagctgcactgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggcttccgttccgtcccgtcccgtcccggccggtcagctccgcagcgcgacggcggcctcgtgcaccagcgacccggtggcctgcgcgacgccgtgcgcctcccgctccgcggnctcccggcacgacccggcgccgttcatgcggcgcacgaaggcggcga

SEQ ID NO: 12985 - DNA, 504 bp, Zea mays
  unsure at all n locations
  Clone ID: cC-zmpo14820014a09a1
accttcctggacgtcgaccctggctgcgacaggccggccatctggtcggcgtcgatggagctgatccgtatcaccgacgtgctgccgctggtgttctgcgggttgttgaactcggagcacgtcttcctgatctcgccgtccttccccgtgagaaccttgagggcgctgagcttctccatggccttggcgaagatggggacgaagtcggtagtcttgtccgacatggccttcactatgggctcggtcgtcttgtccatccccagcaggcggtcgatggtgaggggcatcttcttctccagcaccaggccgaagtagctcccgtccatgtcgttgggcgaggtggagtccatggggacggagcccgagtccttgccgtcgcaagcgtcgctgatcttcttcttgaacgcctcgtcgatgggcgcggcgtcggtctcgatgaagaagcacctgcagacgccgatgctgtggccgccgcccagcatcgcgatcatctnctccgtgttg

SEQ ID NO: 12986 - DNA, 514 bp, Zea mays
  Clone ID: cC-zmpo14820014a10a1
cgaaacaaacttcatgtctttttttacttaaacaaacttcaaaaaagttgcaacacttgcaagatgaatgtacattagcctcgcgaaaataaggccttcactatcttaatcttttataatgtcaccttgtacatagtgctctcggaagaagaaaaggtgttgctaaaataacaaagaattgctgcaatttctctctatttcattttactgcaccatgcctcccccctgtaaaaagaatatttcgaaaacccacacagagcatgaagaatgacgaagttgcaaagcccttccaactaaaatacggacacagaccagcaactgacaagtgaatcaacagaccaggcaaaatcgcggagtcctttcagacgtataccccaaaccaaaggggtaactggaaagccaggactcttccaacagaaggagattgtcattggtatgacaagttcacatgtattttcctgggaccacgctgcttgcagcaggaaccatgatgggatgaatggcctggaacggc

SEQ ID NO: 12987 - DNA, 424 bp, Zea mays
  unsure at all n locations
  Clone ID: cC-zmpo14820014a11a1
cttatatataatggggaatacaaatataataacaagcatcgatcgatctctcgatcgagtggacacgattacaaatccatcgagatcggtgtgttgtcgaactttgtgggcaggcacgcacagtgtgcatacgcaatgcaatgcatgcatggataggcagatgatataggagcattaactagttcatgggatgtcaagtttgttatccttgtaagggtccctaggcccctgcttagcagcgatctccttgcacctcttcatgcagtcctccatgctcatgtggagtgggcccgtgacctcgtcacacccggccttgcagtccatggcggtcgccggaggggcggcctncagcacgagcgtgatgagaagcatcgccgcgacgatgaggaccgtcttattcgacgccatcgtcggtttggtttgc

SEQ ID NO: 12988 - DNA, 397 bp, Zea mays
  Clone ID: cC-zmpo14820014a12a1
gcctcaatgttccgaccatgtattaaaatttgacggaaggcaaagattgtggacatttggacaacggttgcagaatgcaaagcaagaactggagccctcgatctcaagaaactaagcagggagatctaccggttgcattgtagcagccagcccatacaagacgacgtgtgcgtggcggcagatcatctgatcagctgatcaattaagagcgctagctatcattcccttgccgttcctgcagtgtgccgcccccgcacggccgcgcgcgggcctccgggtgcatgaggagcttgaacctgccgtcctccttgcagggctgcagcagctcctgcgacggcaggcgcatctgccgcagcacgaggcgtccaccctcgcggtgcgcccgcaggcagagcca

SEQ ID NO: 12989 - DNA, 426 bp, Zea mays
  Clone ID: cC-zmpo14820014b01d1
agacaaagaaggtcaatcacattatatattggggcaggtttacaaatcgtaagacaaccaaacttgctttggggtcgaatcacaaaattatttgccaaaacgatacaataaaattatataaacaagggggaaaaaatgccgaacgaaggatgggtggtgtttaacggagcggccactcacaatcccagggcatggagactactaattaattaatgttggcgttggtgtcgttggttggatgcattcaatcacaggccttgctctacgaggtagtcaccgagcctctcaaccaccattgttgactgttcaagggtcatgggctttgtcgttgatgcccgatcaccagagccttgttcgggcttttttacagatatgccttcagatcccttttttccgcggatgacaaggccgggcttgtcttggatg

SEQ ID NO: 12990 - DNA, 281 bp, Zea mays
  Clone ID: cC-zmpo14820014b02d1
tcgctctaaaggaagaaaagcatgaaattgtcgaagcttacaatcaatagacctgagcttggccttgttaccactttgacttcggaaagggcacttgtccatttggaagcagctgtttttacaagcatgcctacgatgatggccgtttggaagacgctttattgaatcatcatgatgccgacaatgcaagcgcagcagattgccaaacttatgaggttgtcgtacttactgactccgctgcatgtgtaaggaaactcaaacgtatctttgagcaaacattg

SEQ ID NO: 12991 - DNA, 187 bp, Zea mays
  Clone ID: cC-zmpo14820014b04d1
gacggattaatacagggattgccaggaacccacgacaagcatggaaacgccaaacgtggttgttgtgacaaagtttacgcttagccaaagttatgcggcgacgcaatggcggaagcacggtggttggcggggggcccagccgggcagcccagtgcagataggtgagatcttgggtgggggactgggg

SEQ ID NO: 12992 - DNA, 303 bp, Zea mays
  Clone ID: cC-zmpo14820014b07a1
ggggaaaggaaccaaaatttcccagttcccaaaaaaaaagcctttttccccaaccccccccctttaagggcccccccaaaaaaaaaaatttttttcccccgccttttgaaccccgacccccccaaagggggggcccccctcctttcccccccaaaaaatttttcccttaaaaccgcaaaaaaattttttgttgggcccccccccttgggggccaaacccccgggggaacccttgaatcccccccccccccccgtgggggccccccaaaaaaaaacggcccccccctacgggttaagggggggg

SEQ ID NO: 12993 - DNA, 332 bp, Zea mays
  Clone ID: cC-zmpo14820014b08a1
gggggaaggaaaattttttaaaaccgggcccccgggggggaccccggtaaccaacaccggggaaccccttgggaaatcaaacccaaaaaaaaagggggggggcggggggtttcccaggggggggggggggacccccccttttttggggttaaaaaacacggctctaatttttcttccaggggggggacaaaaataaaccgggcccccggggggggcccaaatggggggggtaaaaattgaaatcttaatggggggggggggttttaaacccctggggggcaggggaaaaaccccgccccgttgggccctgggggggggcctaaacccaaggg

SEQ ID NO: 12994 - DNA, 481 bp, Zea mays
  Clone ID: cC-zmpo14820014b09a1
agccggcgtcgccaacaagaagaggctgtcgaagcagctgtccatgaaggagaccaccagggaggtcaagtgggagaagcggaagcggcagatacaacggcagaggagcatcatgcgcctgagcgaagccgacgacagagctcgagcgcggagcgggtggccactggtataaccgacggggacctggatgagctgaggggatccatggatctcggcttcaggttcgacgagcagaagggcggtcaggacctctgcgacaccctccccgccctcgacttctatttcggcgtcaaccggcaggtgtcggagcccaggatgtcgtttcccacgagcacgagctcagggccgtctctgtcggccaccaagttctcggccaacctatgtggcacgcccagcccaggtagccctggtgcgcactctagtaacgccttggagtcatggaagatttgcaacccaggagataaccctctgcttgtgaaga

SEQ ID NO: 12995 - DNA, 429 bp, Zea mays
  Clone ID: cC-zmpo14820014b10a1
ggttgtcatacttatacattaatcatcaaaagttgagccacatacatcagtatacacctcagatatgcgaggcaagaaacatcagttgccatgcatacagtaacgatcgacgaccaatgtataatgcatgtgtgtgatatatacacacacgcggcaccacacgctgaggcctggtacctgcacgcgcgtgcgacattgacattgcgcgcacatcgaccagagagatatgatcagccgcgacagccggtgatcgggttgcagccgcgggtgtagtcgttggcgggtttccctgggcgggaggcctcggggcccaggttcttgtcgcagttgcccagtaccttgcagctgatcaaattgtcaaatgacaccatcccctcggcgctgatggccccctgcgggccttgtggtaacaggaggcacagaaccacc

SEQ ID NO: 12996 - DNA, 382 bp, Zea mays
  Clone ID: cC-zmpo14820014b11a1
aaaaaaaaaacgggcccggtttttaaggggggcccccctaggggtcccagggccacccaggggggcgaagggaaccccccctgggggtttggggccccccgggccggagggggaatttccggacagaccatttggggcccccccttggaaaacggggcccgggggaacccagggaaaaaaaatgggggggaccgggggggggacccccgggggggggggcccccttccagggggggcccccccggggggtttaggaggcgcggggcccttagaaggcccctgggggggggggggcccccccccgggggggggccccccccgggaagggcccaccccctcccccggggaaaaaacggggtataggcgggggtggttggggggg

SEQ ID NO: 12997 - DNA, 244 bp, Zea mays
  Clone ID: cC-zmpo14820014c01d1
acccacgcgtgccacaaagtctgctagccagccagccatcagccagcttgctcgccgtgcccgtccttctttctcgactgcggtccggtccgttccgtaccgcccgccgacgccggcggattcagggagtggagatgaagaaaatcgtctgcgccgtactagttgccgcctcggcggccaccgtggcgcttgccgcggaggctccagctccggcccccaccagcgggtccttcgccgtcgcgcc

SEQ ID NO: 12998 - DNA, 462 bp, Zea mays
  Clone ID: cC-zmpo14820014c02d1
gccgacaggtgctggccccgacgacaatggtggcggttgcgggtacaaggacgtgaataaggcccctttcaatagcatgggcgcgtgtggcaacgtccccatcttcaaggacggtctaggttgtggatcctgctttgagatcaagtgtgacatgccagcggattgctctggcgagcccgtggtggtgtacattacggacatgaactacgagcccattgcggcataccacttcgacctatcgggcactgcgttcggtgccttggctaataagggtgaggaggagaagttgctcaaggcgggcatcattgacatgcaagtttcaagggtcaagtgcaagtttggatctaaagtcaccttccacttggagaaggggtgcatccccaactacctggccctgtcggtctaattcgtcgacagggatggcgacactgtggttgggggacatcaaagagaaagggctcc

SEQ ID NO: 12999 - DNA, 139 bp, Zea mays
  Clone ID: cC-zmpo14820014c03d1
gggaaaaaaaccccctaccccacatttttttttttttttggggttaaaaaattattttccttgctttaaaaaaataaaaaaccccccggggggcgcctttttttttatttaggaatatatccttttttgggcgcccccc

SEQ ID NO: 13000 - DNA, 166 bp, Zea mays
  Clone ID: cC-zmpo14820014c04d1
aaaaaaactcgtattcttttgtaatcaggcgtgcctccagatgcacgtcacaaggcataaattcaagcaaaagaagaaaaagaggaagattctgtggtaccgccggcggtttgaacaccctgctgacctggctctttttttcagccgcttttctttctttttctga

SEQ ID NO: 13001 - DNA, 424 bp, Zea mays
  Clone ID: cC-zmpo14820014c07a1
ctgtaggaaatcgatatattccccggacaaactccggcgatggccggagcctgaaacgtgacaaaacatctttgtcctcccctccctgctttccctcccggcttggtcacaatacaatctcatctacgccggagctgcactgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggcttccgttccgtcccgtcccgtcccggccggtcagctccgcagcgcgacggcggcctcgtgcaccagcgacccggtggcctgcgcgacgccgtgcgcctcccgctccgcgggctcccggcacgacccggcgccgttcatgcg

SEQ ID NO: 13002 - DNA, 345 bp, Zea mays
  Clone ID: cC-zmpo14820014c08a1
tggcgccgcgagaagagcagaccggctacggagagcgtgacggccgcgcccactctgaggaaaagttggggcaagtccttggcgtccccggcgctcggcccaccaacgccgctgcttgtcgtcggtcacaaaaaggcgtccatttgcgccacgagaggagcccggagccgtgccaaattcaaataatttgggactctaacgagaccacaaggtagtggcgaagaatctgttcttggagggataaattttttgcagaaaaccagaaagcgcgtcagggaacgcgagctccggtacctgcaagtggccggctataccgccatggcgtggaaccgaacagactgggcg

SEQ ID NO: 13003 - DNA, 401 bp, Zea mays
  Clone ID: cC-zmpo14820014c09a1
ccaaaatataagttttatttttatttttaaaccaatcgcaaacagagggggttcatgttatacaaactgtttacgtaaatccccccgggggggattaaataaatccctacttcctttgggggaaaaaaaaatgaccaaactgtcctgggatgtgtaacaatgccccaacacagttcttgaaggcaaacgtaaattaattagcaaaacgacaccctgggacccatccttgcttttttccatgaaatgaaacgcagcctttggaacctggcttggccaggccttgagctaaaaaaagcagcctttgacccccaccggccggccttaaaaacggtttgcccgtgcagaaggacagtgtgccggaaaaccgggtgacccttgtaacgtaggttcctggtttgggc

SEQ ID NO: 13004 - DNA, 434 bp, Zea mays
  Clone ID: cC-zmpo14820014c10a1
atccttcaaacgtcattttttcttcatatatttctgcaacatgttacatgtacagtctggtagaaggcactgctcccccacagtccctctctacacgttgcattggtgaaaacaacagcagcagcagcaaagggctcaaagcccaaccacgtacagctatacataaagaatgggtgtcgaacccggtttgagtctctagctaagacctcacacgcggacatacccctcttctttccctgcaaaatgtggaaaaattgcaggatcttccgttgggaactatcttgaggtgaggtggttgtcgtccatgtaactggactcctaacagccagcagcccttatgaaattgtcgtacgggctcgccgccggtagcttcagagactgcttgtggaagtcctggcctggctgtgcgttgtcgccgttgggcccgttcatgt

SEQ ID NO: 13005 - DNA, 341 bp, Zea mays
  Clone ID: cC-zmpo14820014c11a1
gggggcaaaaatttggggtttaaaatggtaaaaaaaaaatttggtggacaaacaaacaaaaattttttttccaacccaaaaaagcgcgataaagagaaatttttttgtagacagaactttttaattttgtcggaaaggaaaaccccggagggttttttggttaaaaccgggggggaaacccaggaagactggaatcccctcctttttcaaaatggccctttcttggggggggggcagtaccgcccctaaacagggggcataatcttttggcaaaaatatttcttggggaggtttttctactccagcgccgggggaaaatttttgggggggtttattttcac

SEQ ID NO: 13006 - DNA, 248 bp, Zea mays
  Clone ID: cC-zmpo14820014c12a1
acgctctactgcgccgcggctgacgaccccaacctcgcccactacgttagacaaggacgaatgtactgcggcaccgcgtcgcgccgggttcgtgaccaacgtgaccgagtacatcgcgggcgccaaggagaggctggagtgcaagcacttcagcaccggcaagctttagcgcgccatcgacgggtgtaccgacgcgaccgggacctacacgatcgagctcaatgacagttcacgaggaggacatttgt

SEQ ID NO: 13007 - DNA, 236 bp, Zea mays
  unsure at all n locations
  Clone ID: cC-zmpo14820014d01d1
cggaannaccgggtacgacccacgtcgtacggtcggggacgctgctcacgatttcgacgagggatcttctcgagggatgacggagagctcgaggtgggtggcgcaacggagggccgggcattggccgtgggacgtgggcgttggtcttttgctgcggttacatatgggcaagctgggtgctctccgcgccagtcaccgtgttcgatgccagtctgtcgtggaagaaagtgcatgca

SEQ ID NO: 13008 - DNA, 376 bp, Zea mays
  Clone ID: cC-zmpo14820014d02d1
gccgaataccagccatgccaatgctgtgcccctaaagatggccctgcttatgcgccatgcccttgcacaaccccaggccgggatgcaccttccttgctccacgttagcagctgccccacaccaccgttgtgccgtgacaaactttaagaggatgacgctactggaggccgcctttcccgtgcttggcctcctatccctgcatgttgctttagggcagcgggcgtcacccatataaccggcccttcagcatggccccacatggaatttgtattctgggttgtgtggacggcaaatggattgaggctgtggcatgggagccgccaagagaagaaagggaaaggaagaaagggagttggatcaatattagccactgatg

SEQ ID NO: 13009 - DNA, 297 bp, Zea mays
  Clone ID: cC-zmpo14820014d03d1
gtgcactagatatgttgccaaaataaaaagctctgcaacatatatatgcaatgggtcgatatatattttagtatggcttaacgccgtcgtagttccccggcggccagtagctgcacatgatgatggtgtcgccgctgttgcacttgatgcgtccgcaaccgacgctggtggtggtcttacagacgacggccttgtagtggccgcacatcttgccggggtcgcaggtgtctgagttgtaagggaagttcttttttttctcgctccagccgtccacggtgatctttcaggtcagccccg

SEQ ID NO: 13010 - DNA, 78 bp, Zea mays
  Clone ID: cC-zmpo14820014d04d1
gaccaagcgcacgcacaccatgcattaagcaatgtcgcctcatatgcttgaccaaaggacttttcctgttttaccatg

SEQ ID NO: 13011 - DNA, 351 bp, Zea mays
  Clone ID: cC-zmpo14820014d07a1
gcgtggggttttttgagaaattccggaaggggacccaggggccccaaaatttacccctaaccgggaaggggagacatatgagcataaacgggaacaaggggaaactgggggaaaaagaaaaaagggcaaaaagtcccaaaaaaaaaaaaagggggcaacaaaaagcaaaacaaaggaggccggaagagaaaaaaaaatgacaaagctgggggggactttatggaacccatataaaatgggagacccccgggacccggtccccaaaaaaaaaacgcaaaccgcccggcgcaattgaaaaagcaattagcgcccggggggggataatgttttcacacgaaacggggggaattt

SEQ ID NO: 13012 - DNA, 284 bp, Zea mays
  Clone ID: cC-zmpo14820014d08a1
ggggccaagccaatggtttatttcccggggtttccctacaaaaaccgccctttgggaaaccttccttcacttttcctttggttcggccccggcatccaaaaacatgaggggggttttttcctacgggaattggaatcctacacttttcctccaaaattccttcaatccaaaggggcccttagatcgggacccccttagtggagccggcccgagggccaaagaaaaccaaaagctggcccggcacccaattagggaggggaggaacccattatttttcggggatt

SEQ ID NO: 13013 - DNA, 464 bp, Zea mays
  Clone ID: cC-zmpo14820014d09a1
accttcctggacgtcgaccctggctgcgacaggccggccatctggtcggcgtcgatggagctgatccgtatcaccgacgtgctgccgctggtgttctgcgggttgttgaactcggagcacgtcttcctgatctcgccgtccttccccgtgagaaccttgagggcgctgagcttctccatggccttggcgaagatggggacgaagtcggtagtcttgtccgacatggccttcactatgggctcggtcgtcttgtccatccccagcaggcggtcgatggtgaggggcatcttcttctccagcaccaggccgaagtagctcccgtccatgtcgttgggcgaggtggagtccatggggacggagcccgagtccttgccgtcgcaggcgtcgctgatcttcttcttgaacgcctcgtcgatgggcgcggcgtcggtctcgatgaagaagcacctgcagacgccgatgct

SEQ ID NO: 13014 - DNA, 507 bp, Zea mays
  Clone ID: cC-zmpo14820014d10a1
tttttttttttttttttttttttttttttttttttttttttttttttttttttttttttggaaccggtggtttttatccgaaaaccggattccggaaccttaccgtttcccattccccctattagagagggcatttaaaactgggggtaaaaaaggaaaaacgtgtcccggggggaaagggggtttcggcccaaaataaaacaccacacaccagcggaaaaaaaaaactaaaaagccgggggggaaaaaagagagggcaaacccacgtaaagtgggtggggcaaaattcccgttttacactgggaaaacccctcccgcgagggaaataaggaaacccccccaccccaggggagggggatttcgccttcggggccccagggggatttttctttaacacaggggagagggggaaaaacttaatggccctccccccccggggcctttaaaaaagggaaaaacggggaaaacgctggtttcccccaaccgcaaaaattatttttgtggggg

SEQ ID NO: 13015 - DNA, 132 bp, Zea mays
  Clone ID: cC-zmpo14820014d11a1
attaacttatatcattagatatttttgtcccctaataatatttgatgctatgtacaaggccacaaacttacaattgtagctggggcagcattatatttctagcactagctaatagctttccccacgcgtccg

SEQ ID NO: 13016 - DNA, 230 bp, Zea mays
  Clone ID: cC-zmpo14820014d12a1
acgcattaactgagcccagcgctagctgctgtcggggcgcgccgtcttcgtcgagccggtcggtctggtgtggtctgggctggctgtctgccaagttacgcagcctggctccaccgattgcacaccatacattgagcgttgggtcttggtcgtacgtgccgttgtactgtggaagaggccgtggctctacaacagtgtttatatgcacaattacacatatcaccaccctg

SEQ ID NO: 13017 - DNA, 85 bp, Zea mays
  Clone ID: cC-zmpo14820014e01d1
tcgccattcctgcgctctccattttgcgtgtgtgacagtctcacttggaccagtgtctcgccgctgcgccgccgtgctctgtacg

SEQ ID NO: 13018 - DNA, 406 bp, Zea mays
  Clone ID: cC-zmpo14820014e03d1
ctgccaaggcgctcaagggccccttctccatccgtctcaccagcgagtccggcaagaaggtcatcgccaaagacggcatcccgccgaactggagacccgatgccgtctacacttccaacgtccaattctactagactttgaattcccttcgattcatccggcgcggtgggctatggacctgcagcagcaagctaattaagtttatatatattgcatgagagagcatgcaccgcttaccatatatactactgagacttctgaattctaggatatgtaatccttttgtttgggtttaggaggcaattctaatcatgtatgccgaattccaaagagtggtaaacaagcaaaatgttaaatatacatgccattttcggaggcaatttctttcatgagggcctgttgctat

SEQ ID NO: 13019 - DNA, 167 bp, Zea mays
  Clone ID: cC-zmpo14820014e04d1
cgtccgggcggtggtggtactgaagccgacggtgacacgtagcacgtctataccgatccagtgcctcaacgctgcctggcagccgaacgcgaagaataagagcttctgtgatcgccgccgggcgcaggtgtttctgtgggaccatatatccaacttggtcaacatcg

SEQ ID NO: 13020 - DNA, 251 bp, Zea mays
  Clone ID: cC-zmpo14820014e05d1
tatatgttggggcaggtttacaaattgttagacaaccaaacttgctttggggtctaatcacaaaattatttgccaaaacgatccaataaaattatataaacaagggggaaaaaatgccgaacgaaggatgggtggtgtttaacggagcggccacgcacaatcccagggcatggagactactaattaattaatgttggcgttggtgttgttgtttggatgcattcaaatacaggccttgcttttagaggttg

SEQ ID NO: 13021 - DNA, 211 bp, Zea mays
  Clone ID: cC-zmpo14820014e06a1
ggcgtcggaggcgggggccggggcgggggcctcggcggctgcggcggacgccacgagcgcggcggccatggcggcgacggcgacgaacttcatcctgaggccggccatctgcgagtgtgtagtgcagctagcgagtcgggtttttattgggccgcggggatctctctacgagagtatgaagcagtagaagtgtagagagatgcgcgcaggc

SEQ ID NO: 13022 - DNA, 381 bp, Zea mays
  Clone ID: cC-zmpo14820014e07a1
gaaaacccaaaaacatgttttcgggaacccaaaaccaaacatggaaccaccccaacccaaatcctaaaaaacccccggccgggggggggggggacccccgccgaaaggggggcggacccggggaaaaaacggggggaaaaggaaaacccccccccccccgggggggggccccccccccgccccaagggggggggggcgcgccccacggccacgggacaaagcctcaattgaacgggccccaaaatggggtgccccccccccccgctaaaaaatttaaccagcggtgcccccacgggcaccaaaggggccaaaaaaaaaggccagggagaccctttaaaaaacccggggggagggggccccaagggccttgttaaaggggcc

SEQ ID NO: 13023 - DNA, 452 bp, Zea mays
  unsure at all n locations
  Clone ID: cC-zmpo14820014e08a1
gacagaaacaatcatacagcgtacggcataaccgatccttccatgtacggggtacaagaaacgccctttcaataaaacaataacagtgttttctgaaacgatataataaaggctctaaaggctctttccagaaatattgaagggaaaagtttgagccagcaactggagttcgtgtttaagccagaactagttagcagcctaccatggcgaaagtaacatactcgaaccaatcttggaaagatcctgtcattcttgtgccatgctcgaatcaatccataaattgttcagacactgccgggacaatgccatcactcaaatgctaagaatcagttattagtcttcgcatgtgggcaactataataaatcaataaacgacacagtagtcacgagacatgtaaaacaagagnggatgtgaggcattttttcttcagcatacaccagttgatccacta

SEQ ID NO: 13024 - DNA, 430 bp, Zea mays
  Clone ID: cC-zmpo14820014e10a1
aatcccatcatatgaataatcatacgcacaaatcctggacaacggggacaacatatcacaaaacactaacacacacgattgtagatacacacacacacaagctagcagcagcaacggaaatacagaagtgcatgaatacatatgcttaaaagtaggtagtataggattgtaggaacttatagtcccaattgatgtaccacagcagcgaagactctgaagcccgttgcatcgatcaggcgtgctcctcctcgccgtcctgctcttcctcgtcgtactcctcggctgtggcgtcttggtactgctggtactcggcgacgaggtcgttcatgttgctctcggcttcggtgaactccatctcgtccatgccctcgctggtgtaccaatgcaggaaggccttgcgccggaacatagccgtgaactgctcgctcac

SEQ ID NO: 13025 - DNA, 302 bp, Zea mays
  Clone ID: cC-zmpo14820014e11a1
gaaaaaaatgcctccaaaaatggcatgtatatttaaccttttgcttgttttccactctttggaattcgatcatgaacccgaacaaaaggattacatatactagaatttggaagtctcagtagtatataaggttagcggtgcatgctgccaacttaattagcttgctgctgaaggtccatagcccgctgtgccggatgaatcgaagggaattcaaagtctagtagaattggacgttggaagtgtagacggcatcgggtctccagttcgccgggatgacgtctttggcgatgaccttcttgccg

SEQ ID NO: 13026 - DNA, 456 bp, Zea mays
  Clone ID: cC-zmpo14820014e12a1
ggccgccctttttttttttttttttagcgattttggtaaggaaaaaaaaactgtcggccggcctggcataaacgccaatcgtggcatgcaatccaaggaaaccgaagccttttgggagaaaccggaacggaggtgacaagaaacacgccgaccggtcatttgttaatactaaccggttgggctcgatcaaccgtgcgcccaagcatgcatgttgttggttaatcagacctttgtttaacagctattaatcagatctcgacgtccatgcccaggtcagagctctagacacaggaccctttatttatgcatccatgggtgccctccaatagcagcagcgctggcaacaacggctggccacaacccggtggacgaagacatgggcgcctttttttctatcaagtggacccgcggaagctggtggccatccagaaacgggccctggcgacgcggctgttt

SEQ ID NO: 13027 - DNA, 410 bp, Zea mays
  Clone ID: cC-zmpo14820014f01d1
agaaccaaaactgtgtttcttgaattataaatattccacctcaattcgcctccccgtttccgagaccaaattaacgcatctctacaggaaataacgatgtgagatggtcaaagcaaaacaaacttaactcatcagttattgtcgcgcgagagcgcgctcgcgggcatgggcatgcgaacgttagcagcggcgacaaacgatgcgagggcccaaaacgcccggctctttgttgtcgtccgtggagaaggagatcgatcagatcatgttggagagcgagcgggagttcttggacatcttgacgagcgacgcgtcgaactgctccatggggttcttctcgccgatctgcctgaactgcttgtcgcagttctgtatgttctgcgccgccatgcccatggtggcgcggatggtga

SEQ ID NO: 13028 - DNA, 279 bp, Zea mays
  Clone ID: cC-zmpo14820014f02d1
gacacaacacgggcactttcaacatttaaggagataacattgtcaattacaccaacatggtttgtctactaaaacataatgcactaaaataataagcagaagcaaaacttgcggcggatggacgataagagcggcttaatcgtcgaacaggctgaagcccatttcctcgtccgactcctcggcaggctctggagccttctttttctccttgggggcagcagcagcactagagtccgcagcagcgacaagatcaaggagtacctcaaggacccgagcaag

SEQ ID NO: 13029 - DNA, 501 bp, Zea mays
  Clone ID: cC-zmpo14820014f03d1
gcaaatgatccagggaaagaatgtgttatttgcctctcagaaccaagggatactactgtcctgccatgtaggcatatgtgcatgtgcagtgagtgcgccaaggtcctgaggtaccaaaccactcggtgccccatctgcaggctgcctgtggagcgtctcctggagatcaaagcgaacaacaaatctgaagatcagcaccagacgccccaattgtcaccgcgcccagacctggctccgcatgaagaaggggtgtactcgtgatcaaagtcagctctgatgtattatatggctcgaatctgaggaccttcctgaaggttggctctatcatttgagcaacgggggatgcaactggtacttttacctttaacatatggaagcttatggcatcgtatggctttgccgacctctgctggatctgcctatttggaggtccgagagcagggatgcaatgagagtgtgtttaattatacatcatgcattgcgcgtgccatggatacctta

SEQ ID NO: 13030 - DNA, 237 bp, Zea mays
  Clone ID: cC-zmpo14820014f05d1
gtacatgctgattgatgatgattaattaatatctgcatgcatgcattgtagaagcaaagaaatgggaggtagcttaggcatgcatgcatgatgcatggggccttaattaattcatccacggccacgggtcgtcggtgatgatagcttgaaccctctgagcgcggacacgccggcggcggcgcctcgctcttgtgctgcttgtggtgctgatgcaggcgcttctgctttcgctaatac

SEQ ID NO: 13031 - DNA, 311 bp, Zea mays
  Clone ID: cC-zmpo14820014f06a1
gaattaaataaatgatctcatggataaccaaaaaacggggcaggcacatgatcgccgaccagacaatggagcgtacacgcacgtaccaccaagcgcacacttgctccttcgacaccgactacactacatacagacacactcccgtctaaacagctcacaccgacccatacacgacaaggactccattgcggccaaacaaatgacaaattaagcaaataccacccgtacatctcatatctttgccaatacgtcaccgaacgcgccccgcacgagcgaggccgggcctaggggtacaggaggagctggaacct

SEQ ID NO: 13032 - DNA, 388 bp, Zea mays
  Clone ID: cC-zmpo14820014f07a1
gctgtggacgctgctagtggcggtggccctgtcggcggcgctggcctcgaaccgccccgtggcggcgacggcgacggcggcggcggaggcggcgaacgaggtgctccgcgcgcaccagctgccggggggcctgctgccggcggggatcacggcgttccggcacgacgccgccacgggggcgttcgaggcccggctggacgcgccctgcacggcgcgcttcgaggtcggcctccgctacaacgccaccgtctccggggtcatcagccccggccagatcgccgacatctccggcgtcgccgcgcaggacctcttcatgtggttgcccgtgcacgacatcaaggtcgacatcccctcctccggcgtcatctacttcaacgtcggcgtcgtc

SEQ ID NO: 13033 - DNA, 508 bp, Zea mays
  Clone ID: cC-zmpo14820014f08a1
ctttctttttttttttttttttttttttttagggcacgcctcatgccagggcatcttattagttctcttgggatgtgtacattaatgaaaacattagatcgtacacttttacagctttacaatatgtgcagaagaactttcttgaagctgaattctgtcgcaaggggtgctgatttcaagttttcaacctgtattgaaattattatgtatgcaagggatgctattcgcaccgccttttgtctgtacaaaattcttgagtacaaagaacgtgatatacacactaccggttgcgctcatcctgtactcaacccactagcctggcaccatcagtctccgtgtatctcaggacatgtcagacgattaccacctgtgtccgataaatcttcactcaaagttgtgtgtataaaatggccgcgtttgttgaaatggtaacgatagccccattggagacgtgtgttccatggcacgtttaaggtttctttgcttggaccttttttaggtatttttt

SEQ ID NO: 13034 - DNA, 287 bp, Zea mays
  Clone ID: cC-zmpo14820014f09a1
acagccgtcgcccttttttttttgttttttttttttttttttttttttttttttttttttttttttttttttggacaaaaaaaaaagggcaggggaaccccctttttttcaaatttttttgaaagaaaaaattttggtcttttgggccacgggagccaaaaaaaaaaaataaaggggggccctttttctataaaaaataaccagggaaatccacgggtttttttgaaaaaacttgcccattgaaaaataccggttggtggtggcaaaggaaaagatcttctttataa

SEQ ID NO: 13035 - DNA, 167 bp, Zea mays
  Clone ID: cC-zmpo14820014f10a1
aatggagattaagaagatggtgaaggaggatgacaccatcattgttggtgccagcatcactggcaaaagggggaggggcttgttattattaccccctggccaatgcaagcatgcgtcatgcgttggttgggatccaacccaatcccgacgcggggttttgcccaaaa

SEQ ID NO: 13036 - DNA, 404 bp, Zea mays
  Clone ID: cC-zmpo14820014f11a1
gtgacaaaacatttttgtttttttttttttgttttttttttgggggggggcacaatacaatctcatctactttttttttgtaatgaacagacgtgccaaaacaaaaagagggagtgttttttaaccccccagagaaaaaaaaaagttccacccaaaggaaaacccaaggggggcccgagcaacataaaaaaacccaacccctgtatgtacagccgatcgtaaaaaaaacccaccaccccgtaccgtcccggccggtgagggggcaacctttacttcctgtctcgtgcaccagcgaacccggtggtctgcgcgactccgtgcgcctcccgcttcgttgtctaccgggacgacccggcgccgttaatgcgggggacgaaggcggcgaacctccgccagattttcgg

SEQ ID NO: 13037 - DNA, 320 bp, Zea mays
  Clone ID: cC-zmpo14820014f12a1
tcgacccacgcgtacgcgctgacgtcaagggggtcccagcagtaccgcgccctgaccgtaccggagctgacccagcagatgtgggacgcgaagaacatgatgtgcgcggtcgacccgaggcacgggcgctacctgacggcgttagccatgttccgcgggaagatgagcaccaaggaggtggacgagcagatgctgaacgtgcagaacaagaactggccctactttgaggagtggatcccgaacaacgagaagtcgagcgtgtgcgacatcccccccacaggcctggcgatggcgtccacattcgtattgtacaccacctc

SEQ ID NO: 13038 - DNA, 339 bp, Zea mays
  Clone ID: cC-zmpo14820014g01d1
caacaacagggtcgtatcatcgtcatcatctgggaaacatacatgatacatccagcaagatgaaacacggaggggggcaaaaaaaatagcgctggctgaattacagattagtggggggggtataacccatcctgtacgttctcaaggagattcgactccgattcattgccaccccaagggagggggggctccaggcacaacatcaatcaatctgcctcgggcgtgcagctgccatcaacaactaacattttaagaatgcaagtcaacttactatgcttgtgagaacgcggtttactcctcgaagccatccatcatggggcggtggcctccttccgaaga

SEQ ID NO: 13039 - DNA, 238 bp, Zea mays
  Clone ID: cC-zmpo14820014g02d1
aaagaaaactcaacctgcgagggtaagacagcccccgagcattgtattaagaagaagacattctcacacaggtcgagaaaatcccctgaacccctgccccacccatacacggcggcatcgaagcttatgtgagaatgaccacgaccgggactgagccttacacctgtgcttcttccactgggagccgaacccaagacctgaggagtgctactcagaccacctaaccaactcagctaga

SEQ ID NO: 13040 - DNA, 234 bp, Zea mays
  Clone ID: cC-zmpo14820014g03d1
attatgggggggaaaattttaatgctacacaccgcaaagttcaaattttctaccaacatttcgctcggtttaccaccccaccacttcttgccagaaaaaaactttagcaccaatttatgaaaaaacaactctggcagcttattcaacaaacttatatggataaaagggaaacaaaaaaaaaaaaaataccccaatgttaaaaccaccccatccccaatacttacttcacaagaa

SEQ ID NO: 13041 - DNA, 430 bp, Zea mays
  Clone ID: cC-zmpo14820014g04d1
ccacgcgtccgatcaacgccactattagctggggctaaaggagctgttgatcataagaacattaggagatactacatgggtactgtacccaatgcgaggccaacagttaattactcgtacttgagaaacaatgctcctgcaagagcagttggtgcacaaaggaaattggagttggattatcagctcccagagactaataaccataataaggtgacaaaggcagaagcgatgaacccgtcttggtccagaccagcagcagtaaggagcaatgcaggaaattatcttgccaacgacctgaacccccgtgtacctgaccttgccgagaaagctgtctcagttgtcaatgggccccaacagggagtggggtttggggtcacagagatttgttagaacgcatgagaacgctgtcaagcgccccttgtcgtgggat

SEQ ID NO: 13042 - DNA, 245 bp, Zea mays
  Clone ID: cC-zmpo14820014g05d1
gagacaataaacatcaaagttgaatcaggagacatgcatgtccatatacataaatataaagaacaatttttggctgagggacttattagatagacaggattatatatcatcatatacttaactcctacaatggttcgagacggcgtctcgatgtgtttacgcatgaatgcatttgcagctgaccatcgccttttaatttccctgggcgcccccccctttggttgattattattcctcggaagcgg

SEQ ID NO: 13043 - DNA, 325 bp, Zea mays
  Clone ID: cC-zmpo14820014g06a1
ggaaaccggcccaaccccattcaagggccttaaaaacaaaaaatgcccagtggggatatacaacaatcagagggggtttttgcaaaccccataaaatgtaaggggacccggaaagaccacattcaacagttgggggtggaactagagtgggatgaataaaaagttgggccaccaaaaagggaaaggtttgcaagaacctagggcgggacacaaatgaccagttgggagcgggcgaaaccgggtaagttaagggccctgattgattgggccgacttgaagggccatggcaaaggaaagcgtataaaaatcaccctgggaaattttt

SEQ ID NO: 13044 - DNA, 68 bp, Zea mays
  Clone ID: cC-zmpo14820014g07a1
ggggggacaatagcaagaatccagcactcagaatttggtacagccacccagttacatttttgttttcc

SEQ ID NO: 13045 - DNA, 433 bp, Zea mays
  Clone ID: cC-zmpo14820014g08a1
gtgcaataaaaccgcttcaccattttatacgatgtctccctctatttaagagttgggttgtgttcttaaacttgtacattgcaatgtcctctgtggcatgaaatttagatcatgtatatattttgaatggaattatagatccacactagtagaatgaataagaaagttcgcagattgccagaggcctaaaaaaagactggcgagagtgagaaagagagaggtgaccaacagtgagtgatggatgcaagtaggttcagacgcaggcgagctccttcgccatgccaatggacttgccgatggcgttcttgcagacggacatggtcttgttgtcggacctgttgtacttgatgtcgacgttgatgagctgcacgccctggcagggcaggttgttggcgcaagtgagcgtgatggcctccggcgtgttggaggtgcc

SEQ ID NO: 13046 - DNA, 519 bp, Zea mays
  Clone ID: cC-zmpo14820014g09a1
gacaacattcatgcgataacactcgggaaaaatccaacatatcaagttatcaaggctccgccgtagtagcggaagacacggttctaaataagcagataaaacatttcgctaccaaaatagatcgttttagctgcagctgcaggctattgggaccacaagctctgatacgagggcaactcagaatctgagtactacgaaaatcatgtctgtatacctaatccagcttgcatccgaagctcatcttacaactcataaatatttccacgtcaatcacccaaatgacagtagcgtcactggacctctcactgttgctgcggcggttgctgtgctactggttgttgttggtaatttggatagccagcataagctccagctccataattatacatattaaggtcctgagactgggggtacccataggcctcatagccttgaccgtagccataatatccagcatttagccccgcccactggttggagtcctgaacttgtttgtttgaggggctggaccccatgaaa

SEQ ID NO: 13047 - DNA, 162 bp, Zea mays
  Clone ID: cC-zmpo14820014g10a1
tgcacgcgtgcactcgtcctggatcctgtataccggacagccgtcgccctttttttttttttgatcagtacagacaacgcactgtattaggttggcatacaggagaagaaactttctaccggtaaaaatgaggagtgtccatgtcaaccttctaactcatgt

SEQ ID NO: 13048 - DNA, 436 bp, Zea mays
  unsure at all n locations
  Clone ID: cC-zmpo14820014g11a1
gcatagtaaaatataggagaaatatttagagaaaattgctgcgaatatggaaaccctcaaattctggaactgaaactacataggcggcattcagcaacacagaatcgtcacacgcgttctacttcttctgaacatctgaactcgccagtatcaatacgacatatatcttacaacttacaacccgatgcaggaggaaggcaacactgtgaaaataaccgagcccgctggcactctctgacagacctgcagatagggtgttccactggatcggactagcctagcctagcttcttgctgattagcccctcgatggagccgacgagcgcgaaggcgctgacgagcaggcagacgacgctgaaggtctgcaggacgacccagcgggcggaccaccggcgcacgttccgctggatgaagtacatctccacggngaagtagat

SEQ ID NO: 13049 - DNA, 416 bp, Zea mays
  Clone ID: cC-zmpo14820014g12a1
acgaaataattgggaataaatagttcgtgaatccctgaagcgtgcatatatatattcctgccaagataaaggtaatggagtcttcacgcatgttccatccggccgtcatcctgcttctcctgcttattgtgtgcaccgatatggcacaggctagggaatgcgagaagtacagcgagcgacttgttggggcatgcatgatcgcagacaactgtaccaatgtgtgccgaggggagggctttttggtcggcatgtgcaacacctttcggcggcgttgcatctgcactaagcagtgctaaacaagagcgctcgatcgcttgccatgcattcacatcctattcttaataacggtcattatctcccgcttattaatgacgaacgtcatgtatgttctgcagactgacatgtatatcttgaag

SEQ ID NO: 13050 - DNA, 414 bp, Zea mays
  Clone ID: cC-zmpo14820014h01d1
gaccatggtaattggatcgagattctacgcgtggataacctggtcatcaccggcaagggaaaccttgacgggcagggcccagctgtgtggagcaagaactcctgcaccaagaagtacgactgcaagatcctttccaactcgttggtgatggacttcgcgaacaacggggaggtgttcggggtcacgctgctcaactccaagttcttccacatgaacatgtaccggtgcaaggacatgctgatcaaggacgtgaccgtgacggtgcccggggacagccccaacacggatggcatccacatgggcgactcatccgggatcaccattaccaacaccgtcattggcgttggcgacgactgcatctccattggccccgggacctccaaggggaacatcaccgacgtgacctgcggtcct

SEQ ID NO: 13051 - DNA, 132 bp, Zea mays
  Clone ID: cC-zmpo14820014h02d1
aaaaggaaatatcatatatattccatgacaagattacagaacgacttgacgcgaacacatgaattttaaatagtaatgtctacgtaataataataattaaataacacaacccgttaccatgcatgcatagat

SEQ ID NO: 13052 - DNA, 333 bp, Zea mays
  Clone ID: cC-zmpo14820014h03d1
agatagacaggattatatattatcatatacttaactcctacaatggttcgagacggcgtctcgatgtgtttacgcatgaatgcatttgcagctgaccatcgtctcttaatttccctggtcgcccgcccctttggttgattattattcctcggaagcggaaatgaaccggacgacgggacgacgagagaacaaacgagctagggggacaaagctagagaagaaggaaacgagagaagccgctgccctcacgctcctttaaaattgtgtatacagcaccgtgcgcacgttatggagaggaaggtgaaacccagcgagatgcgtgcatgctctaga

SEQ ID NO: 13053 - DNA, 303 bp, Zea mays
  Clone ID: cC-zmpo14820014h05d1
aaataaacagtgtattcaattcatgtaataaaatcaatccaacacaacaaggcacatgaagagatggtgttgtgccacaaaataaacataggaaaaaaattaaatattggctcgttgacacgtggactggaaatattattcgtcatcactcatcacaggctcatcagatgctgagagtggtcttgtaggtggtgccggccttgaaatcggcggggatgacatcatcggcgatacggtagccgccagacttggtagcaaagcggatgcagagggggtacttgagcggggccttggtgtcgagcg

SEQ ID NO: 13054 - DNA, 375 bp, Zea mays
  Clone ID: cC-zmpo14820014h06a1
ggggtgtgtatgtgtaattgtgtatatatatactgtcgtagcgccaccgcctcctccaccgtccaacggcacgtacggccgcgacgacgacgtcaatgtatggtgtgcgatcggtggagccaggctgcgtgacctggcaggcaggcagaccagaccagaccagaccgaccggctcggcgacgacggcgcgccccggcagcagctagcgctgggctcagttcatgttgcgggcgcagcgcgtgatggcggagcagccgcggcggtaggggttggcggccttctgcgcctcgcagttgctgtagtaggaccggccgcgcttgttgcacggcacctggtccgcgcgcagcgccgcgtagctgatgtaccggttggtcg

SEQ ID NO: 13055 - DNA, 390 bp, Zea mays
  Clone ID: cC-zmpo14820014h07a1
acaaaatgcaaattctatttcatcgtttcgtattaattagagatttacaaggacaataatctccatgactgcacgacaacatagatctaaaatgccaatgcatcgttgaacccggcatcataagcggcgtcggtctcatagtcaccgatcgcctctccgagcatcatccccccgaccgcaccgcctaggagccctaggccgagccccatccccatacctccgccatgcctcgccggtgcagctaccggctgtgctgcgtagttgtacatcgccggttgtggggaagcagcattgtacccgtacggtggcggagcagggtacccgtaaggctgccgcgggtacgccgcgtacggcgaacaatattgttgcggcgggtatgcggacgccatg

SEQ ID NO: 13056 - DNA, 455 bp, Zea mays
  Clone ID: cC-zmpo14820014h09a1
agcctcgccctttttttttttttttttttttttttttttttttttttttttttgtttttttttttttttttttttttttttttttttggggtaagttttttttgggaaaaaaaaaacccgggggggggcccgggggtaacccgggaaatccggagcggggcccgcaagggaaccccctttccctatggggggggaactaaaacgttggggacccaacggggggggcggcccccggggggaaaaagggttcccgttaaaattccccccaaccttaaagggggggggataaaagggtgaccccgggggggccaaaggggggcccccccccaaattattgggggggccccaccgcccccttttcaggagggaaaaccttttggccccatgccttaaggaaaccgccccccccccgggggagggggtttgtcttttgcgccccccgggggttttttttt

SEQ ID NO: 13057 - DNA, 338 bp, Zea mays
  Clone ID: cC-zmpo14820014h10a1
atgataagagattcaaaatgcaaattctatttcatcgtttcgtattaattagagatttacaaggacaataatctccatgactgcacgacaacatagatctaaaatgccaatgcatcgttgaacccggcatcataagcggcgtcagtctcatagtcaccgatcgcctgtacgagcattatacccccgaccgcaccgtctaggagccctaggccgagccccattcccataccttcggcatgcctcggcggtgcagctaccggctgtgctgcgtagttgtacatcgccggttgtggggaagcaacattgtacccgtacggtggcggagcaaggtacccgta

SEQ ID NO: 13058 - DNA, 441 bp, Zea mays
  Clone ID: cC-zmpo14820014h11a1
gggccggggaaaaaaacaaaaatatagggggccccacccccgggcctttaaaggttaaaagagccggtttatcccccgggctaaaaaaatgggcccccccccaggggggcccccccaaaaaaagggcccccccccgggccccaaaaaagggggatgcctcccattttttggggggaaaaccccccccccccggataaaaatacattttttttaagcccgccccgaccccggggtcccccccggaatttcggaccgggccccggggggggaccaatttttcctaaaggggggcgtattaaagcttgggggaaacaagggcaaaagtgtttcccgggggaaaatggtatcccctcccaattccacacaaaaaacgagccggaagctaaaaggggaagcccggggggcgccatgggggggcccactcaattaattggggggggc

SEQ ID NO: 13059 - DNA, 157 bp, Zea mays
  Clone ID: cC-zmpo14820014h12a1
ttttatttttttttttttcttccgttattatttgaggaagaattgggataatatttattttatctctgactgctaggcggccacctgtttggaaccagtaaattcctaaccgttccttttaaagtaccagctttccaaaaaggggctagaattgtat

SEQ ID NO: 13060 - DNA, 509 bp, Zea mays
  unsure at all n locations
  Clone ID: cC-zmpo14820015a01d1
acgacaagttggcatgcacataacaaagttangattgcctagtcctccagcacctcttatcatcagcatggttggaaggaatagtcgagatgcatgcatcccaaagcgtacggacctggtgcgtccttacacatcaccaagttgggcgcctccggcaatggcaggacagacagtacgaaggctgcgcacgaggcatgggcatctgcgtgcggcggcactgggaagcacacaatcctcatacccaagggcgacttccttgtcagacaactcaacttcacaggcccttgcaagggcgacgtgaccattcacgtggatggcaatctgctggcgaccacggacctaagccaatacaaggaccatggttattgcatcgagattctacgcctggataacctggtcatcaccggcaagggaaaccttgacgggcacggcccatccgtgtggagcacgaactcctgcaccaagacagtcgagtgcacgatccttcccaactcgatggtgatggactt

SEQ ID NO: 13061 - DNA, 371 bp, Zea mays
  Clone ID: cC-zmpo14820015a02a1
agcggggtgtaaaaacaaatatatagggtggcctacacccgggcctttaaaagagccgttttattccaagggcttaaaaaatttgcccccccccaagggggagcacccaaaagaagggcacccccttgggccccaataaagcggggtgggtccagtttattgactggcagacacacgcgaccaggattaaattacatatgttttagggcggacgattacgacgacgatcacaacgacctttcccaacttttttggggggcgggaaaaaaaaacaaaccaatccatgggcattttcttaagggattattttggaaagcgtgcggcaaatttcggacatttaaatgagcgacctgttggggtccccctggggg

SEQ ID NO: 13062 - DNA, 347 bp, Zea mays
  Clone ID: cC-zmpo14820015a02d1
gacatctgcatgaatactccctcccccgacctgcgcaccatgactgctgagaagcacgccaacaagtacaatgtggtgtactccgcgacagggctagacatccaggtggacgccttcaaaaaccgcgtgaaggctgaactgcccctctccaatgaggaggtcaagacagccccgacgccccaggctcggaggccagctgaacctctgcaagacctactacctggacgccctctacaacctcagtgcctgcaagcgctccatcggatgacgacacgccttcaccatccgcgccactatgagcatggtggcgcaggacacgcataactgctacgagtagttcaggaacg

SEQ ID NO: 13063 - DNA, 318 bp, Zea mays
  Clone ID: cC-zmpo14820015a03a1
caacccctgaatttggttggtatttggagaagaaattttataccctcaaagtcagggtgttacaccgtcgaacataatatatctgtcggatgtctgtcgttttactgttgcgcgttacccatggatagcatctaatgggcaatgccaggacgagagaaaaattatcactagagagatgggtcagtcgatggagggtctagaagcatgcaagctccttgaggcaacccttggtgctgaccttggcgttcgtgcatatagccatggtcttgttgttggtgccgctaatactcgacgttgacgtcatccatggtgacgccg

SEQ ID NO: 13064 - DNA, 499 bp, Zea mays
  unsure at all n locations
  Clone ID: cC-zmpo14820015a03d1
cctgcaccatgaagtactacttcaacanctttcctaactcgcctgtgatgcactccgcgaacaacgcgcaggtgtgcggggttacgctggtcaactccaagttcttccacatgaacatgtaccggtgcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatccattggtaacgcacaacagttaaacgacagacatccgacagctatattatgttcgacggtgtaacacccttgaattgagggtataaaattt

SEQ ID NO: 13065 - DNA, 366 bp, Zea mays
  Clone ID: cC-zmpo14820015a04a1
tacagcggtcgcgcccttttttttgtttttttttttttttttttttttttttatattgtgttttttttttttttggacaaaaaaaaaaggcccaatgttccccccctttttttaaattttttcggagggggaaaatttgtggcctttttttccacgggtgctgaaagaaaaaaaagaaaaaggggcccttcttttttataaaaataaccagggagatataccggttgttttgttagtattcagcccatacaaaaaaaacggttggtggggggcgggaaaaggtttagttgattaattaaaagggcgggcttttttttttttgccggacccgcagggggcgggccccccacggacaggcgcgggcct

SEQ ID NO: 13066 - DNA, 322 bp, Zea mays
  Clone ID: cC-zmpo14820015a04d1
aggcgacaacctcctgatgcactgagaggtttgagcgcggccgcgcgggggcgacacactgcaggaacggtaatggaatgatagctagcgctcttaattcatcagcttaacaaatgatctggcaacaaccacacctactattgtatgggctgtctgctacaatgcaaccggaacatctccctgcttagttacttgagatcgagggctacatgtcttgctttgcattctgcaaccgttgcacaaacgttcacaatctttgccttccgtcaaatcttaatacatggacggaacattgagtcattttgtcttgtcaaaaagaaaa

SEQ ID NO: 13067 - DNA, 513 bp, Zea mays
  Clone ID: cC-zmpo14820015a05a1
gatatctcttacagtattgcttttgtatgtacgactccagcagaaaaaacaacagcaaatgtgctttcttttttgacactgcagggggggacgtatacgtgttgttctgtccaattttactcacaatctgttacaattcgtagcaaaaaaaaaaaacaatcagcatgccacgtgattctccagtctccaccttttacaaggtacaaccagtactcaatcttccccggaaagagacgcgtttgcagcgcggtatgtatgtacacaaagaaggcggcgtgcagtgcaggccatgccatcgatcatttccaaagcttgagcgagtccttccagctcccatgcttgtcgaagtgggcgtagatcttgtcgagccggatgatgatctccgagaacgtcggccgcgccatggcttgcgggtgccagcattcctccaccagcgctttgaagtcgggaggatagcccttgagcctgcccttgagtgatggccgcagtccctcgaccggatcgagtgccctg

SEQ ID NO: 13068 - DNA, 539 bp, Zea mays
  Clone ID: cC-zmpo14820015a05d1
gcactttcttgtgcctcttggtccccgattcgccatcgccgactgttcgacccggatgcacggaccagaccctatgagtgcttctgcgggtgcttcggcttcaggccacatggcggcgaacggcataaaggtggctctgcaccggcaggtctcggggggctcgatgaagcagaacgcggagctccggcgccaggcgtcgctcgagtccccgcggacggggcgggccaccagccggttcctgttcgggcggcagtcgtccatggacccgaaccggaggcgcggacggagccagagccccgtgcgcgcgccggaagacctgggcgtgccggacaacctggacgccaccatgcagctgctcttcttcgcgtgccagggcgacgcgctggggatcgagggcctgctgcgcagcggcgtcgacctcaacagcatcaacctcgacggccgcaccgcgctgcacatcgccgcgtgcgagggccaccgcgacgtcgtcagggtgctgaacaactggaaagccaacatcgacgcgcgcgaccgctggg

SEQ ID NO: 13069 - DNA, 450 bp, Zea mays
  Clone ID: cC-zmpo14820015a07a1
gggggtggggccctatttaacggggaggccggagaggaaaaaaaaagaaaagggtagagaaaaacggagcccgcgccccgggagaaagtagagggggacgggcccaacaaaggggagggccccaaaaagataaaaaacgggggggggcccgggccccgccccggcgcccggggggggggccggggaggacgggccgcggggacccaaaagacctcgccgggggcctaaaagggggccagggcccaagcgaagggggggaccaaaggggggggtgggggggcgccaaaaacctggaggcccccaaactactggcagacgaaaaacgggggggggaacccccccggggatgagggaacaggggccggggtcccccccaaccatggggacaagcacccaaacccgggggaggaaaacaaagcggggggcaggggccccggggcccaagggggg

SEQ ID NO: 13070 - DNA, 518 bp, Zea mays
  unsure at all n locations
  Clone ID: cC-zmpo14820015a08a1
ggcacctgaagagaccgccgcatccgcatcggcgcctgggccgtcgtctgtggacgtcgaagcttcatccaaggccaccggaccatcgccgtcagaggcgccatcgcagagtggttcgaccggcgaagacaagacgccggaaaaggaggagggaggaggagacgctccgccaccggcggcatcggccagcgggccgcccgacgaggcgtcggagacagcagcaaaggacgtcgatgctgctggaggcggcaaaacgccggcgccagcgggagcagcgtctcagggcaacaacctccgagtccccgtctcttgcgtgcttacagttgctctgtctctagctctgactggtggtatctaattaacccatctcttcatttcgtcagccgcgcgccgtatcattgtgacaacattttttttagtagctgagcatgctgtaaaagtaatttggttgacaattgcacattagctggacctatatatttaaagcacgcagatagcatgatgtctgttnnnaaaaa

SEQ ID NO: 13071 - DNA, 480 bp, Zea mays
  Clone ID: cC-zmpo14820015a09a1
agaaaaaaaaaattcccgcgtttcatttcgaaagggggcctgaacaagattcttcaaatatatgcagaagaaaaaatatttgcttagtaattggagtctgttgtccaagcgattcacgctacagccaaatgatcgaaccaacccccaaaaaaaaagaaactgaactaaagcgggtcatcgtaactgaatattcccagcgcaacaattggtatcttgtggcgcggacaagagccgctcaagcaaatagggtaggtaggagggtcttcgctttgttgttattattactgaaaacgaagttggaaccagcaacatcatcaacatgcattccaggggaaggggttgtcattacatcccctgttcgagcaggtagtcgcccagcctttccaccaccaagttgcactgcccgggagtcatcggctcgtcgtagatgccaatgatgagtgactgccctgttttcttcacagtgatgcccccggatcc

SEQ ID NO: 13072 - DNA, 510 bp, Zea mays
  Clone ID: cC-zmpo14820015a10a1
cacagaaaaacgctgatacaccatctgggataagcgttaggataggtacacacatagccacttataaggttgtccatatatgtatagtacaaactttttgtagttctgtaagtactagacaggtgcctactggcatatcagtcagccactacgttattccaagccatggctgactatgggctatggcattcgagaataccagcacattacattacgattgtaggtaacagtttcatcgcatggggcaagctcacgcatcatggtcgccttcaacagtgttgacacgctcacactcatcaatccattcactatatatatcaataggctcagtgagtgcattaacagttgtgctgaagttttcctgacagattctacaagatgcttcgccaatcagattcttcatgtcaattcggcactcaacactactcccgtggttgcagaatgggcaggaaaagacagtgtcaagcttgtccatccgcttcttaggaggtggcttagcagctgactttc

SEQ ID NO: 13073 - DNA, 493 bp, Zea mays
  unsure at all n locations
  Clone ID: cC-zmpo14820015a11a1
ctgaagtaattctgatgtagcacattgatgcatgagaaacgtctctatacaacatttaaaacgttaatgttccttcctttcccttctgcctcctcgctctagaaaagaaattggcgcctaaattgcccagattacatgccgccggactgccgactataccccttctcagtgtgcaaccaagggcacacttctcaggcacaggcagatacaaactttttggcaggcttcatgccgccggcggtgttcctcttttcctgaccacacagaaaaaacactgtctactgcactctaaacttgcagcatccagccaaaggtttgattggccgcttcaagttgtcnggtgtttagccacctgaaggcagcatagacccatcaaccgcacagaggattcaccatgattcggccatgatccagtcactaatacatgtttgacatgccaaacggaacaacgccgacctttctgtgagtagttgctgccactcctgctgcagtg

SEQ ID NO: 13074 - DNA, 237 bp, Zea mays
  Clone ID: cC-zmpo14820015b01a1
ccaaacgaatgattttaaaaggaaatatcatatatattccatcacaagattacagaacgacttgacgcgaacacatgaattttaaatagcaatgggtacgtactaataataattgaggaacacagcccgctaccatgcatgcttgggaattcgtatcagaccactactactatatgggaacagcgttgaaagtgacgacttccatgcatgcctccatgaagagcagggtatgcatgc

SEQ ID NO: 13075 - DNA, 214 bp, Zea mays
  unsure at all n locations
  Clone ID: cC-zmpo14820015b01d1
aaccccaccnaaacaaananaccaccaacacacccccaccagcagagcaaacaggaacagcaaaaaccacaagcgcaaagccgcaccccacaccccaacacagagccccacccccacccacacccgcaacaccaacgcccccctcaccaacccaccgaccacccaagacgcgaacacccaccgagaccaccgaaccgcacaccaccacaacccc

SEQ ID NO: 13076 - DNA, 383 bp, Zea mays
  Clone ID: cC-zmpo14820015b02a1
ttttgttttttttatttctttttaccattttatactatgttttcctttatttaatagttgggttgtgtttaaaaggggggacattgcattgaccccagtggcatgaaggggagaaaatgaatatatttcgaatgggcctatagaggcagactaatagaatgaataagaaagcccgcacgattgacaaatgcctaaaaaaagactgcccagagtgagaaccagaaatgtgacaacgagtcgagtgatggatgcaagtttgttcaaacgcaggcgagctactacgccatgccaatggacttgccgatggcgttcttgcagacagacatggtcttgttgaatgacctagagaacttgatgtcgacgtttatgagctgcacgccctg

SEQ ID NO: 13077 - DNA, 170 bp, Zea mays
  Clone ID: cC-zmpo14820015b02d1
tccacccgcttgcggcatgtaggtaatcggtctgatcttacagggaaattgcattcaaaccacagacgactctacccaattaaaaactattacaaacaaacaaaaaacaaaaaaaaaacaaaaaacatataaaaaaaaaaaaaacaacaaaaacaggcccgcctttttaa

SEQ ID NO: 13078 - DNA, 370 bp, Zea mays
  Clone ID: cC-zmpo14820015b03a1
gacagttattgtatttttcgggaatggacatcattaccatctctagtttaagggtacagcatacaactcggttatgctagtgagaagaatcccatccacaccgcatcacccatgatcgatctttttacaaattacagcacaccaccgaccccacagattttgtgaccccgacgagatgaagacctattacttatacaatacagaaacgacgacttacgtaggatgtctgctcgactaacccaacgaattaaaacttttgacaggaagagccaccgataacagtgtcttatgcgcaactattactgcctccgggcgagcttttacacacctgcgagtggctgtgatgatcaatcacccatgcatggatctt

SEQ ID NO: 13079 - DNA, 548 bp, Zea mays
  Clone ID: cC-zmpo14820015b03d1
gggcattgatcgatttttacccggattacgatggccgccttcggcagccaagagggagaccagcgatccattgagaggatgtgtgggcgtgcgggcgtatgtgcagcgagcacctagggcatatgcattatttcagaagagaactagctactccgatcaagatgagcgacgaaggattgtacgtatattgctgagaggagatcgaacagacggtgatgagttggcggaagatcgatgcatgcgtggatgatcatcacagccaatcgtacgtgtgtaaaaggtcggtcggaggggggaataatcgtgcatgagacacctctttcgctcgctcttcctctcctacgtcttaattcattgggttcgctcatccgagatactacgtacgtcgtgcgtttagtattgtatatattataggtcatcatatcgtgggggtcatcacatctggcgggttggtggtgtgttgtaatttgtaaagagatcgatcaggggtgatgccggttggatggtatactacacactaacaaaaccgagctgtatactggactact

SEQ ID NO: 13080 - DNA, 424 bp, Zea mays
  unsure at all n locations
  Clone ID: cC-zmpo14820015b04a1
gttactagagaatcactcgaaatcactctattagagaattatggagcggagctatatgccaaacaacccactctccgtacaatcaaagcatgcatttgaaacggatctgggcgtacgagctgcagctgcaggctattgggaccacaagctctgatacgagggcaactcagaatctgagtactacgaaaatcatgtctgtatacctaatccagcttgcatccgaagctcatcttacaactcataaatatttccacgtcaatcacccaaatgacagtagcgtcactggacctctcactgttgctgcggcggttgctgtgctactggttgttgttggtaatttggatagccagcataagctccagctccataattatacatattagggtcctgagactggnggtacccataggcctcatagccttga

SEQ ID NO: 13081 - DNA, 272 bp, Zea mays
  Clone ID: cC-zmpo14820015b04d1
aaggacgaccaccaccaccctatctgctttcccgaagactgcgtggaaacctcccaacatcacatgaactagttcatgctcctaaatccatctgcctatccatgcatgcattgcatcgcgtattcacactgtgcttgccatacgcccaaacagctgcacacaatggcctccatgcatttctaacccgcctacacatcatcaacagatccatccatccatgtatttatactctgtattcctcaatcactcaatgaaaccccctctaattctgt

SEQ ID NO: 13082 - DNA, 519 bp, Zea mays
  Clone ID: cC-zmpo14820015b05a1
aaaaatatcatggcataagcataatcactccaagcaatattttgttttcagacaaagtattttaaactatgttatttagtatacacgtgcaaaacgctaattataaaccaaaaaaattatgttagatcgcgcttttaatactccaaaaatatcatgataactattatcgaaaacagtttttttacaaagcaatcaaacacctactgttggtagagagagagaaaaaaaactataataacctccaatatgatggttttatcttaaaactcaaaaggtactttgcttagaaacaccgccttaaccttctcgtcgttctcgatgatgaacgcagtgagttctcctgccgcagtccgaaaatgagcgacgagagcagtagtaaaagagagaacgcctcgcaagctgatcctggggatctgagaagaggaagcgtgcattttgctctccaaggtcagcccccgggtgcagctgtccagctggctcccttgtgccccggaaagtgattcgtctgcgacagcgaga

SEQ ID NO: 13083 - DNA, 506 bp, Zea mays
  Clone ID: cC-zmpo14820015b06a1
aaaaatatcatggcataagcataatcactccaagcaatattttgttttcagacaaagtattttaaactatgttatttagtatacacgtgcaaaacgctaattataaaccaaaaaaattatgttagatcgcgcttttaatactccaaaaatatcatgataactattatcgaaaacagtttttttacaaagcaatcaaacacctactgttggtagagagagagaaaaaaaactataataacctccaatatgatggttttatcttaaaactcaaaaggtactttgcttagaaacaccgccttaaccttctcgtcgttctcgatgatgaacgcagtgagttctcctgccgcagtccgaaaatgagcgacgagagcagtagtaaaagagagaacgcctcgcaagctgatcctggggatctgagaagaggaagcgtgcattttgctctccaaggtcagcccccgggtgcagctgtccagctggctcccttgtgccccggaaagtgattcgtc

SEQ ID NO: 13084 - DNA, 525 bp, Zea mays
  unsure at all n locations
  Clone ID: cC-zmpo14820015b06d1
cagcaaaattggctccattttctcgggctttnatttgganaaatagccaaccaancggcaataggccgcccttttggtgaccctaaccgcgccancatggccccttctcggcacttgtgattcgagggcttcgttctcgctgtcgcagacgaatcactttccggggcacaagggagccagctggacagctgcacccgggggctgaccttggagagcaaaatgcacgcttcctcttctcagatccccaggatcagcttgcgaggcgttctctcttttactactgctctcgtcgctcattttcggactgcggcaggagaactcactgcgttcatcatcgagaacgacgagaaggttaaggcggcgtttctaagcaaagtaccttttgagttttaagataaaaccatcatattggaggttattatagcttttttttctctctctctaccaacagtaggtgtttgattgctttgtaaaaaaactgttttcgataatagttatcatgatatttttggagtattaaaagcg

SEQ ID NO: 13085 - DNA, 368 bp, Zea mays
  Clone ID: cC-zmpo14820015b07a1
caggttgatggtgatgtccacatcctgagcctggatcgtggccagcctcgcactttttgtaaattttaatttaacgactgcattttattttaaggaggggaggtcgggtccacatgcatgcacccagggaatgctttagaactggggaaaaacttcttggatgctaaaaatccaagaacacacgggacaggctgagatggcgtcggggctccatgcatacgaatgaataaaatatatggttgggtcggtgaaacggcgcctggaaatgaaacccattatgcttcctctcaggctattgcggtgccgggagggggcttctgagggtcgcatcccctgaaataggcgcgtgggtcccctttggcgaccca

SEQ ID NO: 13086 - DNA, 475 bp, Zea mays
  Clone ID: cC-zmpo14820015b09a1
agaaaaaatataatgtcattcagataattttctcatgttattatcgttacatagtcaagaagaaacatagtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcagaatcgtcgccggacgatggtgctggggcgctggaggtgccatcagaagatgggcctggtgcggcggaggactcagacgacgacgatggcgctggtgcgctagagggaccggatgaggccgccgccgccggagcatcagcagccgacgcgctggcaccagcaccggacgccggcgcgtcgtcaccagacgggccgctggcgctcgcagggccctcggaggcgccggcggtggcatcggcggagcccccgaaggcgccgccgcg

SEQ ID NO: 13087 - DNA, 539 bp, Zea mays
  Clone ID: cC-zmpo14820015b09d1
cacctttactaccgaatatgatatacgcgttcaatttgcgaacttcccatggccgccatggctcgttcggtctcctgcgaggtgtcgccgccttctccggctctccctcctcgtctccgccgcggccagtgcgcggaccgtgggcgacaccgtgcaggacgcgtgcagcaagacccacttccccaagatctgcgtggacagcctcgccgccaagccggagagccagaaggcgacgccgcgcaagctggcggagctgttcgtgaacatcgcggccgagaagggatccgggatggccaccttcgtgcaccgcacgtacagcgacaaggaggacagcgacatattcaagtgctacgacagctgctccgacgacgtggaggaggccgtcgcccacctcaacggcctcgtccgggagcccaccgacgccaagttcctcgagctcaagtcgtggctcttcttcacgctcggcggcacctccacctgcgaggacgcctgcaaggacctgcccaagaccagcgacaaggacgacgtcgtcaacttca

SEQ ID NO: 13088 - DNA, 306 bp, Zea mays
  Clone ID: cC-zmpo14820015b10a1
aaaaaaaagaaaaaaaatgtgttaaattgccttacggacgcgaaaaaaaaaaaaaaagaaaggccggaaaaaaaaaaaaaaagggggggagaaaaaagaaaaaaaaggggggggccacccacaagggggggggaggaaaagccaaaaaaaatatgggatcccccccgagcttggccccgggggggggaaaaaaaatttatttaataaaaaaaaaaacggggggggggattacaaacaacaactatttttttagggggagggggggggaaaaacccaacaacaaaaataaaccccctttggggcttt

SEQ ID NO: 13089 - DNA, 98 bp, Zea mays
  Clone ID: cC-zmpo14820015b11a1
gtagaaaaatctgattttttggtatgcgtaatcgccaacgactttcgagagggtttcggtacccgagacttctaaggtgtgccatttggggagaagac

SEQ ID NO: 13090 - DNA, 392 bp, Zea mays
  Clone ID: cC-zmpo14820015b12a1
aaattatattcacaaagaactgtgaccacattgtaaagatattacgataaactgatgaagagcagcaaaaccaatgctagttgttcaaagatagatcacgacgagaatagcctgcgaggacgaaagcgtcatcgtcttctcacatcgtagcggcgcctgtcgtgagcacgagctcgagcgcactactatgggcatggctgcttggttgagcaaatgattccccctcactgctgcgagttgcgcacctccaacgcgcactgcgactggaataagggcacaagggacgccggctccgccacgggcgtcgacatcgctgggtgccgccaccccatgccgagcgcgggcgccgacggcctcggtgtcacagtcgtgcacctggtgctccccactgc

SEQ ID NO: 13091 - DNA, 261 bp, Zea mays
  Clone ID: cC-zmpo14820015c01a1
gcttgaagtgctattgtgcatagataaccctgatgatgatacacgagtcatcctatgtcatagatacacatctgggtacacaacaagggcaacgagcaagacgtgaagtttggctgtaaggccactctttggtgacacgcccaaccagagggacctttctttcagacctgtttacaaataaaatacaccaccggtagtacatatccgtgcgctcacacatttttgagaacccacagagaaacagggagtcatttttttttt

SEQ ID NO: 13092 - DNA, 100 bp, Zea mays
  Clone ID: cC-zmpo14820015c03a1
gacgttcgctgccctcgtacggaagcctgtatactgtacagcggtcgtctttttattttactagcgagcgcgcatggcatttcaatttatgcagaccctg

SEQ ID NO: 13093 - DNA, 272 bp, Zea mays
  Clone ID: cC-zmpo14820015c04a1
gccacaaattactaaatattttattcaaatggcacttgaagggtttacaaactctaggaaatgaggggaatcccaaggggagtttggggttgtttgggagaaaagattataagggcacattcctattcaaatttgaatagcaagaggattttatcctcctcaatccccttcctcacaaacgtacccttatgttttcaaactagacatgaggatttcatccttggggttgatgagcttcggggggtgtcctagttgacgctgatgagcttaag

SEQ ID NO: 13094 - DNA, 568 bp, Zea mays
  unsure at all n locations
  Clone ID: cC-zmpo14820015c04d1
acgcgtgtgtggggaccgctgtgtgnttgaaggtatctttttgacgccctttatacgacacaaagcaancgctacgaagcaacaatgagacccgtattctggggagggaactggttgtgtgcctggaacccttcagaacgggagccctccgctgacgaatgtcgaaggggggaatgctctctcgagaacgtaanagagacnagcttgagctcaacnaggaaggcccatggctgctctacacaaagagncttgaggaagaacggagcgcgtcggcagttgcggctagccagacgatggccatgatcaataggttgcaggaggagaaggccgcgatgcagatggaagcactgcagcacctgaggatgatggaacagcatgctgaccacgaccacctagcgatacaggatctgcatgatttgctcacagagagggagaaagaattgctcgacttggacgctgaacttgcacactgcaggaggctcctgcagaacgacgatccgttcaatggcgacagatttgatggcactgattatacaacgaacaacaacacggattttgtggggagcgc

SEQ ID NO: 13095 - DNA, 400 bp, Zea mays
  Clone ID: cC-zmpo14820015c06a1
gggaaaaccaagttagttaaattttgcaatattggcttcgaaaggggcctgcctacccggggggactgggaccccgttctcaccgggcaggtgttctcaccgggccctggttaaaggagtttacatgggggaagaaaaccctggccccgggggggcaaaaaacgggccacgggttcctgccaaggcccccggtcgatgcaaaacaaacagcttttgtcgttccggggcatgcatggggatcgcgcgagcgggtgcccgttttcctttttaaagagctcgggccctgacaatggccatgctcatcttgctgggggcgggggcccgcaactccagctggatgccctccaactcccttttgaaccgggccttggagcttgggtacaggattttggtcctgacc

SEQ ID NO: 13096 - DNA, 550 bp, Zea mays
  unsure at all n locations
  Clone ID: cC-zmpo14820015c06d1
gccattgcgcacctctttcccgngttcccgtcntctcgctcttcacccccgagctcggctgnagaaacattggagaccctatcaggcgatggcgcgctcnncctcggggatggccgtgagcgacgagtgcaagctcaagttccaggagctcaagtcgaagcgaagcttccggttcatcacgttcaacatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtcagggcgcgagctctcttaaaaggaagacacgcattccctcgcgcgatcgccatgcatgcc

SEQ ID NO: 13097 - DNA, 345 bp, Zea mays
  Clone ID: cC-zmpo14820015c07a1
gaaagcccaaataaaaactgttggtttataaaaaaaaccccggggaggaaaataaggggcgacatcgcgggtgtgtttggtacctgggggggccggcctaaagtttccctccccccctatgccaaactggaaaaaattgaaggggggcttctttgtttggtaaaagttttagacccctgtacttcagggctgtttccccaatttttttattgggccccccgtgccgggcagtaaattaattttggtgggccaggtttttctttccggcccttttggggtttttttttccccccacccgtggagaggggtcgggggggggggacaccttttccttggaaggggggg

SEQ ID NO: 13098 - DNA, 536 bp, Zea mays
  Clone ID: cC-zmpo14820015c07d1
caactcattcgccgcatccttcacatcatccagtggcgcctgtgcaaccaagcccaagacgcttggggggcattgcccagctgaggcgggcgtctgcgcacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcaaagctgatcgactgtccgtgcatgcgtgccaattaatataattggctgatgatgcctgatgttcagtgtgtgatactgcgatcaagcaaggagacgacacttgaattctttac

SEQ ID NO: 13099 - DNA, 129 bp, Zea mays
  Clone ID: cC-zmpo14820015c08a1
aggccctggtttttataaaaaggtgttttggttttttgcgccctgggccccccctaatcaaatttagggagcccccctcaacaattaggcggaccggtgaacctccaggggtttttggaaaagcccttt

SEQ ID NO: 13100 - DNA, 124 bp, Zea mays
  unsure at all n locations
  Clone ID: cC-zmpo14820015c08d1
cttctgtaagaagcctttctagntcattcggtttgctaattgttgacgggcgcttcattaatttgatttgatgtggctcatgggtgggagaaacaaaactacttttgataaaatgcagggcatg

SEQ ID NO: 13101 - DNA, 503 bp, Zea mays
  Clone ID: cC-zmpo14820015c09a1
aataaatattgagttattcataacatacttaatacatgaacaagattatgaaccttgggcatacatgaacaagatacatgacagtcatcagaatatacatgacagtcaccagagcatacatgacattctgcataaataagaacgagataatgaacgttattaagaataggttgtcgatgcatggcaagcgaccgagcgatcttgcttagcactgcctagtgcagatgcaacggcgggggaaggtgctgcacctgccggacaagaagccctgaccgcgggacacattggcgcagttgtatgcgatcatgcatgccccaacaaatcgttcactgtacttctggcattcccttgcctgtgccatatcggtggacacactgagcaggagaagcatgatgacggtcggctggaacctgcgtgacgacttcattacctttatcttggtaggaatatatatatgcacgcttcacggattcacgaactatttattcccaattatttcatat

SEQ ID NO: 13102 - DNA, 401 bp, Zea mays
  Clone ID: cC-zmpo14820015c10a1
aaaaaaaaaccgcccccctgcctttttttttttttcccttcaaacggggaaaaacccccatttgggggacattacattggggggcccctcggcgggttttttttttgaacaaaaacaatttgcttaaaaaaggcccgattaattggaatccaattttttgttccccccatataaaatggttatcgcatgcggggccccccggggaccacctacctataaaccccctcagcgcctgaggtgaaccccccgtcaccccggggcatgcatacatgcatgcctgcctgcatggttcattcatttcaaggggcttctcttcaaaaaggggggggggggcaggaccccttgcagttttcggtggggcgcgggtttttttccttggcccaagtgacccttcaggcctt

SEQ ID NO: 13103 - DNA, 545 bp, Zea mays
  unsure at all n locations
  Clone ID: cC-zmpo14820015c11a1
atgatgttcatatgaaaagtataattaggtggcagcatgttcaaaatattctttgacatcgatcatttcatgccacacaatacaatcgaatttttaggataagcaacagtccccagtttgtctaaagagacccaacaccaccatacgaatgacactgaatggaaaatatacaggggaaaagcaaaagaatgctggctaggtaactggttgtgaagttgcagcactcgttcaactccccatatgtttctccttcagagcatttcctgagatttgcggacacattgccttacctttttcttgaactcatcccgcttttctctccaatccttggcagcttcgatattcgctggagactcgtcatttggactagagagcatcgaaatgatgctcagaactatactttcaaccgtgtgcactggtgtccatcgttcgcttgcaagctcataaccattgggatcttcaccaggtggatgaagaatagaaatgcanacacgtccatcaggataaacattcggatgccacatctcagaagtaaatcttactga

SEQ ID NO: 13104 - DNA, 529 bp, Zea mays
  Clone ID: cC-zmpo14820015c12a1
atataacttgtcaatccatttcttaactcttctcttttaaacaacagcgaagtctcactctagctatatatggagatgaagaagatggagaaggaggatgacaccatcattgttggcgccagcatcactgtcgtaatagggtagtggtagcaaatagatatcacggtccaatgcatgcatgtgtaatgcattgcttgggatccaaccaattctagtatagctagcataggccggcttaaagtattgtcagcactaaagttaattatttggcggtgtaggcggtgttggccttccagttggcagggatgacatcgtcgtagacggacttggtgcctccctcggtagtgaggcggacggtgaggggtcccttaagcggtttgtcgctgtccttcctccagatggcgccccaggagtgcttcaggggctcgtacgtgtcagagcccttctcttgacgtccactgccacaatgtcaccgtcgccatcgacgtacttgaccagcagcgccaggtagttggggccgcaccccttt

SEQ ID NO: 13105 - DNA, 397 bp, Zea mays
  Clone ID: cC-zmpo14820015d01a1
gaacttgtattccttctcaagattgtacactgtactgtatactctgtatcagctgatgtgcacatgccaaaccctgtctgccaaataatcctctccgaaaacacaaacatgaggtgccgaataagatctacagtacatcttaagggacggtgcctacccatctaatttcccatttggcaagaaaaaaagcttctgaaacttgtcgaagcaaatcgagttccggccaataaagtgatatcccgccaatttgatctctcacgtcacgtgcagaggcaccaggtgcaccggcagaagctagggcaggagcaactgcagcagctgcatcgccaccactggcaccggtaccaccaggagcaatcgaaccagcagcagccgcagcagcagcacccggtgtcgc

SEQ ID NO: 13106 - DNA, 372 bp, Zea mays
  Clone ID: cC-zmpo14820015d03a1
cctggatgaaacaagccaagcatatggtctgggagtatcgacttaatacttctgacccgacttggctaggcgtatggtgtgctcaatgcatgatgaactaacacacacggtttgctcatattgacttgcttccacgcgagaaacttgacggaactgaactttttcatggccttggagaccatatggacgcacctaagggaactgagaaaactggacttctctatgcaccggtggacgccgtccatctccagcaaccagccaaaggagacgggtatgttgttctacagatcgaggcctaagtagctgacaagcatgtcgctacgtgtgtcttgctacattgggacggctcctcagtgctctccgactgaatcc

SEQ ID NO: 13107 - DNA, 503 bp, Zea mays
  Clone ID: cC-zmpo14820015d04a1
aatgaaccttgagctcattagaagataattcatacatgaacaaaataataaatattgagttattcataacatacttaatacatgaacaagataatgaaccttgagcatacatgaacaagatacatgacagtcatcagaatatacatgacagtcaccagaacatacatgacattcgtcataaataagaacgagataatgaacgttattaagaataggttgtcgatgcatggcaagcgatcgagcgatcttgtttagcactgcctagtgcagatgcagcggcggcggaaggtgctgcacctgccggccaagaagccctcaccgcggcacacattggcgcagttgtctgcgatcatgcatgccccaacaaatcgctcactgtacttctcgcattcccttgcctgtgccatatcggtggacacaatgagcaggagaagcacgatgacggccggctggaacctgcgtgacgactccattacctttatcttggcaggaatatatatatg

SEQ ID NO: 13108 - DNA, 301 bp, Zea mays
  Clone ID: cC-zmpo14820015d05a1
aaacgcacggtcaaccgactagtatacaacaatgtttcggtttccacagacccccttggggaatatcgacccaccggtgtctgcaaacaacattccaaacattccagtttctcgtacaaaatggggaaaagaaaaaaaaaggcaaagtgggcaagccatacatgacatttggcaaaaaaaaacacccaagccgccccactgtaaaaaggactactaccaaactggttgtcaaccctgacaaacacaaagtggagacattaaccaggaccacaccatccttaacattaagatcaccacaccc

SEQ ID NO: 13109 - DNA, 546 bp, Zea mays
  Clone ID: cC-zmpo14820015d06a1
agtagtagtagatcagacctcatctcaatttagattcaaacaagattggtaaaatgtacagttctaaggatccacagaaatacagaatactgccacgaatgataacacaagatacgcaccaactcattcctttccttggagacacggtccaattctctctgcggttgtgaagaccaagagcattaggaacaaaaggcaaaaaaacactccgccccgaacacgaaaaaagcctgatgaccttcgtagaccatttggaaaatttggccccgttaaagacatatatctgccaaaggattactacactcggtaaggtatcttgacttaattattgtgaggtgggtgtttgcccatggacacctatgtgcaacttggtgatctctccctgaactcctctggttccgcttgaatggtcggccgagatgaatgcggtagaataggttgtacgtgccttccgggaagaagaattcaacctcccctctgacttcaaaccaccagatttgcgagaggtatcgcaaccgtgcgaatcttgattcatcactgggaatg

SEQ ID NO: 13110 - DNA, 477 bp, Zea mays
  Clone ID: cC-zmpo14820015d07a1
acaactacacaataaattcattaattgtcattcaaattacaaacgaagaaaaacatgcaaaaagttaaccaaccagtcccaaaggatgaaacaaaggcctagatatcttgaggagaaattcataaattcctaataagcgtagtcatatcgactcccattcccatgcatgaccatgagaacacagattcccagaagaattgctgctctgtgactatgatgttagctcaaagccaccatggtcatctagaaaggaagcatcgcggtggcagcggcggccagcatggccaggacgacaccggtgcccatgctcgggctgccgctctcgtggtcagcggccgggccaggagactctgctggtgactccgaagcatgggctggctcgggtggactatcggcggattcgccgccggcctcggccgtcgacggctcttccgaggcggcactgccaccgccgctgctgctatcgtgcgatgcggt

SEQ ID NO: 13111 - DNA, 549 bp, Zea mays
  Clone ID: cC-zmpo14820015d08a1
caatcacatgcccgatttggtattcaatccaattcagttccatcctcttcaatatcgacatccaaacggagagcaatgtgtcttactatgtgtgatattgactacgattatagagtcattgggacggcgattgatctacactgccttagcagtggacttcaataagagaatgtttgtttccacctaatctatatagatcagagtggattgggtgggttttagtaagtcaaaatgccttccaaaacatgtgagtacaaataaccgaacaagcgtgagaatggaatattccgtgagaaaaaacagaagacgcaagcctgctcatgtcgaccgcatgtgacgagttcacgctccggacaaaacaaaccttgatgagacccggggcgcgtgcacatcacagcagccatgctctctccttgacggtgagagatgatgatgacaggtgatcattgattgccgcacccgcaccgcacgggcgccgtactcgttggcaggcagaagcagaacagacacggatggaggcgcgggtggaccacgacgaccaccggatgc

SEQ ID NO: 13112 - DNA, 554 bp, Zea mays
  Clone ID: cC-zmpo14820015d08d1
aacctaacttgaccccgtcctgcggccgttggttttgaccgtcttgtgggcggacgggcatggcgattggcgactggggcttgtccggagcgtccgggaatggccatgcgcttggatgcttccagctttaccgcggacggagcccgtgactgtctgtgaacgagcggcgccggcactaaacaacgagtgctggctggtgaggcgtggccgcatggtacccgcggcccgtggccccggagccggaaatgcatccggtggtcgtcgtggtccacccgcgcctccatccgtgtctgttctgcttctgcctgccaacgagtgcggcggccgtgcggtgcgggtgcggcaatcaatgatcacctgtcatcatcatctctcaccgtcaaggagagagcatggctgctgtgatgtgcacgcgccccgggtctcatcaaggtttgttttgtccggagcgtgaactcgtcacatgcggtcgacatgagcaggcttgcgtcttctgttttttctcacggaatattccattctcacccttgttcggttatttgtactcacatgtt

SEQ ID NO: 13113 - DNA, 506 bp, Zea mays
  Clone ID: cC-zmpo14820015d09a1
acatgaattatttcacatgaatcggttctttttgacataataaaaaagacattggaaacaagaaaaaaaaaattcccgcgtttcatttcgaaagggggcctgaacaagattcttcaaatatatgcagaagaaaaaatatttgcttagtaattggagtctgttgtccaagcgattcacgctacagccaaatgatcgaaccaacccccaaaaaaaaagaaactgaactaaagcgggtcatcgtaactgaatattcccagcgcaacaattggtatcttgtggcgcggacaagagccgctcaagcaaatagggtaggtaggagggtcttcgctttgttgttattattactgaaaacgaagttggaaccagcaacatcatcaacatgcattccaggggaaggggttgtcattacatcccctgttcgagcaggtagtcgcccagcctttccaccaccaggttgcactgcccgggagtcatcggctcgtcgtagatgccaatgatgagtgact

SEQ ID NO: 13114 - DNA, 484 bp, Zea mays
  Clone ID: cC-zmpo14820015d10a1
ggggaaagacaaatcagaacaacgattcacagtcatttcatagtatgataacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggccgtccggcatgccgcgccccgcgcaagtgtcgtcccggcagttgtgcgtcttggtgcagatgacgcgggtgtcggcccagcagtcctcggaatggacgggcaggacaaagcctgtgttgatgagaagcagcagaacgaggaggcctgaagccatcgccttgctcgtcgccttcatttcgagggagcagagcagaaggctggatgaagatcgcttcgacgcgtgggtcg

SEQ ID NO: 13115 - DNA, 471 bp, Zea mays
  Clone ID: cC-zmpo14820015d11a1
aaaacctggctgggatgtcccggtactaatgaaaaccctgagctttcattagctcgtctatatatatatataagcaaaacatctcatcagtaaagagattagagattcgtgtctctcgcttttgcttcgtactcaaatagatatatcgggtggcatgcgtcgctacttgggcgggggctggatccacgtgtcgccgaggacgtagtgtgtgccgacgaatggcttggcctgcgcctcggggaggtccagcgcccaccccacccttttcttcttcttggggtcagcgccggggccaaagcacttgaactcgccgtagtagatgccgctgctctccggcttggggatctgccagccgtcccagcccacggggaccacctcctcccccatcttcgtgtacgagtagacgacccgggaggagtccccccaggcgcggcccaggtagatctggccgcccttgacgccgccgatgct

SEQ ID NO: 13116 - DNA, 492 bp, Zea mays
  Clone ID: cC-zmpo14820015d12a1
agtggaacagagaacttgttacacatacacaggcaaaaaccttatcaagttctctcacaggatcccttctttcatatttaatcatgaggctagaattatgttcgagcctgatcattatgctgttccagaaaatatgaaccaagaaaatataacagcgtgcatttctcatttatctgagctttcatgtttacatgatgacacaaatggcttccctgaaactgttgttgcgcaattctcaaatccttcataaaaaagcaaaatggaagcaggttccccgatgcaagccatgatgagctacttctttgatggcacaaaaaattcttgactgaaccaactcgaatgagagagcactattatgaggagaatataaggctttgaggaagacgatgtagctgactgctacctcaagaaattccacaaccacctgttccatccgatccataactcccttcaggtaaatcctgagggcgacgatggtggccatgtcgtcat

SEQ ID NO: 13117 - DNA, 321 bp, Zea mays
  Clone ID: cC-zmpo14820015e01a1
ggcccacccccaaaagggtgagggagcaggcagcaaccctgcaaaacccgttagttttttttataaacagaactggccataccccaaaatttttggattttttaacccccccgaataaaaaaaaaaggtggctttttaactgactaatccgggccaccggccacaccgatcaccggaccgcccgttagctgtcccccgtttcccaagaaccacccaccgttgtggagtcccccctgatttggggaccaattttttcaatttcaccgttggccctgggggggcttatgcgtgccttgtacgcggggccgaggttccttaacc

SEQ ID NO: 13118 - DNA, 364 bp, Zea mays
  Clone ID: cC-zmpo14820015e02a1
atccaaagcacacatatacgtgatgggtaaatcgaattgttgaactggtccagacaaatggcaagcaatggcacaggtgtcgatccctcactcgagggaaagaacaaataacagggcaccaaattaaactggtgcatcaccgataccaattcgttaaatgaaaatcaagtctaaagaggaaggaaaatatacaatcaaaaggaagacaacggtgtgccactgacaacgtcttgcccaatctgagcacgctcacgcattattaatgcgcgggagcagcagagcagcgcaccgcaatcaagtctctccccccaccttggtctgttccctccgtgtccggctcctagtccggcggctcactgaatgt

SEQ ID NO: 13119 - DNA, 354 bp, Zea mays
  Clone ID: cC-zmpo14820015e03a1
ccgggcaaaaaaaataccgctgggtgaattacaaaatactggggcgggtattacccctgctgtgcatcctcaaggggattgaacaaccactcaacggcactccaagggagggggtgctcccagcgcaacaaccaacaatgtgcctcgggcagccaggtgattcaacaatctacattttaagaatgcaaatccgactgtctatccttacctgaacgccactctctcctcgctggacttctttatgggggggaggcctacttgccaaaaacccatattttaggactgacttccacctgctgaccgcctgctcttgggttcatttagctctatcccaccctttttgtcacgcgcatc

SEQ ID NO: 13120 - DNA, 392 bp, Zea mays
  Clone ID: cC-zmpo14820015e04a1
ggaaccgggaaaaaacatgttttggccccggcccggtccatggatctttaagggcccccggggccatgaaaataatcccccccaggattagggggggtttcaatgggggatcgacctgcccccggacacatttatctttggccgcaaccgtttattctttattggccggggggggagccaggaccccctgcgacccaattgttccccccttttggcagccccccaacagggcctgggaatacgggctccacaaccatgcccaattggagcggccccccccgtggccctgatcctggcagggcccccccccatctttgggaaaacaaatagggggggggtgagattccttccaacactttttgtaatgagcagtccacccccttgcgctgggg

SEQ ID NO: 13121 - DNA, 461 bp, Zea mays
  Clone ID: cC-zmpo14820015e04d1
gctttgaggaggcccgcggggtgccccgcccttcttgtgctgctcatcgacgcctccagcgcaacggtgtcgactgctcatgacaagagctgctggaaggaccacaaccaccaccctatctgctttcccgaagactgcgtggcgacctgccagcatcacggccacgcggacggccgctgcaactgggcatggtcgtggaggccgtattgccagtgcctgttggcggactgccaatacgcgcgaacagctgcgtcgcatggcgtcctggctgcctcgccggccgatgaaggatgaaccgttgcggccgatgatcgatgtgtccgtcggcatgtcgatcactcattgaaaccccctctaatcctgtgcggtattattttcatggcacctgtggccattaaagatccatggacacgtacagtaccaatacatgattcttcacacttcaaaaaaaaaaatttaaa

SEQ ID NO: 13122 - DNA, 339 bp, Zea mays
  Clone ID: cC-zmpo14820015e07a1
cccgccccaaagcaaatcaacgggaaaaaaggtttcccaggggggagcattgggcttttttgggggaaaggaacaggggttccctgcccaacaatttctggtacaaaaaaaaaacgggcaaaagagggtcacaaagggccctacagccgggggctcaagggggcaggggcctttttttttgggaaggggaaaaaaaaagagggggggggtggtaattgcctccccaaagggggggcccttaaataacaatcgcctaagggggggggcccctttggttaaagggggggggacgggccaagaggggggcttcaattatgagggccgacccccgggaggggc

SEQ ID NO: 13123 - DNA, 499 bp, Zea mays
  unsure at all n locations
  Clone ID: cC-zmpo14820015e07d1
caccacctcgcggctcatgggccanattgcggcgtttgcgagagtgtcacagctggaccacatcgctgagacagagcgcttcatggtgaaaaaacaggacgggctggtgaagctgcaggggtccaagcaagggaggaaggggcagctcgccatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcataattgaagccatcctcttagaccgcctccaacactttatccatatggtctccccctcttagtcgaatgttatttaagtgcatcctcttcggagatgcaattacaatccatcctctctttctttttccctttctcaaagagctaggaccttgctcgactgaccttaag

SEQ ID NO: 13124 - DNA, 464 bp, Zea mays
  Clone ID: cC-zmpo14820015e08a1
acataaatatcgtatattacttcatgcaaggaaaacatgtggtgaaagacaaatcagaacaacgattcacagtcatttcatagtatgataacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggacgtccggcatgccgcgccccgcgcaagtgtcgtcccggcagttgtgcgtcttggtgcaaatgacgcgggtgtcggcccagcagtcctcggaatggacgggcaggacaaagcctgtgttgatgagaagcatcagaacgaggaggcctgaagccatcgccttgctcgtcg

SEQ ID NO: 13125 - DNA, 415 bp, Zea mays
  Clone ID: cC-zmpo14820015e08d1
cagccttctgctctgctgcctcttagtcgggttaagagcaaggcgagggcttcaggcctcctcgttctgctgctactcatcaacacaagctttgtcctgcccgtccattcctaggactgctgggccgacacccgcgtcatctgcaccaagacacacaactgccagcacgacacttgcgcggggcgcggcatgcccagacggacgctgacactgggagttccccaacctggtgcccttctgccattacctgcgccccaactgccactagtactggcgccttggattggctcacttcgcctgcgatgatcgatggagcccaactgcaactgcccaatctgctccatctcttgttgtttaaggcataatatataaactgcccaattcacatgtattttgggacatttgatatcatact

SEQ ID NO: 13126 - DNA, 529 bp, Zea mays
  Clone ID: cC-zmpo14820015e09a1
gtcgaaccccttgtccagagccgccgccgacagctcgtcatcgaactcgacgcgcaccggcgcgccgagcgcccggagcgagacccgggcgtcgggccccgccgccgcgtcgtacgcgaaaaagccggccacgggcgcggccagcgcgtagaggcgcggcgcggcgaacgcggccgccgagccgccggtgaagcgctcgaagacgatggtgaggcagcgcgcgaacggggccggcacgacgcgcggcgggacgacgaaaccggcggcgttgacgccgtcggcccagagcgcgttgctgctcacgcgcagcgcccaggcccggacgcccgcgccggagaggttgcccgggaggggcagcaggtcgacgggctgcgtcgtgtcgttggtggtggtgtcgcggagcagctcggacgcgcgggcgcggaccgcggcctcgacggccgagatgttttcggtgcgaccctgcgccgtgcacggtgccggaaaggaggcggcgagtacgacgtgcacgagcagcgacagaggcagc

SEQ ID NO: 13127 - DNA, 435 bp, Zea mays
  Clone ID: cC-zmpo14820015e09d1
ggcggcttccttccccatttccgttgccgcattctccgccccacagctagctagctgccgacttgaacaatttgtcgggggccaaggcgcctctgctgcctctgtcgctgctcgtgcacgtcgcactcgccgcctactttccggccccctgcacggcgcacggtcgcaccgaaaacatctcggccgtcgaggccgcggtccgcgcccacgcgtacgagctgctccgcgacaccaccaccaacgacacgacgcatcccgtccacctgctgcccctcccgggcaacctctccgccccggacgtccgggcctgggcgctgcgcgtgagcagcaactccctctgggcctactgcgacaacgccgacggtttcgtcgtcccgccgagcgttgtgccggtcccgttcagcgcgctgccttaccatcgtcttatagcgcttc

SEQ ID NO: 13128 - DNA, 437 bp, Zea mays
  Clone ID: cC-zmpo14820015e10a1
aagggaaacatgcagtagaatcagctcagttcgagataaatcggtcactgggagcatctttttcttttaaaacaaaacatgctcaatccgggtacagagaaatatgagcacatcagtggcttcaaaaaagagtctgcctccacccgtgcctcctcagttgccatgttcgacatggtgcttggatcaccatccacgagagctaaggtacacaacaagtcgcccaagagtctcgtccaccgccttgttccatacatgagccagttcagttgaacttctacgaccggcaatttcaccaggctggtagaagtaggacgacccatcggcttcagcgattgagcagtacatggcgcggcgctggtggaggacgaaacctcccatggagacggagcccagggcgaacccgaggaggcgctcctgcgcgaggatgctgatcatgg

SEQ ID NO: 13129 - DNA, 259 bp, Zea mays
  Clone ID: cC-zmpo14820015e11a1
aaagaaaatagaccggaacaatatatttcacccaaaagaatcttaaataaacagggtattcaattcatgtaataaaatcaatccaacacaacaaggcacatgaagagatggtgttgtgccccaaaataaacataggaaaaaaattaaatattggctcgttgacacgtggactggaaatattattcgtcatcactcatcacaggctcatcaaatgctgagagtggtcttgtaggtggtgccggccttgaaatcggcgggg

SEQ ID NO: 13130 - DNA, 384 bp, Zea mays
  Clone ID: cC-zmpo14820015e12a1
aaacccccgaatttggggggtttttaaagaaaaaattttatcccctcaaattcagggggttaccccgccaaacataatatagctggcggggggctggcattttactggggggcgttcccaatggattgcatgtaatgggcaatgccggggcaagaaaaaaatttttactagggaggggggtccgccgacggggggtttaaaaacatgcaagctccttggggcaacccttggggctgcccttggggttcgggcatataaccatggtcttgttgttggggccgtttttctccacgttgacgtcatccatggggacccccgtgcatgggaccttggcagggcaaaacaggctaacggcccccggggtggaggaggggcccgtgattt

SEQ ID NO: 13131 - DNA, 353 bp, Zea mays
  Clone ID: cC-zmpo14820015f01a1
aagcaacacatattttttgggtgggttggtgccccaaaataaccatataaaaaatattgttttggtaacatgaacaccaggtgagctcttttgaaatataattcatcatcagaggctgattaaatgctgaatggggtcttatagggggggccggccttgaaattaacggggatgacgtagtcagaaatgcggtacccaccggacttgacagcaaaacggatgcaaagggggtacttgagcggggccttggtgtacagcgttcaggtggcggtcgggcccttcttgagcgtaaaggagaaattatcccccccgtgctttttgatctccacgtcggatatggttgcaacaatggg

SEQ ID NO: 13132 - DNA, 448 bp, Zea mays
  Clone ID: cC-zmpo14820015f01d1
caccttacagggtggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcatccccgctgatttcaaggccggcaccacctataaaaccacactcagcatctaatcagcctctgatgatgaattatatttcaaaagagctcacctggtgctcatgttagcaagacaatactttttctatggttattttgaggcaccaaaccacccaagacatatttgatgctcacaaaaagaagctcatcaatatttccataaatctttcaacttttat

SEQ ID NO: 13133 - DNA, 328 bp, Zea mays
  Clone ID: cC-zmpo14820015f02a1
ttttttttttttttttttttttttttttttttttttttttttttttcaatattttttttttttttttaaaccaacacaaggggtttgcaaaagtgccaaatgtcatgcccaaaccaaacggggctccccccctgcgggttttacatattccaatttaccgaggggggaaaaaagggggaccaaattgaacgggggggtgaaacaacgcgttcacacccaatttgaaggccttcgttttttttttaaccggactccacccggttacccgccctggcttcctcccataaatccccccgaccctcttttaattttacttgggggggccagg

SEQ ID NO: 13134 - DNA, 173 bp, Zea mays
  Clone ID: cC-zmpo14820015f03a1
aaataaatagggtttttttttatttaagggggaatccaaaaataagggcgagcatggatcgcactctggatccgggggaccccacttcagatacataaagaaccgtgtgttgtttaacggtaaaaaaaagcacccacagtgtgctttcacgttgaacagcgcccctggatagg

SEQ ID NO: 13135 - DNA, 342 bp, Zea mays
  Clone ID: cC-zmpo14820015f03d1
atccactgcaaggccgtgtgtgactaggtcactggcccactccacatgagcatggaggactgcatgaataggtgcaaggacatccctgctaatcaagggcctagggacccttacaaggataacaaacttgacatcccatgaactagttaatgctcctatatcatctgcctatccatgcatgcatcgcattgcatatgcacactgtgcttgcctgcccacaaagttcgacaacacaccgatctttatggacttttaatcgtgtccactcgatcgagagatcgatcgatgcttcgtattatacttttgattccacattatatataagacattcaactttaatta

SEQ ID NO: 13136 - DNA, 403 bp, Zea mays
  Clone ID: cC-zmpo14820015f04a1
aattgggatttcttatatataatggggaatacaaatataataacaagcatcgatcgatctctcgatcgaggggacccgattacaaatccatcgagatcggggtgttgcccaactttgggggcaggcccgcccagggtgcatacccaatgcaatgcatgcctggataggcagatgatataggagccttaactcgttcatgggatgtcaagtttgttatccttggaagggtccctatgcccctgcttaacaacgatctccttgcaccttttcatgcagacctccatgctcatgtggagggggcccgggacctcttaacacccgggcttgcagaccatggcggtcgcccgaggggcggcctccatcaccagcgtgatgagaaacatctccgcgacgatgaggaccg

SEQ ID NO: 13137 - DNA, 406 bp, Zea mays
  Clone ID: cC-zmpo14820015f04d1
caccccgatgcttctcatcaggctcgtgcgagaggtttcccgtggcggcgagcggccatggactgcaaggccgggtgtgaccacgtcactggcccactccacatgagcatggaggactgcatgaagaggtgcaaggacatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctccacggatttgtaatcgtgttcactcgatcgagagatcgatcgatgcttgatattatatttgcattccacattatatattacaaattcaaattaaattaaatttaat

SEQ ID NO: 13138 - DNA, 479 bp, Zea mays
  Clone ID: cC-zmpo14820015f05a1
aattacttaaactaacattacccaaactgacattatgacaatgttagccgatgatgacgacaatggaaacagggatctaggtacaagcaggcgcctctgctggctggcaagtgtgaccacacacaaacacaccataccagaggcagaaccacccgccagtggcgccaacgaggagcgctatccgttatagcacgacaaaagtaaaaataaaacatcacgatgtggagtgaaactgaataattctaggacatggatataggctccttttttgtgatcgccacggggccttgtgtagccgctccattgttggatgaagcacggtccattgtctcgaggagctgcatcactcgtcatcatcttcatcctcctcactaccctcttaatcatcctcgtcattgacctccgacttggacttgtgagactcctcttcatcttcctgctcttcctacttggcaggagccttcttagctgcagtgctc

SEQ ID NO: 13139 - DNA, 281 bp, Zea mays
  Clone ID: cC-zmpo14820015f06a1
cggccccctcccgctagaaatgaaaacaatttcggtttttttcggtttttcgaaaaccgtttttgattttttcgactgaaaccagcagtaccggtttttttcggagccggcatcggttatcggaattttgtttcaaaatcggtatcgaaaacaatataagatttttccgaccgttttaatcggttcccgttttcaaacgaaatttaccgaatttaggtatcggaatttttccaaaaacaaaaaattaagtgggctttttaaaagcccacactcaataatgg

SEQ ID NO: 13140 - DNA, 329 bp, Zea mays
  Clone ID: cC-zmpo14820015f06d1
attattgattgttggcttttaaattttttacttatcctttaccccttggaaaaattccggtacctattgtacggttaattgggtttgaaaacgggaaccgattaaaacggtcggaaaaatcttatattgttttcgataccgattatgaaacaaaattccgataaccgatgccggctccgaaaaataccggtactgctggtttcagtcgaaaaaatcaaaaacggttttcgaaaaaccgaaaaaaaccgaaattgttttcatttctagcgggagggggccgaaaaaattcataagactaaaaaaaaaaaaactaaaaaaaaacataaaaa

SEQ ID NO: 13141 - DNA, 373 bp, Zea mays
  Clone ID: cC-zmpo14820015f07a1
aggaaaaaccaaccaacaaactaaaccatggggcgtacatgttagggccccgttatattgacaacgcagcctggcgaaaatatattatcttccttaaaaggcaggggatcccgccccattggtggtgggggagcaaccccgggatgaatggcacccccagctgggggagccacagctggccctggatgaaactttcgacggggttcttttgcaacccgggctggtaggggatgtttttgatacccctccactttacccgttcgctcatgttggggccgggccccgggttttccaccttggcgtaataacaggggctgaggcccaagttgcccaaccacgggagccaaccctgggggttgatgaacccgcccat

SEQ ID NO: 13142 - DNA, 287 bp, Zea mays
  Clone ID: cC-zmpo14820015f08a1
agcaaaaaccaaccaacaaactaaaccatgggacgtacatgttagggccccgttatattgacaacgcagcctggcgaacatatattatcttccttaaaaggcaggggatcccgccccattggtggtgggggagcaaccccgggatgaatggcacccccagctgggggagccagggctggccctggatgaaactctcgacggggtactttttcaacgcgtgctggtaggggatgttcttgatacccctccactttacccgttcgcttatgttggcgccgggcccgggg

SEQ ID NO: 13143 - DNA, 410 bp, Zea mays
  Clone ID: cC-zmpo14820015f08d1
gcgtccgatcggcggcttcattgacccattgggctagctgccgtggcttacccacttcggcctcagcggctgcttggacgccttggtggggaaccacgggcccgaccccaacatgagcgaacgcgtaaagtggaggggtatcaagaacatcacctaccagcacgcgctgcagaagtacaccgtcgagagcttcatccagggccagcactggctcccacagctcggcgtgccattcatcccggggctgctgccgcagcagcaatcgggcaggatacactgacatctaaggaagataatatatgaccggcaggctgcgttgcctatatgacgcgggactaacatgtacgtaccatcgtttacttagttggttggtttatgcttatgaaaagaaaacacggcacatactctat

SEQ ID NO: 13144 - DNA, 344 bp, Zea mays
  Clone ID: cC-zmpo14820015f09a1
cgacaggcgtcacagcgttgcatctgatgtaacgctcagttcagttttgcagagttacccttttacacataaacaacacgcgtacccaatcatattctactaaacatacaaaatgaggacgccatttttttggatgtacagcaatggcgtaaaccaggggatctctgagttccacccaggggatgatggttttgaccgcggctgtttttctgcccggatcttacatatgaggcccggattttgggtagggaaacgagccgctcccgatcctttcttaatggaaaatgcgtaaccaggttgaccgaggggttattggaggagctaaacggattcgccatgtccat

SEQ ID NO: 13145 - DNA, 496 bp, Zea mays
  Clone ID: cC-zmpo14820015f10a1
ggctcaagaacacaagaacgataattttttagatcttgataccatgagtcgatacagttaactaacaacatgataacacattgaaaatcaaacagaaagaaaaagagggagagcaaggatgtatccatggatgagtggatgaccacacattatcatggttttaaagacattgctctcatttttcttccatgtcttgttccaaatttaaccgggccgacgtgtgtggcctcaattggtggagtcatcatcgtcatcctcattgcctgacaggccttcgacaccctgggggccaggtgcagcagccggcccgctaggtccatcggctggcgcgtcagccacaggggcatcggcggactttgcctcggccatcggtgctacgaccatggcgacgaagaggagagcggcaatgacaaagacgacgctagcgcgagccatgggtacgggtgtctagctttctagggttggttgatagctgcttaggcgagttcaacgcttg

SEQ ID NO: 13146 - DNA, 508 bp, Zea mays
  unsure at all n locations
  Clone ID: cC-zmpo14820015f11a1
ggccggggcgcgtcatacggtcgatgcgcgcggcgttccggtccttcccggccatgcaggctccgacctgccgcggcatgccgtcgctgcaccacctcccgggcctgcagggctccggcgtccggagccacttccacggcgcgatgcatgccacggggactctgtacggccaccgccgggcgcgcatcaccatcgcgctgcacgagagccccggtagcccgccgtgcgtgctgctggatgtcggcgtgcccacggccaagttcatccaggacgtgagcgcggcggggatggtgcgcgtcacgctcgagtgcgagaagcagcaccatacggtggacgtgggggcgcggaggctgctcgatgagccggtctggacggccgaggtgaacggcgagagcgtcgggcacgcgtcgcggctggaggcgacagagcgggacgactgcgtgatgcggatgctccactccacgtncatgggcgccngcgtgctgccgtccgatcggacgcgtgggtc

SEQ ID NO: 13147 - DNA, 386 bp, Zea mays
  Clone ID: cC-zmpo14820015f12a1
ggttctcgtagccatgagacccatcaaatcaaattaatgaagcacccatcaacaattagcaagaccgatgaactagcaaggcttcttgcagaagcacttgcgcatggccacgtcccgcttgcactcgccaccgggaaagctctccttcatgcacacctcggcgcatctgtcgctgttgaagcaaaagccctcgaactggagactcggcgataagcattgactctcttccttctccgtgcttttctcctccttcttctccgtctcctgctgtttcgctttctccattatcaaggcatgcatgggcatggctactcccattttggcatcgatggttcccacctctgctgcgacgaggaggagaaacaagaacaggaacggctgaacct

SEQ ID NO: 13148 - DNA, 364 bp, Zea mays
  Clone ID: cC-zmpo14820015g02a1
gcgcccatgaatgatgacaatctcaggtcaacaataatgagcctaatgatcagctgtattttgtttcaacagaaagatttctttatactcacccattgtaaaaacacatggaccaataaaggactttggggatggggcggggtatataacgggagaaatgccttgccgcagcatccatttgactttattatgtactactcagatccgtgtatacgcccaccctgggaagctgggaacatattgaattccagcaattgcgagcttaggaccaaaaggtatatccgggattaacccgctgaacaaaagtcggcggtgacttctgattctgcatttcaggaagatgggttttcatgatataacgagt

SEQ ID NO: 13149 - DNA, 555 bp, Zea mays
  unsure at all n locations
  Clone ID: cC-zmpo14820015g02d1
gggaagaccacgcgtccgtatagattgtttttatcgnattaatgttgctcacctcgcacacggcttagctgctcttgggcatcaatggcatgctcttggggttatagaatctccaaaactaggtttagaagctcccttggcccatcatttgatgcacttttatgagatgatgggtgacacacttgctgtacagtatagcggttctgctgctcataacaaggtattctctgcaaagagaggtcacttgaagctttttattcagtcacaagagttctttaggacacttcagcggcactacagcaacacctgtatagatgctaacaaacaggctgctataaacttgtttttgggatacttccagccacagcaggaaaaacctgcactgtgggagttagaatcatctgctgggaagcataacaataatctttttgatggccacccaagtacattgaaaagagtaaaatcagatggcaccattcttcatgaaagtaatgcttctatatctggctctggtcgttgccataatgaacagttaagtgcatcgcaacctgatgt

SEQ ID NO: 13150 - DNA, 442 bp, Zea mays
  Clone ID: cC-zmpo14820015g03a1
atggatctgatccttattacctacgtgctgccgctggagttctgcgggttgttgaactccgagcacgtgttcctgatctcgccgtccttgcccgtgagaaccttgagggcgctgagcttctccatggccttggcgaagatggggacgaagtcggtagtcttgcccgacatggccttcactatgggctcggtcgtattgtccatccccagcacgcgggcgatggtgaggggcatattcttctccagcaccaggccgaagtacctcccgtacatgtcgttgggcgaggtggagtccatggggacggaaccccagtccttgccgtcgcaggcgtcgctgatcttcttgttgaacgccttgtccatgggcgcggcgtcggactcgatgaagaagcacctgcagacgccgatgctgtggccgacgcccaacatcgcgatcatctcct

SEQ ID NO: 13151 - DNA, 420 bp, Zea mays
  unsure at all n locations
  Clone ID: cC-zmpo14820015g03d1
gcgtccaaaaaaaaaaatataaaaaaaataaaatttaccaaacttaaaaaaccaaaaaaaaaaaaaaaagaaaaaaagaaaaaataaaagggggnacccgccccncccccccccncccacacccccccacancccaccaaaaaanccaccaaaacgacaacaaaaaacccaccccccccccccccaacaccaccgaaaaccacgccaaacccccccccaacccccaacaaaacccccccccacccccccccccaggcaccacaggaaaaaacaacacaaaagcccccccccacccccaccccaaacacaaacccacaaaaaaaccacccccagccccccccccgaaaaccccccaaaaaccccgggaaacaccggcacaccccccaacaaaaccancccccgagcacccccccaaacccc

SEQ ID NO: 13152 - DNA, 439 bp, Zea mays
  Clone ID: cC-zmpo14820015g04a1
aaacatgtaacccccgcttttctctcattatgaatgtaatcctcttacagagtgggtatatactccaagataatcagcaaatgaagaagtgaaataaacataacacaggcaaggcagctgagctacctgcttcttttgttacatacagcgaagtgcatgcatggtctggtcctttaattttgtagagatagagaagagagaacgaattaattgacgcgatgcacgacagtagaggaggaattgccattattattattatagacctctccgcctttgctgttgtggagatgatgggtgttgcacttgtccttcctgaacctcatcttaccctttccgtggtcgatctcccagatgtactcctgcatgagcacgttgcccaagatcccgggccctccccgcggcagcttcctaaaggccaggcacgccaccccgggcacta

SEQ ID NO: 13153 - DNA, 524 bp, Zea mays
  Clone ID: cC-zmpo14820015g05a1
cagaaactatagtcttttatatatacagacactcacgtattgaatcagttacatacatgcaaaagattcagaagaactgcggacttgatcgacagctctcggagggggagcaaaaaaaaaattgcgagaggaatgcaagacgcgcaggcatactctccttgcaacctaaacgaagcctctaatcgacgtctccttcctgtgtctcggtcgcagcctgtcgtcgtcactccgtttgtgctttgcccctgtacggcttgaggatctggaacgagcagagcaggctggcgtcgacgttcatcagcgcgccggcgttgttgaactcgccgcagtagttgggcgccgagaatatggtcaccagctgccggtcggcgaagaactcgtagccgtcctccacgacctggtgggcgcggcagacaaggtcgaggtcgtgcttgtttaagaactcggtgaccttgtcggcgccgaaggtgaaggagacgccgcggtcgttgtcgccccatccggagctgtcgcggtccgggtcg

SEQ ID NO: 13154 - DNA, 519 bp, Zea mays
  Clone ID: cC-zmpo14820015g06a1
aaaataaaattgggatcataataatattagcatcgagtcacgattacagaacaaacccttcgacaattcacacgaccacgaaacgaacgaacaaacaaacaattaaccaatcgcaaaccacgtaaataaaaaaaacaattaattaatcggatgaaccaaacacgatgcatcccaacgttgccgccccgcgcgtcgtcgctcagtggaggtagtaggcgaggaaggaggcgacgagcgccccggcggcgggcacggcggcggcggcggcgccgcttgcgctagggccagccgcaccaccggccgtgccggcgggcgcctcggagggcgcctcggaggcgaccgaggccagcacggcggtggccgaggcggcggcgacgagggcggcgcataggaccttcttcatctccatggctggcgggtggatcacttcgtcgctcctggatatagtggtccaaggaacctggcgttcgaggagatgttattagttattgggtggaattgggagactgctcgctcgac

SEQ ID NO: 13155 - DNA, 415 bp, Zea mays
  Clone ID: cC-zmpo14820015g07a1
gggggggaaaaacaaattgggaaaccggccccaacaaaagggaccccaggggcccgggggccaccccccccccgggggaaaaaacaaaaaacgggggccccaaaaaaaagggggccacaagggaccccattggttaaatgaaaaacagggtaaaagggggggggaaaaaaccccccccaggggagcccaggggggccccattccccccccgggcccaaaaaaaaccccccccccccttggaaatggcggggagcaaaaaaacaaggcaagccacccaattttttccccccaccgtgggtttttccccccggggccggctccttttgcggggggttaatgaatgtttccccccaaaaagggggcccccggggccccccctaaggggggggccaccccgggggaacccttgggggga

SEQ ID NO: 13156 - DNA, 485 bp, Zea mays
  Clone ID: cC-zmpo14820015g07d1
tcccatcccgccgccccgccgggtctacgtggcgctaataagcgcggcgcatccggggatggagatgaagaacatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgctttttttccttcctctttctacttgattttcatttaacgaattggtatcgctgatgcaccagtttaatttggtgcccctgtatttgttctttccttcga

SEQ ID NO: 13157 - DNA, 455 bp, Zea mays
  Clone ID: cC-zmpo14820015g08a1
agaaaaaatataatgtcattcagataattttctcatgttattatcgttacatagtcaagaagaaacatagtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcagaatcgtcgccggacgatggtgctggggcgctggaggtgccatcagaagatgggcctggtgcggcggaggactcatacgacgacgatggcgctggtgcgctagagggaccggatgaggccgccgccgccggagcatcagcagccgacgcgctggcaccagcaccggacgccggcgcgtcgtcaccagacgggccgctggcgctcgcaaggccctcggaggcgccggcggtggcatcggcggag

SEQ ID NO: 13158 - DNA, 457 bp, Zea mays
  unsure at all n locations
  Clone ID: cC-zmpo14820015g08d1
accggcgaacgcacatcgcatgacgtcccatttcgccatgntgcccgctcctcgcgggggccctggtcctcttcctgctgggcccgcggcaggccggaccggggcgacaccggcaggacgcggcacagaccattcccaagatctgcgggacagcctcgccgccaagccggagagccagaagcgacccgcgcaagctggcggagctgtcgtgaacatcgcggcgaaaggggtcgggatggccaccttcgngcaccgaagtacagcgacaaggaggacagcgacatgtcaggtgctanacagctgtccganacgtggagaggccgtcgcccacctcacggcctcgtccggagcccacganccaagttcctcgagctaagtcgtggctctcctccacgctcggggacctccactgcgagaccctgcaagacctgcccaagccagcgacaggacgacgtcg

SEQ ID NO: 13159 - DNA, 448 bp, Zea mays
  Clone ID: cC-zmpo14820015g09a1
gaagaaagaatgtatcgatcagtgctagttgttacacgtacatacattatacatatatatatacttatacacgtactgatcaccaaccactcttttcaatttgtgttctagaattcgaattttcaacgtgcaatacatgcatcgatgtgacgacatgcacgagacgagtgatccactacgacgatacgactgttgagttgagccagtcagattgccatgccacatacagtgcaatcgatcgatcacctccccttcatgtcggcgagctgctggaagagctccccggcggcggcggtggacgcgtcgggcacggcaccgccagcggggacgatggcgccgccctccgccgtggcaccgtcgctgttgccgtcgctgtcgccgccctcgggcgggttggcgtcctgcagctgcagcgcatactcgaggttccacagcacgtcgcccatgg

SEQ ID NO: 13160 - DNA, 571 bp, Zea mays
  Clone ID: cC-zmpo14820015g09d1
cgggaagacccacgcgtccgatctacggcatcgtggggaatttgccgtttccgtggtagcagacgctggagatctgcatgggggcggggggggggctgcactacctgcacacgggcacggcgcaggggatcatccaccgcgacgtgaagaccaccaacatcctgctggacgacaacttcgtggccaaggtgtcggacttcgggctgtccaaggacgggcccgggatgaaccagctgcacgtgagcaccgccgtgaagggcagcttcgggtacctggacccggagtacttccggtgccagcagctgacggacaagtcggacgtgtactccttcggcgtggtgctgctggaggcgctgtgcgcgcggcccccaatcgacccgcagctgccccgcgagcaggtcagcctggcggagtggggcatgcagtggaagcgcaagggcctcatcgagaagatcatggaccccacgctcgccggcaccgtcaacccggagtcgctcgccaagttcgccgagaccgccgagaagtgcctcgccgagttcggcagtgaccgcatctccatgggcgacgtgct

SEQ ID NO: 13161 - DNA, 472 bp, Zea mays
  Clone ID: cC-zmpo14820015g10a1
ggataagatactgatattcatttaaattttatccgacctcacacaatattatccgtatttcaattgaatttgaagagaaaatatgaaaaagaaatatggaacgagcaatgtccatctatatccggttacattcctgtgggtgactcattgccgtcacctggggttgagattgattgttgagcacatccccattgttttcataccttccgaagcaggattccttctaatcatttacccgtagatggcattcttgcctgaaccaagagatccagcgagcgtcgctggcttcttgttgcctcgggtctcttccttctgcatgccggaggtgcgggcactgccctccgtagagcctcctgcaggttccaggttcgtatcggcgctggctgggatcgtcgaaaccacgagagcaaccacgaggactgctgcgacgatggtcttacattgggccattttactgttttctggcttggac

SEQ ID NO: 13162 - DNA, 422 bp, Zea mays
  Clone ID: cC-zmpo14820015g11a1
atcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcatcaggtcacctggttgttgcagcagcaggagcaggaccaggagggaagttcacccactgcagctgcagctgtatctccccgctctcgacgttcctgagccggaggatcatgtcctgcgcgaacttgccgttcctccagcacacgtggctctcgtcggcgaggcagttcctggcgctcggccgctcggacctgatgatggcgccgttcctcagactctcctcccgcgggttcatggctcaccgcctca

SEQ ID NO: 13163 - DNA, 373 bp, Zea mays
  Clone ID: cC-zmpo14820015g12a1
ggcaaaaaaaattttttcccgctttttttattacaacagtttagttctcaccggtaaatcccgggttatgggtatatatagggggaaataattaagccctccccccacctaataagtccggggggggggatttgtccgtatatggccacttaggggtcccatggtttgaactttccattgacaaaatcgtaatggcccccccccagcttgggggtccctttttccagccctttcttgacaaacgggtaggacttgaggttttcaagggacacgttgacggcctccttctccaggagggagcattggtcttccaaaggggcccaggcgtggtcggccagcaccttggactttggcggggcgccgaccctgaccc

SEQ ID NO: 13164 - DNA, 93 bp, Zea mays
  Clone ID: cC-zmpo14820015h01a1
cttcaaacgtcatttttttttcttcatatatttctgcaacatgtttacatgtacagtctgtgatagaaggcactgctcccccccagtcccttt

SEQ ID NO: 13165 - DNA, 189 bp, Zea mays
  Clone ID: cC-zmpo14820015h02a1
aataatattgtttatgttgatgacacctttatttgtggcgcctgcttcagggggaaaagggcgcagggctttttattattaccccttgaacaagggaaaaaaaacacattggggggacgttacctttggggatccagacgcggggtttttgcaaaaaaacaatgaccgttaaaaaggggcgatccaagg

SEQ ID NO: 13166 - DNA, 443 bp, Zea mays
  unsure at all n locations
  Clone ID: cC-zmpo14820015h02d1
aacctgctggtatctcctttattatanccacccttttcaacaacagccagctcgcgaagataatgtgaagccttttcagggcatcatcggccgcactcttggtgctagccctcgcgctagtggcggccaccgccccacaggtagcggaggcaaagaagaagagagcggcggagagcggcgaggcggcggaggcgaagaacatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaagtcaccaaggcctgcagcgtcacc

SEQ ID NO: 13167 - DNA, 359 bp, Zea mays
  Clone ID: cC-zmpo14820015h03a1
cgtccttttttttttttttttaaacatgttaccccctttttttctctattatgaatgtaattcctctacttttttggttttggacaaaaagattatcagcgcttgaccatgtgcttttatcggggcacaggccagggatttcatctcccagctttttttgtacaaacagaaaactgcatgcatggtctgcaccttacccttccccctattgctaagagagaccgagttctttgtctttttgcaacggcaaaagaagaggaagggccgttgttattattattttacaaatgcgccttttttaataaccatatgattggagggggacaccctcttgctgaacctcttgttaccctttccga

SEQ ID NO: 13168 - DNA, 211 bp, Zea mays
  unsure at all n locations
  Clone ID: cC-zmpo14820015h03d1
gacacgagcacgnccgngacgacgccggagccggaggcgnacacggcggagacaagcgcaanggacaggcaccngncccaccngccgccaagcgcgaccgccagcgcaacaccaacagccaccacagcgccaacagcncccgcgacgccacgagcaaccacaccgacggacccaacccgcccgagacggggccgggcaccanggagacgga

SEQ ID NO: 13169 - DNA, 433 bp, Zea mays
  Clone ID: cC-zmpo14820015h04a1
ggccccaccaggtgccagggggccagatattgataagataagatctgtttacattgggggaagcgtcccgtgcaagcaacttaagatgggtaaccaaattaaaacgaggggggagcttgccatttttctgatttttggctgaattctcctctcccttcccgggcaaggcaagcagcgtcccgtcggttcggccagtggccctcggggacgagccgatggagattcccccgcttgaagatcgacgccgagacgttgcattttctgcgcaacctgctggcgttgtggcgctggaacaaaacaacctggcggaggcgggcagccatggtcgccgtctgcgtcctctcattcatgtccgccacgcctgcgcaccgcgtcgtcgacatctttgccttaatttaccaccgggcggtttcaactttaccggccttgtaca

SEQ ID NO: 13170 - DNA, 446 bp, Zea mays
  Clone ID: cC-zmpo14820015h05a1
cacaaacagcagtcacccttttccattaaattaaggggatggaatatttttaatgaagccccccaaacaatttggcaggaccgagtcggataatatatattcgggggcatgcaataccatgcatgggggtaggcttggccacactttgcgtatctatatataattatggcaagaacagttgtagcctgacccacgatcgaccccttaattagttctcggttttgaccaccttgcttgggtggacccacccttttaaattcaaccggacaacggccccggcgccggcgccggcgccggggcattggattccgtatcagccaatttaatgtccgcgtaaacaacccggccttcggactcggggctgttgccgtcgatggagccgttaacgctgccgaggacgtggatgtcttttttgtggcccgaggccgtggtggcaaagtggcaaa

SEQ ID NO: 13171 - DNA, 551 bp, Zea mays
  unsure at all n locations
  Clone ID: cC-zmpo14820015h05d1
gcgtgcgctcacgcgtttcgtcacgcgtttgagctacccagtgtctttagcagacgcgacgncgtccggcaacaatgtcagctttgccgggctgagcggggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcttgccataattatatatagatacgcaaagtgtggccaagcctacccacatgcatgctattgcatgcctccgaatatatattattcgactcgatcctgccaaattgtttcgtcgacttcattatatatattccatccctttacattaatggagaagtgt

SEQ ID NO: 13172 - DNA, 429 bp, Zea mays
  Clone ID: cC-zmpo14820015h06a1
gaacgaacagcagccacccttctccattaaataaaagggagggaatctctataaagaagccgccgaaacaatttggcaggaccgagtcggataatatatatccgggggcatccaacaacttgcatgggggggggcttggccaccctttgcgcatctaaatataattttggcaagaacaggtgaagcctgacccccaatcgaacccttaataagtttttggtttagaccaccttgtttgattggccgcccccttttcatatcaaccggacgacggccccggggccggtgccggagccggggcatcggattccgtatcagccaacttcatgtccgggaaaacaacccggcctttgaactcggggctgttgccttcaatggagcccactacccttccaaggacgtgtatgtctttcttgagcacggaggcct

SEQ ID NO: 13173 - DNA, 507 bp, Zea mays
  Clone ID: cC-zmpo14820015h07a1
cgtcttttttttttggtgttcattacaacttgtatacaaataattatgcacgcagagcatgcaacccgcaccgccttatgcctgtccagtcaacaaaatgacttgagatcgaaaaagcggatgacacacatcattgcagactcccggatgcacgtcatactgaagctaacgcactagcctggaaccatatgtgcaaacatggcatgtgtaatagcacctttgggcagccaacctatactaaaaaagggagcgtagaacatggtcaagtatggtcaaatgtaaagaataacccatgggggaggagggtgccatggcccgtcaaagggcacggatgacgtacctttatcaggaatttgttgcgaagcttcaatgcgacaccacaagctaggtgggcatctaagggcccatttacatcgttcaataacatgaaggcaccggacagccctatagcctcttgcaacagcatagctctctttttcttaaggacacttcgcaccgtgaaaacag

SEQ ID NO: 13174 - DNA, 508 bp, Zea mays
  Clone ID: cC-zmpo14820015h08a1
ggtgttcatttcaacttgtattcaaataattatgtacgcagagcatgctacccgcaccgccttctgcctgtacagccaacaaaattcttgagtacaaagaacgtgagatacaatacaatacaaactaccggttgcactcatcctgtactcaacccactagcctggtaccatatctgagaacatgtcagtcgtctaccacctttgtcctgtaaatcttcactcaaaagtggtgtgtagaaaatggtcgggtatgttcaaatggtaagaataacccattgggtaggtgtgttccatggcacgtttaaggattcttttcttgtacctttttcaggtatttcttgtgaagtttcaatgctccagcacaagctttcttggcatctaagttcccatttacatcgttcaatatcctgataagatcgtccagacctctagcttcttgtaacagcttttctctcttttccttaaggacacttgcaaccatgaaaacagaaattggaacaggaccgtc

SEQ ID NO: 13175 - DNA, 232 bp, Zea mays
  Clone ID: cC-zmpo14820015h09a1
cacgggcgtttttttttattccattgaaggaccgggaaaaacttggtttatggaactgaaccttttcctggttctttaaaggccacagggggcaaaaaaaaaatccccttcccggattgaaagggtcatcctgtgggaccttccctcaaccttaaattcttacccataaaaagaaaagattccctcttcattgtgggtggagttagtgaatttatttttggagggccttctc

SEQ ID NO: 13176 - DNA, 436 bp, Zea mays
  Clone ID: cC-zmpo14820015h09d1
gcgggcggtggcatccgttctatcttggttgggtttcgcgcgttgatggccagccaaagcttgccatgggagccgtgcggtcttacagggtccaccacgcgaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttcccctgcgtcatg

SEQ ID NO: 13177 - DNA, 415 bp, Zea mays
  Clone ID: cC-zmpo14820015h10a1
gaatcaagcactctgtaacatgattttatggccttttcttccttttctttcagaggatactggtatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcagacggggagcggcacgtccttgaagtaacccagcgggttggcggggcgcaggctgtcggagatgccgacgttcctggtgagcaggacgccggcgcggtccctgagcgcctggacctcgttgcagtccttgcgcgggctggccaccagcaccacctggcagatgtcctcctcgtggctgtccttgagctcgatcgtgtaggtgccggtcgcgtctgtgaccc

SEQ ID NO: 13178 - DNA, 387 bp, Zea mays
  Clone ID: cC-zmpo14820015h11a1
ctggttggggcttccccaataatcaaagcccagggcttccattatatattatatatatatcggccaacttacggggtgtttgctgctgcatgtccctagcccggcgggccggatgaatcgaaggccattcaaagtctaggggaattggacggtggaagtgtcgacggcatcgggcctccagttcggcgggatgatggctttaacgatgacctccttgccggactcgcctttgaggcggatagagaaggggcccttgagcgccttggcagcgtccatgctccagatggcgccccaagagagctttatgggcttccactcagccgacaactagtcctggattttcatcagcacgatgtcgtcatcgtccgccacaacttcaccagcacg

SEQ ID NO: 13179 - DNA, 422 bp, Zea mays
  Clone ID: cC-zmpo14820015h12a1
gaccaaaaaaaatttatattattcattcataagacatcaataaccaatgacaatccgaagtagcctcatcaggcgtctcattagaattgaatggaccttaacatattgtgtccaaaaatcacaagtgagaagcataggtagcgacagttattgcggtcttgatgaataggggaggaaagcggcggccgatagaccggcacaaaactttgttcgcgctaatgaagaaacggcaaccaaaacgggggcaggagaggctggcggcggtaacggctcccccacggcttgcatttctcgggcccaaagaattagaagcatttcctgtggacgatggatgggccggactcgtcgtactcggccttggcgatccacatctgctggaaggtgctgagggatgccaggatggatccttcgatccagacact

SEQ ID NO: 13180 - DNA, 566 bp, Zea mays
  Clone ID: cC-zmpo14820017a01d1
ggagctttacctcaatttggtgcttgagtatgtaccggagactgttcattgtgtcatcaaacattacaacaagatgaaccagcgcatgcctttgatttatgcaaaactgtatatgtatcagatttgtagagccttggcatacattcacaacagcattggagtgtgccacagggacattaagccgcaaaatctcctggttaatcctcatacccatcagctaaaattgtgtgactttggcagcgcgaaagttctggtaaaaggcgaaccaaacatttcttacatctgttctaggtactacagagctccagagctcatatttggtgctactgaatacacaacagccattgatgttcggtctgctggctgtgtgctcgctgagctgcttctatgacagcctctgttccctggagaaagcggtgttgatcaacttgttgaaatcatcaaggttctgggcacacccacacgtgaagaaatttagggcatgaatccaaattataccgagtttaaattcccgcaaatcaaagctcacccatggcataagatattccataaaaggatgcccgctg

SEQ ID NO: 13181 - DNA, 374 bp, Zea mays
  Clone ID: cC-zmpo14820017a02a1
gagataaatgtcataatatcataaaaggatttattacaaagcttaagtcttgcaaaataaaagataaatataaagcgaactaaagtccatccttggcgccacaaagtcgactaggagacgccacctagatcaagtcgaactcctcgttgggggggtggtcctgggctacctggtcttctccttcaatgagctcctgctcagcaacttctacatgctgaacaccgtgatcctcaaccacaggctcggtcaattgggtgcccaaataggccgaccacgtcggaccgcgaagcaggcgcgcagggtgcttcggcgaagaacctccggaaattcgaggacgcgtgcgaccagctgcttgcacgcggatgacccttggc

SEQ ID NO: 13182 - DNA, 374 bp, Zea mays
  Clone ID: cC-zmpo14820017a02d1
gccaagggtcatccgcgtgcaagcagctggtcgcacgcgtcctcgaatttccggaggttcttcgccgaagcaccctgcgcgcctgcttcgcggtccgacgtggtcggcctatttgggcacccaattgaccgagcctgtggttgaggatcacggtgttcagcatgtagaagttgctgagcaggagctcattgaaggagaagaacaggtagcccaggaggagccgcacaacgaggagttcgacttgatctaggtggcgtctcctagtcgactttgtggcgccaaggatggactttagttcgctttatatttatcttttattttgcaagacttaagctttgtaataaatacttttatgatattatgacatttatctc

SEQ ID NO: 13183 - DNA, 197 bp, Zea mays
  Clone ID: cC-zmpo14820017a04a1
gcggggccttactcaaatacatatctgtcatccaatttaagacgatcagaggcctagtgccaatccatacagcgactactggtagacggtaattcttcgacatgccatgacatatggctcgcacctattcatgtgctattaccgaccgacgtcccatcaacgagtacaactgcttgagcagcgaggcacagacgggc

SEQ ID NO: 13184 - DNA, 77 bp, Zea mays
  Clone ID: cC-zmpo14820017a04d1
aaaaaaaaaataaaaaaaaaataaaaaaaaaaaaacaaaaacaaatttaaattaaaaaaaaaacaccatccctcctg

SEQ ID NO: 13185 - DNA, 574 bp, Zea mays
  Clone ID: cC-zmpo14820017a05a1
gtcgttgtacttatagcgcgcgcagcgtcacatcttgggcatgggcatagccataggcatggcgccgccaacgtcggggccgctgttgtacgcgtcgcaacgccgcctgacctcgccgtcggcgccggtcttgacgccgaacaagctgagcttctccatggcgcggccgaagtcggtgaagaaggcagtggggttggacgcgtagagctgcaccaggggcttggtgcgggggtccgtccacagctcctcgtcggtgctgagcagtccgaggccgcgctccaggttgacgaagtacatgttgtcgaacttgccgggagtcatgatgtcgttgaacgcggcgatggtggggtccttgaggtagtccttgcacacgttctgcagccccctggcgtatgacgggttcatgctggggtcgaacggctccggcttcccgccctggctgcggaagttgtagaggcggtcggcgaactccttgcagtgggagaagcccaacgtgtgggcgccggacagcggcaccagcttctgcaccgtgaaccccttggcgccgaacatctggatgaggcggttcacggtg

SEQ ID NO: 13186 - DNA, 548 bp, Zea mays
  Clone ID: cC-zmpo14820017a05d1
atcagccaagagctatccatacgcacagcgatgcaccagcacgagatactagccatcatgcgcctgtcgtccctgctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgccccggggtggtgtcctgcgccgacatccttgcgctggcgtcggaggtgctggtcaccatgaccggcgggccccggtacccgatttcggtgtggcgcaaggactcgctggcgtcgtcgccacagcgcccgac

SEQ ID NO: 13187 - DNA, 411 bp, Zea mays
  Clone ID: cC-zmpo14820017a06a1
aaaaggaaattgtttttttcccgggacaaactccgggtatgggcggaacctgaaacgggccaaaacatttttggcccccccctcctgttttcccttccgggtggggcacaataaaatcttttttaccccggggctgcactggcctggcctgacctgcccaaaaaactgctcgctggctttaaactgggcttcctcgtttttcaccccaggggaacccccacctgaacccgagctcccttccaagtcccaacccccgtttgtccaggcggtctttggctttggtaggggcccgtcccggtccggggggtcatgttcccaagccgaagggggccctgtgccccaaatacccggggggcttctcaaacccgtggaccttccatttcgggggccccctgcaagaaccgggggctt

SEQ ID NO: 13188 - DNA, 623 bp, Zea mays
  Clone ID: cC-zmpo14820017a06d1
cgtgaaggtggccggcatccactggcactacggcagccggtcccacgccccggagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcgcgccgccgaggaccggatggtggccttcacgtacctgcgcatggggcccgacctcttccacccggacaactggcggcgcttcgccgccttcgtgcgccgcatgaacggcgccgggtcgtgccgggaggccgcggagcgggaggcgcacggcgtcgcgcaggcccaccggtcgctggggcacgaggccgccgtcgcgctgcggagctgaccggccgtgccggacgggaccgacggaacctacgatcgctgacatacagggttggacttggagggaagccgggtcttgtgggttttctttg

SEQ ID NO: 13189 - DNA, 515 bp, Zea mays
  Clone ID: cC-zmpo14820017a07a1
gaagaatggtcacaagtaaaatgaacctggaatgagatagtacatatataataattcacttaggaaataaatagaaatatttgagaattgtatcgtacggaagagatcgagcatagtccacggatgatgaatctcttatggactacggttagcagtgggcggggggtctgaaataaatgatgtaataataacgatgcatgcaatgtgaattgagtatatagcgtggatgtgttgttgcttggtcgttgatggacgatgacggtcagttggtccggctcctgacgatgtcgaggctcatctcgctggggtcggtggcctggatctcgcactggatgccgtccagctccctcctgaacctgtccttggagctggcgtacagcatcttgctcctggtgcgtgcagtgtcaggggaccaggagaagaagaagatcttgctcttctggcagttctcgatggtggtgaagtcgaagtcgtagatcgcgtagcggcactcgttggcggtgaggctgtcggtg

SEQ ID NO: 13190 - DNA, 565 bp, Zea mays
  Clone ID: cC-zmpo14820017a07d1
acgagctcagaaggaaggcagaggcaaaagcagccatggcgaactcgtcgtccggccttgcggtgaacgacgagtgcaaggtgaagttccgggagctgaagtcgcggcggagcttccggttcatcgtgttcaggatcgacgacacggacatggagatcaaggtggaccgcctcggcggaccgaaccagggctacggcgacttcaccgacagcctccccgccaacgagtgccgctacgcgatctacgacctcgacttcaccaccatcgagaactgccagaagagcaagatcttcttcttctcctggtcccctgacactgcacgcaccaggagcaagatgctgtacgccagctccaaggacaggttcaggagggagctggacggcatccagtgcgagatccaggccaccgaccccagcgagatgagcctcgacatcgtcaggagccggaccaactgaccgtcttcgtccatcaacgaccaagcaacaacacattcacactatatactcaattcacattgcatgcatcgttattattacattatttatttcaggaccccccgcccact

SEQ ID NO: 13191 - DNA, 475 bp, Zea mays
  Clone ID: cC-zmpo14820017a08a1
aaaaggaagactgaatcatagaggtcattacacttacaaattgcaggaattacaaaacgatgagtcgatcctcgatcgatgtatgagatgacatcaacgcgacaaacagataatagtagtatagtagaagaatagaaaggaaaaaaattcgacggggtcgagaaattagaggaggaagattgatcgaatcatatgtgggttgctgacggagcagcgattatatcgagctgaagcgatgaatgcgctgggcgatcaagccggcgcggcgccggcggcaccggcgccctggtccgtggagccgtacgcctggttgcacatcttggtgcaagcggggtctcttttgccgttggcgcagcgctcgtagcagtcgtcgtagcagccgtacgcggtggccacgggcgccgtcgtcgtcaccaccagcagggccaccaaagccagcggcacaattctcatgctctgcgccattattgctggg

SEQ ID NO: 13192 - DNA, 574 bp, Zea mays
  Clone ID: cC-zmpo14820017a08d1
caaggctccccaaagatagcatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatgattcgatcaatcttcctcctctaatttctcgaccccgtcgaaattttttcctttctattcttctactatactactattatctgtttgtcgcgttgatgtcatctcatacatcgatcgaggatcgactcatcgttttggaatttctgcaatttgtaagtggtatgacccttatgattcagtctttctttt

SEQ ID NO: 13193 - DNA, 465 bp, Zea mays
  Clone ID: cC-zmpo14820017a09a1
gagataaagttatatatataactcccattacaatgatttttttgagaaccccagtacagtgatttgagagggcatgcatctcaagattacatatatccattcatttgttccccttcactacgcttctttcgtatttgttcttttgagtttggattggatggtcagaccacgaggagaaaacgaggccttcgtcgtcttaacgcgcgggggcgtaggacggcggcagcggcagccccacgaccttgccgcagcggagggcgttgtcgggcatgttgtactcgtcgcgcagtgatcgcgccggcgagacgacgctgatgtagaactgctccccgaggtagtaccggtcccagatgttggaatgcacgctccacatgcccgcgttgtcgaacgtcagcatgattgccgtccatgaccgcggggtcacctggatcgtgtgccggctcaccgtgtccagcaggttgtacg

SEQ ID NO: 13194 - DNA, 601 bp, Zea mays
  Clone ID: cC-zmpo14820017a09d1
gggttgaccctcgcgtccgaccttcatcgagatcgtcttcgagaaccccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctccgctgcggcaaggtcgtggggctgacgctgccgtcgtcctacgcccccgcgcgctaagacgacgaaggcctcgttttctcctcgtggtctgaccatccaattcaaacttaaaagaacaaattactaaagaagcgtattgaaaggggaacaaatgaatggatatatgttatcttgagatgcatgccctctcaaacactgtactggggtctcacaaaatcattgaatgggagtatatatttaacttatctc

SEQ ID NO: 13195 - DNA, 73 bp, Zea mays
  Clone ID: cC-zmpo14820017a10a1
tttttatcattttttttatttttcttctattttatatccttgggttggtcttttttttctatttccttttatc

SEQ ID NO: 13196 - DNA, 494 bp, Zea mays
  Clone ID: cC-zmpo14820017a10d1
ggaacttatatgctaagaaagcttgcgctggagcattgaaacttcacaaaaaatacctgaaaaaggtacaagcaaagaaaccttaaacgtgccatggaacacacgtccccaatggggctatcgttaccatttcaacatacacgaccattttctacacacaactttgagtgaagatttatcggacacaggtggtaatcgtctgacatgtcctgagatacacggagactgatggtgccaggctagtgggttgagtacaggatgagcgcaaccggtagtgtgtatatcacgttctttgtactcaagaattttgtacagacagaaggcggtgcggatagcatgccttgcatacataataatttcaatacaggttgaaaacttgaaatcaacacaccttgcgacagaattcagcttcaagaaagttcttctgcacatattgtaaagctgtaaaagtgtacgatctaatgttttcattaatgtacacataccaggagaac

SEQ ID NO: 13197 - DNA, 411 bp, Zea mays
  Clone ID: cC-zmpo14820017a11a1
atcagccaaactttttttttttttggttgggtttttttttttttttttttttttttttttttttttttttttttttttttttttttgggaacctcccacaggtgccttgtttaacccccaaaaaaatcccccattgccccaagaccaaaccccccaaatgtttttatttcacgggggccggggccccggggcaaaatttggggggaaaaaaaaatggaaaaggggaccccggcctaaacaaaaagggggggttttgcttcccaaaaaacaggggcccaaaaacccaaaaccggtcccaacacccaagggggggtttcaccacccccgggtcttccagagcccctggcccccctaaatgggtaggggcaagggccggggttttttaaaaggggccccaaatggggcaagccc

SEQ ID NO: 13198 - DNA, 536 bp, Zea mays
  Clone ID: cC-zmpo14820017a11d1
gaaatctcgccctcgttgcggtcgtccacattcttttctctccttctcgtcggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcaaagaggagcttccgcttcatcgtgttcaagatcaacgagaacgtgcagcaggtggtggtggacaggctaggggagccaggcgagagctacgacgccttcacggcctgcttccccgccaacgagtgccgctacgccgtgttcgattttgacttcgtcactgacgagaactgccagaagagcaagatcttctttatctcttgggccccggatacatcgagggtgagaagcaagatgctgtacgcgagctccaaggaccggttcaagagggagctggatggcattcaggtggagctacaagcaaccgacccaacggaaagagcatggacatcgtcaagtcgcgagccctttgaac

SEQ ID NO: 13199 - DNA, 305 bp, Zea mays
  Clone ID: cC-zmpo14820017a12a1
aaatacgggtatatatatagagagaagctacgcacaacgacagcaatggcagtagtttttttcttttctttttggggtgtgtatgtgtaattgtgtatatatatactgtcgaagcgccaccgcctcctccaccgtccaacggcacgtacagccgcgacgacgacgttaatgtatggtgtgcgatcggtggagccaggctgcgtgacctggcaggcaggcagaccagaccagaccagaccgaccggctcggagacgacggcgcgccccggcagcagctagcgctgggctcaattcatgttgcgggc

SEQ ID NO: 13200 - DNA, 483 bp, Zea mays
  Clone ID: cC-zmpo14820017b01a1
ggttgtcatacttatacattaatcatcaaaagttgagccacatacatcagtatacacctcagatatgcgaggcaagaaacatcagttgccatgcatacagtaacgatcgacgaccaatgtataatgcatgtgtgtaatatatacacacacgcggcaccacacgctgaggcctggtacctgcacgcgcgtgcgacattgacattgcgcgcacatcgaccagagagatatgatcagccgcgacagccggtgatcgggttgcagccgcgggtgtagtcgttggcgggtttccctgggcgggaggcctcggggcccaggttcttgtcgcagttgcccagtaccttgcagctgatcaaattgtcaaatgacaccatcccctcggcgctgatggccccctgcggccctgtcgctaacaggaggcacagaaccaccgacgctaccaaagccagcctcgccatggtcgtcgccttcttcgtacctgcgtgt

SEQ ID NO: 13201 - DNA, 565 bp, Zea mays
  Clone ID: cC-zmpo14820017b01d1
gcttgctcctcgatccatcaattgcaagaggagcaagataccaccaccgtagcaccacacgcaggtacgaagaaggggacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggccctagcgtgtggtgccgcgtgtgtgtatatattacacacatgcattatacatttggtcgttgatcgttactgtatgcatggcaactgatgtttcttgccttgcatatctggaggtgttacctgatggatgtggctcaacttttgatgattaatggttaagtatgacacccaaaaaaaaaaaaaaaagggcgggc

SEQ ID NO: 13202 - DNA, 505 bp, Zea mays
  Clone ID: cC-zmpo14820017b02a1
gcaaacgagaactaggcattagacaagcatcacagttccagactagttcacgaaatagtttcaacgaattaggactccttatacaattttttgaataaaaacggctcgaatctaaaggaactccacttaacataggacaacacaacatagcaagttcaacagagaattgtgcccaactttccagcaagcagaatctcctaactatgggtgaaagactggtacagaggaacctgagacatcattggactaacattatcatagcaatggggatacatcattgttggggttggccaatgtcgataaacagtagctccagaagaccctattgttagatcaggctggccaaagtacatagtatgctggtttgtggacatgccacgagattgcacataaccaatgtcatactgcatgaactgcggcacaacaaagttgacaacacctgggcttaagttgaagccaggcactgagctcctaacataccttatgatgcttccatcggagtctg

SEQ ID NO: 13203 - DNA, 615 bp, Zea mays
  Clone ID: cC-zmpo14820017b02d1
tacaaaactttatgcagaaccctcagctgcaggagtttgaattccagaactttccgacttcttacctccgctgtgctgctcatcgtgttgcacaacattatggcttagagactatagtagcagatagtttagtagaaggctcagttagcaggattgttgcaagaaaaacagcagaaagcaggtatcctgcaatttttttatcagaagttcctagcaatcaagcaagaaatgatcatgaaacagctgagaagcttaagtttgtcatttatcaaaggcccaaagcattccaaaatggaagcgctgattctagaaacaagagtggtgtaccaaaaactgttgatgagagaatagaggaatataataaagcacgagcacgcatcttcaatggttccatttctgcagattctgatgctgcaagtattatgggaactctttctactggcaaagatgaaccagtaaatgttgacccttctggtgatgaaaccaaagtcagcacaatgaacagtcgttccagagttgctggtttttaggatactgaaaggatcgtagtgacccagactacgatcgaaactacaaaaggtatgttaggagctcaatgcctggcttcaacttgag

SEQ ID NO: 13204 - DNA, 453 bp, Zea mays
  Clone ID: cC-zmpo14820017b03a1
ccgtagatactgctatccatgccatgcgttcgctctgtatcgttgtagttttgtgcagcatgtccgcgacgccgccgtggtatagtttactggtcgtcgtcgtcgtccgagtccagctgctggagcggcgcggcgcagacggggagcggcacgtccttgaagtagcctagcgggttggcggggcgcaggctgtcggagatgccaacgttcctggtgagcaggacgccggcgcggtccctgagcgcctggacctcgtcgcagtccttgcgcgggctggccaccagcaccacctggcagatgtcctcctcgtggctgtccttgagctcgatcgtgtaggtgccggtcgcgttggtgaccccgtcgatggcgcgctcgagcttgccggtgccgaagtgcttgcactccagcctcaccttggcgcccgcgatgtacctcgtgacgtttgtcacgaac

SEQ ID NO: 13205 - DNA, 514 bp, Zea mays
  Clone ID: cC-zmpo14820017b03d1
accctccctccctcacacaaataataaggaaaggtcccgcccttttcctccgacatccacaaggggggaggggaaagacacgtacattcacccggcggcaataatggcctcggttccggctccggcgacgacgaccgccgtcgtcatcctatgcctatgcgtcgtcctctcctgtgccgcggctgacgacccgaacctccccgactacgtcattcagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcaaggaccgcgccggcgttctgctaccaggaacgtgggcttttcgacagcct

SEQ ID NO: 13206 - DNA, 486 bp, Zea mays
  Clone ID: cC-zmpo14820017b04a1
gatcacaattggttaagatgtaatttgaatttgcggatggatttacattttttaactctggcaccatatcggagtgcatgagcgaaagaatgaatatgcatgcatgatgcatggtataatctgcatggctgcttgcgggcatgcaggttgaagaacaggagggaaagtggctacttagaagttcttggacgcctggtacgtgacgcctaacttccagttagcggggagaacgtgccatgaggtggccttgcggtggacgatagtcatgacccggaacgtcagcgacttgcaggtgaggccctccccggtctgccacacttgcccccagttgcgcttgatctccgtgcacttgacgcacttgcttcccttgaccgacaccggcgcgatgtcgcctgcgccgcccacgttggtgaacgtcaccatgttgaagaccttgttcccggggatggtgtaccgggagccgtcctgttttgcccacgccacctt

SEQ ID NO: 13207 - DNA, 532 bp, Zea mays
  Clone ID: cC-zmpo14820017b04d1
cggcctgcggcgggtgctacgaggtgcggtgcgtggacagccctatcgggtgcaagcccgacgcggcggcgctggtggtgacggcgaccgacctgtgcccgcccaaggacaagtggtgcaagccgccgcaggagcacttcgacctcagtatgcccgcgttcctccagatcgcgcaggagaaggccggcatcgtgcccatcttctatcgcagggtggcgtgcgcgaagcagggcggcatccggtacaccatcaccgggaacaagtactttaacatggtgacgatcaccaacgtgggcggcgccggcgacatcgcggcggtgtcggtgaaggggagcaagcgcgtcaagtggacggagatgaagcgcaactgggggcaagtgtggcagaccggggaggaccttacctgcgagtcgctgacgttccgggtgatgactagcgaccaccgcaaggccacctcatggcacgttctcccccgctgactggaagttcggcgtcacgtaccaagcgtccaagaacttttaagttgccactt

SEQ ID NO: 13208 - DNA, 543 bp, Zea mays
  Clone ID: cC-zmpo14820017b05a1
catacaaatatcaaaccgaggaaagcgaccatgtgaaataaataaataaaatatcgcagagattttgcaacccctgcacgaaacgaaaccagtctccgctcctcagaaggaggcgaaggctcccgcggcgacagcggcggcggcgcaaacgcgcgccgcggcgctggcgagtgcgacgggcgcgttgctggcggcggcgccgcccgcggttgcttcggcgccgggcggggcggggacgtcgaccctgggctcagtcatggtggccccgttgggcgcgccgacaggggcggcgtcctcgttgtcgtcgacggcgtcctcgatagaggccggcttgtcgccgtcaaaggaccccagcggggtatgcgccacgggggtcaggatggtgggcatggcgttggcgtcttcggcggatgcgacagaggcccacgcatcgacgagcgcggcggcgaggagcagcagcagcaacgcccggtgccaggccatggcggcacggacggagaacacgcttggcgcctttgcgtggaaccggatgggtccaaaata

SEQ ID NO: 13209 - DNA, 605 bp, Zea mays
  Clone ID: cC-zmpo14820017b05d1
tatagacctaataagaacaaagacgtacgataacctgcttattttgcgacccatcccgttcccacgcaaaggcgcggagcgtgatctccgtacgtgccgccatggcctcgcaccgggcgctgctgctgctgctcctcgccgccgcgctcgtcgctgcgctggcctctgtcgcatccgccgacgacgccaacgccatgcccaccatcctgacccccgtggcgcataccccgctggggtccttcgacggcgacaagccggcctatgacgaggacgccgtcgacgacgacgaggacgccgcccctgtcggcgcgcccaacggggccaccatgactgagcccagggacgacgttcccgccccgcccggcgcccaatcaaccgcgggcggcgccgccgccagcaacgcgcccgttgcactcgccagcgccgcggcgcgcgtctgcgcccccgccgctgtcgccgggggagcctttgcctccttctgaggagcggagactggtttcgtttcgtgcaggggttgcaaaatctctgcgatatttaattattaatttacaaggtcgcttccctcgtttgaatttgacgaaaaaaaaaaaaaagggcggcgtcta

SEQ ID NO: 13210 - DNA, 207 bp, Zea mays
  Clone ID: cC-zmpo14820017b06a1
atgggctggcttcttttttttttttttctttttctattttttccttctttcttttgcttttccttttttttcagaaaaaaaatcggttcatatattttccgcccacccccccccaatttttcacacagccctttttctaaaaaatttgcctccacccccaaaaatgccccgaacttccaaactgcacccccctaaaatatttgtccc

SEQ ID NO: 13211 - DNA, 555 bp, Zea mays
  Clone ID: cC-zmpo14820017b06d1
tgaagatacaagagaatttgttggagagctgaatattacagtcgtgaaaggtactaacttggccgttagagacatgctaacaagtgatccatatgttgttttaacactcggagggcagaaagctcaatcgacagttaaaaaaagtgatcttaatccggtatggaatgaaatgcttaagatttctgttcctcgaaattacggacctctaaaacttgaagtgtatgaccatgatacgttctcagccgatgatatcatgggtgaagcagagatagatctccaaccaatgatcacagccgccatggcctttggagatacttcacgtcttggtgacatgcaaattgggcggtggttcacgaccaaagacaacgccctgatgaaagatagcacagtgaatgtcgttgcaggcaaggtaaaacaggaagtgcacttaaagctgcagaacgtagaatctggtgagctggaagtagagctagaatgggttccgatcctctagactatgataactcccctgatccttttggttaaaaaactattctcaagatgcatcaaaatttt

SEQ ID NO: 13212 - DNA, 416 bp, Zea mays
  Clone ID: cC-zmpo14820017b07a1
ttttatctcgcgtttttttttttttcttttttctctttcattttttgtggtggtcacttattttttttcttttaaaagaacttgccaacaggcctttttattattatccattcaatcgaacaaaaacccccatttggggaaccttacattggggctccccaccaccgcttttattttggaccaaaaacatttaacttaaaaaaaccccaattaataggaatccaatatctagatcccgccattctaaatgggccatggatgcctggcccccccgtgaacaactgcggttaaactccctaaaggcctgagttgaacccccctttaccccggggcaagcatacctgcattcatgcatgcttgggccattcattccaaggggcttcctttcaaaaaagggggggggggcacgacctttt

SEQ ID NO: 13213 - DNA, 551 bp, Zea mays
  Clone ID: cC-zmpo14820017b07d1
cagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcaacgagaactgcaagaggtcctgcaccccttctccttttgaagcgaagccccttgaaatgaatgaaccatgcatgcatgcatgcatg

SEQ ID NO: 13214 - DNA, 413 bp, Zea mays
  Clone ID: cC-zmpo14820017b08a1
ggtccacccatttcttctgaatggaaaacttgtgccctggtacatgttcgtgtagaaaagaatacacacatacaccggttgggtacgtaatccacacatactagcacctctgtggtgattcgaaggcaggacaggaaccccttgctcttgcattggcgaatatgcgcgccgtgccgtcgcgccaccacactagctaggcagatcttcgcaggtacgccatgacgccgatgccagtgacgagggcagccccggcggcgaccccgctgtacgccgtcgtccacgcgtcccggctggacatgcccaccgccatggcgccacgtggggtggccaccggtttcctgcgcccggtggtgccggagtagtccaggaacagcttcagaccctttcattcggcgagcctggcgtgttccacc

SEQ ID NO: 13215 - DNA, 465 bp, Zea mays
  Clone ID: cC-zmpo14820017b08d1
ctcaatcatttcaatcatcgacgtcattgacatcgcacatgccgtgatctccattgtggagagcagtggcggcggcggcgacggcagcgcggggagcgacgaggcggcatcgtccatgttccagaggttctgggactccgccatggccttgggccccctggacgacgagacggacacccagtcccagatgagcgaggcgtcgaggtcgcagatgatgatgtccgatgtccaccaccaccaccaccaccacgactccgcgggcggcggcagcgaggcggggttctcgctgtcgtccttctcctttaagctccaggacaggcgagggcggatgcaccgcttcagctgtgaggttcagagcttgacgcctctggtgacctgcatcctgcggaggcttggcgccgacatcgaccctgaccgcctaccgcatatcctgtactaagaccaggaccgggaccaggtggtgct

SEQ ID NO: 13216 - DNA, 186 bp, Zea mays
  Clone ID: cC-zmpo14820017b09a1
gggtaaaaaggcatttgaatttgccccttggtttacctttttttaaccccgggccccttttggagtgccttagccaaaaaatgaatttgcctgggtgaagccggggggcatccccggggcgggtggccggggggccgggtcaaaaaaacgggggaaagggggttcttaaaagttcttggacccctt

SEQ ID NO: 13217 - DNA, 189 bp, Zea mays
  Clone ID: cC-zmpo14820017b09d1
caggcgtccaagaacttctaagtagccactttccctcctcttcttcaacctgcatgccagcaagcagccatacggatgataacatgcatcatgcatgcatattcattctttcgctcatgcactccgatacggtgccggagttaaaaaaatgtaaatcaatgtgcaaattcaaatgacatcttaaccaat

SEQ ID NO: 13218 - DNA, 326 bp, Zea mays
  Clone ID: cC-zmpo14820017b10a1
gccccccaaaatggcatggatatttaacattttgcttggtttccactttttggaattcgggatacctgattagaaatgcctcctaaacccaaacaaaagggttacctttactagaattcaaaagtctcagtagtatatatgggtagcggggcatgctctctcatgcaatatttttaaacttaattagcttgctggtgcaggtccatagcccaccgggccggatgaatcgaagggaattcaaaggctagtaaaattggaccttggaagtgtaaaccggatcgggtctccagttcggggggatgacctttttggcgaagacccttttt

SEQ ID NO: 13219 - DNA, 604 bp, Zea mays
  Clone ID: cC-zmpo14820017b10d1
actgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacgtcatcccgccgaactggagacccgatgccgtctacacttccaacgttcaattctactagactttgaattcccttcgattcatccggcgcggtgggctatggacctgcagcagcaagctaattaaggttatatatattgcatgagagagcatgcaccgctaaccatatatactactgagacttctgaaatctagtatatgtaaat

SEQ ID NO: 13220 - DNA, 238 bp, Zea mays
  Clone ID: cC-zmpo14820017b11a1
catagaacccagatggctgggttacaaaatatattatatacacatcccgttagtcccgggacgacatgcaaaatgcactagccaactcgcacgaacacgcaagtacattaatgacaggaaacttgggcagaaattatctgcttctgcactagacagccataaatccttgggtaacccatggaaataatcgatcggcggcggccacagccactcctagatagatgtaattatggttgtg

SEQ ID NO: 13221 - DNA, 238 bp, Zea mays
  Clone ID: cC-zmpo14820017b11d1
cacaaccataattacatctatctaggagtggctgtggccgccgccgatcgattatttccatgggttacccaaggatttatggctgtctagtgcagaagcagataatttctgcccaagtttcctgtcattaatgtacttgcgtgttcgtgcgagttggctagtgcattttgcatgtcgtcccgggactaacgggatgtgtatataatatattttgtaacagagacatctgggttctatg

SEQ ID NO: 13222 - DNA, 327 bp, Zea mays
  Clone ID: cC-zmpo14820017c01a1
gaaaaaaattgcctccgaaaatggcatgtatatttaacattttgcttggtttccactctttggaattcggcatacatgattagaattgcctcctaaacccaaacaaaaggattacatattctagaattcagaagtctcagtagtatatatggttagcggtgcatgctctctcatgcaatatatataaacttaattagcttgctgctgcaggtccatagcccaccgcgccggatgaatcgaagggaattcaaagtctagtagaattggacgttggaagtgtagacggcatcgggtctccagttcggcgggatgacgtctttggcgatg

SEQ ID NO: 13223 - DNA, 358 bp, Zea mays
  Clone ID: cC-zmpo14820017c01d1
catcgccaaagacgtcatcccgccgaactggagacccgatgccgtctacacttccaacgtccaattctactagactgtgaattcccttcgattcatccggcgcggtgggctatggacctgcagcagcaagctaattaagtttatatatattgcatgagagagcatgcaccgctaaccatatatactactgagacttctgaattctagtatatgtaatccttttgtttgggtttaggaggcaattctaatcatgtatgccgaattccaaagagtggaaaacaagcaaaatgttaaatatacatgccattttcggaggcaatttttttcaaaataaaatcatcctaaacaatataaattg

SEQ ID NO: 13224 - DNA, 519 bp, Zea mays
  Clone ID: cC-zmpo14820017c02a1
gaatatgtgcatcttctctttcctttaggacctttacacagtatacacagacacgttctctggtgtgtcgcactttcaactcccctgtttcttacatggcgagccggcgaatgcatggtctgcttctggtcgtcggccgtcctcgctggtggcttgatctagcagggcttgccgggcgtgcaggcgagggagccggcgtagcgcgtgagcctggtgacgtaggacccgttcctgggcttgatgaggtccttcttgttgaactgcctgttgatctggccgccggtgacggtgaagtaggcgccttccatgaagaggtcgttctcggagtgccacacccagttcttccacaccgactccggcgtgtcatgctgcttggtgacctgcttcgcggcaaggctgggcggcgcgatgtagcggttgccctggctgatgatggtgggggccttgctgccgccgatggcgtacatgagccagtgcgtgtagtcgttggtgaccacgtggaagaagccccagcggcac

SEQ ID NO: 13225 - DNA, 639 bp, Zea mays
  Clone ID: cC-zmpo14820017c02d1
ccaactgccacctcaccaaccacaacgatgtcatgctcttcagctccagcgacaagcatcccgaggaccagatcatgcagatcactgtcgccttcaaccacttcggcagaggcctcgtgcagaggatgccaaggtgccgctggggcttcttccacgtggtcaacaacgactacacgcactggctcatgtacgccatcggcggcagcaaggcccccaccatcatcagccagggcaaccgctacatcgcgccgcccaaccttgccgcgaagcaggtcaccaagcagcatgacacgccggagtcggtgtggaagaactgggtgtggcactccgagaacgacctcttcatggaaggcgcctacttcaccgtcaccggcggccagatcaacaggcagttcaacaagaaggacctcatcaagcccaggaacgggtcctacgttaccaggctcacgcgctacgccggctccctcgcctgcacgcccggaaagcctggtagataagccaccacgaggacggtcgacgaccagaagcataccatgcatttcgcggctcgcatgtatgaacaggggagttgaaagtgcacacacccaagacgtgtctgttatactgtgaaaggtcctaaggaagagagatgacatattc

SEQ ID NO: 13226 - DNA, 307 bp, Zea mays
  Clone ID: cC-zmpo14820017c03a1
aagggcatcgttgttaggatcatatattcaaagaagtggctctgcttacaaagttacaatttttttccgcgaggctaagacaggtccatgtcagattttccattgtcgtgagcctcagacgtaacgaaggcatctggcacacttgattgcagcgtgatgataaaccgggttcacagagagattaagaggaaaaaaaagggatgagggaataaagaagcgtcgtcgtcgtaaagaaatatggcaaacgtgtagacttcagtctgcgtgatatatatgcatgggtggttgttggtcgctccgatcctag

SEQ ID NO: 13227 - DNA, 307 bp, Zea mays
  Clone ID: cC-zmpo14820017c03d1
ctaggatcggagcgaccaacaaccacccatgcatatatatcacgcagactgaagtctacacgtttgccatatttctgtacgacgacgacgcttctttattccctcctcccttttttttcctcttaatctctctgtgaacccggtttatcatcacgctgcaatcaagtgtgccagatgccttcgttacgtctgaggctcacgacaatggaaaatctgacatggacctgtcttagcctcgcggaaaaaaattgtaactttgtaagcagagccacttctttgaatatatgatcctaacaacgctgccctt

SEQ ID NO: 13228 - DNA, 510 bp, Zea mays
  Clone ID: cC-zmpo14820017c04a1
aaaaagtataaaacaatttataatttaggacaaagagagtgtatacatgacaagaacatagcccatcatcacatttcctgccagacatcacccaaaccaaaagaatgacgacattagaactgaaaagcatggcgaaacttcagttaacgtgtaattgacagctcaggtgccacaaacatcgaaacaatgcttcggctcagttttgttgcccaccgccggcgccattgccgtcgaccatcttggtgatgaacttagggatggggacctcgtacccgtacaacgagaagtcgggcggcagctgcggcatcctgggctccgacggcatcgccgggaacgagatgttggccagcccggagaggtcgggcatcttggggatctgagggatgtcggccgggagagccggggccgccccaggctggagcttggccagcaccttcggcggaagctttgacaccactacttgcggtggaacgacgttggccggctggctggcgttggcgggcatggtta

SEQ ID NO: 13229 - DNA, 651 bp, Zea mays
  Clone ID: cC-zmpo14820017c04d1
gcaccggcgccggtccctcccgccgtcgggtcgttgccggagaactcccagacgaccaacgtcccggtgaccatacccaacacagcgacaggttcacccgcggcggtccctcccgccaccgggtcgttgccggaaaacaccccggcgaccaacgtcccagtaaacatgcccgccaacgccaaccagccggccaacgtcgttccaccgcaagtagtggtgtcgaagcttccgccggaggtgctggccaagctccagcctggggcggccccggctctcccggccgacatccctcagatccccaagatgcccgacctctccgggctggccaacatctcgttcccggcgatgccgtcggagcccaggatgccgcagctgccgcccgacttctcgttgtacgggtacgaggtccccatccctaagttcatcaccaagatggtcgacggcaatggcgccggcggtgggcaacaaaactgagccgaagcattgtttcgatgtttgtggcacctgagctgtcaattacacgttaactgaagtttcgcatgcttttcagtctaatgtcgcaattctttggtttggtgatgctggcaggaaagtgagatgggcttggtcttgcatgatatactcttttgccaaatataattgttatacttt

SEQ ID NO: 13230 - DNA, 513 bp, Zea mays
  Clone ID: cC-zmpo14820017c05a1
aaaataaaattgggatcataataatattagcatcgggtgacgattacagaacaaacccttcgacaattcacacgaccacgaaacgaacgaacaaacaaacaattaaccaatcgcaaaccacgtaaataaaaaaaacaattaattaatcggatgaaccaaacacgatgcatcccaacgttgccgacccgcgcgtcgtcgctcagtggaggtagtaggcgaggaaggaggcgacgagcgccccggcggctggcacggcggcggcggcggcgccgcttgcgctagggccagtcgcaccaccggccgtgccggcgggcgccttggagggcgcctcggaagcgaccgaggccagcacggcggtggccgaagcggcggcgaccagggcggtgcagaggaccttcttcatctccatggctggcgggtggatcacttcgtcgctcctggatatagtggtccaaggaacctggcgttcgatgagatgctattagttattgggtggaattggtaaactgcttc

SEQ ID NO: 13231 - DNA, 527 bp, Zea mays
  Clone ID: cC-zmpo14820017c05d1
caccggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggaggtgcggctggccctagcgcaagcggcgccgccgtcgccgccgtgcccgccgccggggcgctcgtcgcctccttcctcgcctactaccttcactgagcgacgacgcgcggggcggcaacgttgggatgcatcgtgtttggttcatccgattaattaattgttttttttatttacgtggtttgcgattggttaattgtttgtttgttcgttcgtttcgtggtcgtgtgaattgtcgaacggttagttctggaatcgtgactcgatgctaatattattatgatcccaattttatttt

SEQ ID NO: 13232 - DNA, 296 bp, Zea mays
  Clone ID: cC-zmpo14820017c06a1
cacaaaaataaaataaaattgggatcataagggttggagcatcgagtcacgattacagaacaaacccttcgacaattcacacgaccacgaaacgaacgaacaaacaaacaattaaccaatcgcaaaccacgtaaataaaaaaaacaattaattaatcggatgaaccaaacacgatgcatcccaacgttgccgccccgcgcgtcgtcgctcagtggaggtagtatgcgaggaaggaggccacgagcgcccctgcggcgggcacggcggtggcggcggcgcctcttgcgctatggcca

SEQ ID NO: 13233 - DNA, 138 bp, Zea mays
  unsure at all n locations
  Clone ID: cC-zmpo14820017c06d1
tgcagtccgcggctcgtcgaggcgagcatgtctcccaattcccatcccaatatactatatatacanntctcctcgaaccgccagtgtttcctgtggagccgagctatatctcagtgagccgatcgaatgtgtatccac

SEQ ID NO: 13234 - DNA, 543 bp, Zea mays
  Clone ID: cC-zmpo14820017c07a1
gtacgttgacaagaataaccgacacccggttgccatggttcataatcttaatattgcacagtcactccgcgctgaatacatcagctcctcccgacaagtgcaacattatacatgtgcagagctctgacacacgccaaagcctaaaacgtgggacctacgtaccgcaccacactcctggtacccagtcacccaccccacaccctacctcgctcgcagtcgcagcttccgctgtacgcacactactgcgcggtgcacgcaccgacgacacggcggcgcagcttatgtatgagtaagtatagggactcgccatacaggtagtcgtcgcagcgtgccaccccgtctagcgatcgaacacagtcgacggggaacgccggccggtccggtcagatggtgagcgcgacggcggcctcgtgcacgaggggctgggtggcgtgcgcgacgccctcggcctcccgctccacctgctcccggcacgccttccgcgcgcccggcttcgtcatgcgctagacgaacgcggcgaagcggcccagtgtcgggctggac

SEQ ID NO: 13235 - DNA, 544 bp, Zea mays
  Clone ID: cC-zmpo14820017c07d1
accgaatccccagaccaaatcgccgtcgccgtcgcatcgcagcatcgggagtcccagggtcccggaccgaatccatttccagacacccaaggccaagatccatcgctcgttccaacctgcctcctccttcttctgcttggtcgtctgatctcgttcaccattcgtgtccaatccgatccatccaaccgctgtgaatgatggcgctcaacctgtcccaccagaccggcgcggccgtggcggcggcaccggcggcgccacgagcggccgtcgtcgcggcggcggccacggcgccacgctcggccgtcgtcgctgcggcggccaccgtggcgccgtcgtccgtgtcggcgcccgcccccgctccggcgctccagctgcagacgatgacggtggacccggcccccgtgcaggcgcccgacgcggtgaagcccgacctcgccatggcgtgccatgcgctggtggaggccttgcccgatgcggagcaacgccgaccttttcgtcgacttcggagcaggctcgggtgccccgttttgttatgatgccgttg

SEQ ID NO: 13236 - DNA, 548 bp, Zea mays
  Clone ID: cC-zmpo14820017c08a1
ggggtgtgtatgtgtaattgtgtatatatatactgtcgtagcgccaccgcctccttcaccgtccaacggcacgtacggccgcgacgacgacgtcaatgtatggtgtgcgatcggtggagccaggctgcgtgacctggcaggcaggcagaccagaccagaccagaccgaccggctcggcgacgacggcgcgccccggcagcagctagcgctgggctcagttcatgttgcgggcgcagcgcgtgatggcggagcagccgcggcggtaggggttggcggccttctgcgcctcgcagttgctgtagtaggaccggccgcgcttgttgcacggcacctggtccgcgcgcagcgccgcgtagctgatgtaccggctggtcggcttccgctgcgccagcgttcgccgcaccgcgtcgtcggagccgaggccgtcgtcgctcagcccgagcttcttcggctcgtccacgtcgcattcgcccaccgggcccgagcacttctgcgggcccgggccgctggcgtcctttgcggccgcaccccatgggctaagttcccga

SEQ ID NO: 13237 - DNA, 549 bp, Zea mays
  Clone ID: cC-zmpo14820017c08d1
gggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcggaccaggtgccgtgcaacaagcgcggccggtcctactacagcaactgcgaggcgcaaaaggccgtcaacccctaccgacgcggatgttccgacatcacgcgctgcgcccgcaacatgaactgagcccagcgctagctgcttgccgggcgcg

SEQ ID NO: 13238 - DNA, 483 bp, Zea mays
  Clone ID: cC-zmpo14820017c09a1
ggacaaatggattacattacatttgcgcatacaaaaccatcacgaacagcagtcacacttctccattaaattaaagggatggaatatatataatgaagtcgacgaaacaatttggcaggatcgagtcggataatatatattcggaggcatgcaatagcatgcatgtgggtaggcttggccacactttgcgtatctatatataattatggcaagaacagtagtagcctgacacacgatcgagcccttaattagttctcggttttgaccaccttgcttggctggacgcacgcttctcagttcaaccggacgacggccccggcgccggcgccggcgccggcgcatcggattccgtatcagccagcttcatgtccgcgtagacgacgcggccttcggactcggggctgctgccgtcgctggagccgtcgacgctgccgaggacgtggatgtctttctggtgggcggaagcggtggttgcgaggtggc

SEQ ID NO: 13239 - DNA, 575 bp, Zea mays
  Clone ID: cC-zmpo14820017c09d1
aagcaaccgtgtgccttttggagacgcgatgtcgtccggcaacaagatcttcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactggtcttgccataattatatatagatacgcaaagtgtggccaagcctacccacatgcatgctattgcatgcctccgaatatatattatccgactcgatcctgccaaattgtttcgtcgacttcattatatatattccatccctttaatttaatggagaagtgtgactgctgttcgtgatgggtttgcatgcgcaaaagtaatgtaattcatttgtcc

SEQ ID NO: 13240 - DNA, 431 bp, Zea mays
  Clone ID: cC-zmpo14820017c10a1
gcagcggaatttctttattacaaaaggttacaagttacatcaaatttacattaagtttatcggagtgattacaaagtgattcaaagaaataaactttgaaatgttataaattacttgtaagtttgaaatatatgctagcttaagtgaccatcctcaataagaagtatagaagaggtactgagactattaagaaggccgagtccaccggcacttagcaccatccacaacaacgcacttctattttcggttcttcctcctgcttgggaaccaccattgcacaaaagtagcaaagctccgcaggctcttcaccaaatgggatggcgtaatcactccggtcaccgctcagagtcgctttgccgctgtgtagattttccggtgaacaatcccagggtcccccggcatcaatccacccggaatgaccacatgatttt

SEQ ID NO: 13241 - DNA, 431 bp, Zea mays
  Clone ID: cC-zmpo14820017c10d1
aaatcatgtggtcattccgggtggattgatgccgggggaccctgggattgttcaccggaaaatctacacagcggcgaagcgactctgagcggtgaccggagtgattactccatcccatttggtgaagagcctgcggagctttgctacttttgtgcaatggtggttcccaagcaggaggaagaaccgaaaatagaagtgcgttgttgtggatggtgctaagtgccggtggactcggccttcttaatagtctcagtacctcttctatacttcttattgaggatggtcacttaagctagcatatatttcaaacttacagagtatttattacatttcaaagtttatttctttgaatcactttgtaatcactccgataaacttaatgtaaattttgatgtaacttgtaaccttttgtaataaaaaaattgcgctgc

SEQ ID NO: 13242 - DNA, 247 bp, Zea mays
  Clone ID: cC-zmpo14820017c11a1
aggcaccacaaaagggtcggagtcttttatcaattaatacaacccttgtttggaaaacccaattaataaacctgccggataattaagggccgggcaaaacaagattccgttccacaaaacaaagctttggaaaacaatgggaaccggacagaaaccccgcagcatctttaaatcaagggccaaatggctaaacgcagatttctagggaagttaaaaagggttttaccccctacaacaaaatgggggc

SEQ ID NO: 13243 - DNA, 420 bp, Zea mays
  Clone ID: cC-zmpo14820017c11d1
gagcagcttcgacaccaagctggcctgcgaatgaagccaccagtcatggctcaaagtcaaggacgatctgtctgtttcacgaagacggtggccccaaattttgctgggccaccattctgttgtatgttgttgatgccttcttaacttacctaggaagctgcgtttagacattttgcacctgatctacagctgctgctgtgtttctgtcctgatcgcattgttttccatagctttgctctgtggagcggcaacttgatctgccctgcccttaactagccggcaggtttattaatttggttttccatactatggttgtattaactgagaagagactccgacactttcgttgtgcctcagataaaaataaataaaaaaaaagtggtatttgtgtagttttgttaatatatatacctaatcaat

SEQ ID NO: 13244 - DNA, 362 bp, Zea mays
  Clone ID: cC-zmpo14820017c12a1
gcatcaggcgttgtttctcatgagtcatgagacaaagagttgtgctcataccaccgccgcataggcgcatgacattagaaggaagaatagctcggaccatacacagagatacatgaaacctaaattagccgtcaataataagttcacaaggaaccatgccatcttcttctcagctggccgcgccgaacggaggagcgtgtatagacagaataaacaacaccatctcagaatttgaaggtcagccacttccccagctgtggatgagcattcttcttctcaccagatagtggcacagtgtcctctgcatgtgtcctcctgttgctccttagtttagaggagcagaaccatttttggaacagact

SEQ ID NO: 13245 - DNA, 508 bp, Zea mays
  Clone ID: cC-zmpo14820017c12d1
ggctaccgttccctgccccccgactccccgaggcaccccctcctccctcctcggcgaaacgacaaccaccccgccggggagggtaatccaagcgagggcgagccatcaccgtgctgttcctcgtttgctgtcgcctcgaagagcctccttcgttccctctccctcgaccgatcggccggtctcacggggcatttcgcggggctggtcgatctctccccgctcattctgtcaagggattggtcggttgccgattccgtgcggccggataactcggatttattcagtttttcgggttcgctacatgcgtgtgcgatgccggccagctccctcccggcgttccccgacgccaccggcgacattggcgccgcgctcgagctcgatctcgaggatctcgccgccggcggcggcacggactgcatcggcgcgctcgcctgcggcaggagcagctttttctaccgtcgtctcccggagccccgccttcgcctcaccggtcagaagcttgacgact

SEQ ID NO: 13246 - DNA, 418 bp, Zea mays
  Clone ID: cC-zmpo14820017d01a1
gaaaggcagaaacaattgcttctgcatttgcatgtttctcttctcggtcatcatgttacatgtgcacacactcgttacattacctatgctgttatacccttacgcacaaacgtacatgcgcttatctgatagcattcaattcaggtcgctagagcattgcagggtgcgatcgacttgtcactggttctcctggcctgcctcatcgggagtactctcatcgtcagtagagcgcgctgtgatcaccgcttagtatccttggaactgaggccgcggtggcgacgcatactgctgcgccatgattggtggcaagatgaactcctcaggtgccggcggtggaggtgatgatggtgcgggtggaggtgctgatgaaaaggctggtgcagggttgccaagctcactggaacaagtggtggtgggg

SEQ ID NO: 13247 - DNA, 479 bp, Zea mays
  Clone ID: cC-zmpo14820017d01d1
cggtgaagcccccgccaccaccgccacttgtaagctctccaccactgccaccaatgacctccccacctccaccaacgccggcgagctcaccgcctcctccagtgaggtcccctcctccaccggcgccaataaactctccacccccaccggtcaaatccccaccaccacctgctccagtgagctcgccacctccaccagccatctcatcaccacctccacccgcaccatcatcacctccaccgccggcacctgaggagttcatcttgccaccaatcatggcgcagcagtatgcgtcgccaccgccgcctcagttccaaggatactaagcggtgatcacagcgcgctctactgacgatgagagtaatcgcgatgagggaggccaggagaagcagtgacaagtcgatcgcaccatgcaatgctctagcgacctgaattgaatgctatcagataagcgcatgtacgtttgtgcgtaaggggat

SEQ ID NO: 13248 - DNA, 369 bp, Zea mays
  Clone ID: cC-zmpo14820017d03a1
tttttttattttcttttttatctatcctttatcttttacatatatttgtatgttaatttattcttatttaaaatacacatacactaacattcttatcttcctattacaaaataacaacacaaaaaacaaaaataacacactaacacaaattaaccaaacacacccccccccaataacaaaaaaaaaaaaaaaaaaccaaaaaccacaacacaacacaaaaaaacaaacaacaactcacacccaacatacaaacaaaaaaaaaaaaaaaaacccacaccccaaaaaaatcaccacccccataaacaaaacccccaacaccacccacacaaaaaaaaaccccacaaaaagcccccctatcaacacactaac

SEQ ID NO: 13249 - DNA, 357 bp, Zea mays
  Clone ID: cC-zmpo14820017d03d1
gtgtcggtgaaggggagcaagcgcgttaagtggacggagatgattcgcaactgggggcaagtgtggcagaccggggaggacctcacatgcgagtcgctgacgttccgggtgatgaccagcgaccaccgcaaggccacctcatggcacgttctccctgctgactggaagttcggcgtcacgtaccaggcgtccaagaacttctaagtagccactttccctcctcttcttcaacctgcatgcccgcaagcagccatgcagatgataacatgcatcatgcatgcatattcattctttcgctcatgcactccgatacggtgccggagttaaaaaaatataaatcaatgtgcaaattcaaat

SEQ ID NO: 13250 - DNA, 573 bp, Zea mays
  Clone ID: cC-zmpo14820017d05a1
agcaaacaatagtcgagagttaagttgcattcaaaaagaatcgatttgtaaattcacagaaacaagagcaaaatgttattgtatccatatggacatccagtcttaaacaagaccctgtgatgaacaaaataactaactaggtcattttaacttcccacaattgaaaggtcacaaattcgaacataatgacgagcgtttgatgccaataccctatagcattgcaggatcaatgttcatttgattaacgtgcttgaaaacctattagcgctgtgccacatcaaatttccgcaagttcatacaggaactgtccacaatccacccgtccatccttgcacttaaagttgatctgaaatgaagcatagattcgcagttgcaggatttcaccgttgaaaaaggcttgttctgatcagtccatgacgaccttggcgccaactgccttcatccgctcgatgatcgccttggctttctccttggataggccgcccttgatacaccgaggcgccttcttcaccagcttcttggcctctttagccccaggtcggtgaacgaccggatctccttgatcaccttgat

SEQ ID NO: 13251 - DNA, 537 bp, Zea mays
  Clone ID: cC-zmpo14820017d05d1
ccccatgcggccatgccgcaccccacagccagaaccctagcctcgtcaccatggcctcctccttgctccgctccggccaccgcctctttctccgacgccaccgcctacccgcggcattctccaccgctacggccgaggagctaatcgacgtacgcaagcttcccaccaactacgacccctccacctttgacccgtcctccccgtcccgcccgccgccgtccgaccgcgtgtggcgcctcgtcgaggatgtctcctccctcaccctcgcagagaccgcggctctctcctctctcctcctccgccgcctcgacataccctccgcaccacccatcgccatcctcaactccgccgcggggctgggcggcgccgccacggccggcgcggcgggggagaaggcgggggcggcgggggcggccgagaagaccgtcttcgagctgcggctggagggctacgacgctgcgagcaagatcaaggtgatcaatgagatccgggcgttcaccgacctggggctgaaggaggccaaagagcttttggaga

SEQ ID NO: 13252 - DNA, 532 bp, Zea mays
  Clone ID: cC-zmpo14820017d06a1
agtaaccgagataacattcattcaataagccccaggatgttgtattatcagaaccccatggagggaaaacgggagacatcaaaggtttgttttgtttacaaggtgaccgagtctctcttccgacttaaacatgtatgccaattagtggtcgatctctttcttgcacattgatcatcaggcatcagccaattgacgtgggggcaattagcttagcgatggcttgtccttctggatctatatctcctcctcggtgtctttcttcaattctgtcgtgggctcggctgccaccttgttggtggcaatattttcctctgcatggactgctgatggcttctccttctcgatgacggtcttctccacaacttcctcctcctctttgttctcaggctcgacaacgacgaccgtcactttcgaagtggtcaccttactagcaatctgctgaggctcaatggtggctgctggctcttgtttcgccgtcactgttagtgcctccttcttgttctcctccaccttctcaactactgcatgtttt

SEQ ID NO: 13253 - DNA, 561 bp, Zea mays
  Clone ID: cC-zmpo14820017d06d1
ttaagcctccccgaccgccacatctattaggtgcagtcatgggtgcctgtgcaacgaagcctaagacgcttgaggggaaagccccagctgaggccaccatctccacacccaaggttgcacctgagaccactaccatccacattgaggttgcggcaaaacatgcagtaattgataaggtggaggaggacaaggaggaggcactaacagtggcggcgaaacaagagccagcagccaccattgagcctcagcagattgctagtgaggcgaccacttcggaagtggcggtcgtcgttgtcgagcctgataacaaagaggaggaggaagttgtggagaagacctgcatcgagaaggagaagccatcagcagtccatgcagaggaaaatattgccaccaacaaggtggcagccgagcccacgacagaattgaagaaagacaccgaggaggagatatacatggagaaggagaaaccatcgctaagctaattgactgcatgtcatatggctgatgcctgatgatcaatgtgcacgaaagagatcgaccactaattggcatacatgttta

SEQ ID NO: 13254 - DNA, 417 bp, Zea mays
  Clone ID: cC-zmpo14820017d08a1
aaccggtgaatttggttggtatttggagaataaattttataccctcaaattcagggtgttacaccgtcaaacataatttagctgtcggatgtctgtcgttttactggtgtgcgttaccaatggatagcatctaatgggcaatgcaaggaccagagaaaaatttttactagagagatgggtcattcgacggggggtctaaaagcatgcaagctccttgaggcaacccttggggctgcccttggcgttcgtgcttatagccatggtcttgttgttggtgccgctattctcgacgttgaccttatccatggggaccccggtgcatgggaccttggcagtgcaaagcaggctaacggcctcccgggtggaagaggtgcccgtgatgttcttgaaggtgacatccttgaccgggaccttgga

SEQ ID NO: 13255 - DNA, 491 bp, Zea mays
  Clone ID: cC-zmpo14820017d08d1
aacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttattctccaaataccaaccaaattcaggggtttaaaaaattaatcatctcaaatactatcacctaatataatctcactt

SEQ ID NO: 13256 - DNA, 525 bp, Zea mays
  Clone ID: cC-zmpo14820017d09a1
ggtacagccacgcagttacatttttgttttcctttcctttctcagttacatatttgtaatccaggtgaagaggatttgtggtttagtgccagccagtctgcgacgactgcggtcggtcgtcgacgacgtgctattacatatcgatcgtcgtcgtcgatgtgctattactgatcgtcgtcgtcgtccgagtccaactgtttgagcagcgaggcgcagatgggcagcggcacgtccttgaggtagccgagcgggttggcggggcgcaggttgtcgctgatgccgacgttcctggtgagcaggacgccggcgcggtccctgtccgcctgcacctggtcgcagtccttgcgcgggctctccaccaagaccaccttgcagatgtcctcctcgtggctgtccttgagctcgatcgtgtacgtgccgttcccgtcggtcaccccgtcgatggagcgctcgagcttgccggtgccgaattgcttgcactccagccttaccttgggccccggatgtactcggtgacattggtca

SEQ ID NO: 13257 - DNA, 508 bp, Zea mays
  Clone ID: cC-zmpo14820017d09d1
ccctcgtcgtcgtctcactcaccccgccttcacgcctccctcaccaaataaggtcccgcccttttccgacattcacaggggggacaggaaatcagcggccatggcctcgattccggcgactaccttcaccgtcatcttatccggcctctgctgtgccgcggctggcaccgtcgtctacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgttctgctcaccaggaacgttggcatcagcgacaacctgcgc

SEQ ID NO: 13258 - DNA, 505 bp, Zea mays
  Clone ID: cC-zmpo14820017d10a1
acctgatctcgcgtcgcgcgtccccaccgtgcccgcgcagctatcgcgggggtcacgacggcgacgcgattccaggagctggtagactggatggaggagcggaaggcggcattcagggacgacggcaagtggacagagacggtgaatctggggctcaggagccccgcgctcatcatgttcgggctgcttcagttcgccatcgacagggacctcgggttcgggaagaccagcctcgtgctgccctgggtgcgccatggccggctggggtccgcgtccgtgacggtggtgccctgccccaacggcgacgggtcgtggttcttcggcggcactaggatgtggtcgcggctcatggaggtggtcgaatccgatcctttgatgaagccgacagcgaacccgagaatggtgacaccggcgggatcccgtctgtgaccctaaaccgacgggaactgtgaactcgcgctggcggtacctgccattacggtgtacgggtatcgtcaccatcatc

SEQ ID NO: 13259 - DNA, 527 bp, Zea mays
  Clone ID: cC-zmpo14820017d10d1
atcctaagtgttcatccttttatagaagtgcataatgaatatcttggatattgcttctgattacaccaactgaaggtccacgtactttggaccttgagaacactgcattggatggtcaatagcggtaccaacaagcaaatcaatgaactggggccaaaacctggatctggatgatgatggtgacgatacccttacaccgtaatggcaggtaccgccagcgcgagttcacagttcccgtcggtttagggtcacagacgggatcccgccggtgtcaccattctcgggttcgctgtcggcttcatcaaaggatcggattcgaccacctccatgagccgcgaccacatcctagtgccgccgaagaaccacgacccgtcgccgttggggcagggcaccaccgtcacggacgcggaccccagccggccatggcgcacccagggcagcacgaggctggtcttcccgaacccgaggtccctgtcgatggcgaactgaagcagcccgacatgatgagcgcggggctcctgagcccc

SEQ ID NO: 13260 - DNA, 455 bp, Zea mays
  Clone ID: cC-zmpo14820017d11a1
atgaagcacgcatttatattgaattttcactagatacatgatttgacatacattgtttaattacacttggagattgaactagcagtagaccgacacaaataataaatataatgaatttgtttttctcttacaatcaaatgaataaaaagagaaaagaacacaaatgacactaattacatctcaactggccgttttatttgaagaaccgttctacttaaaatatgtaccacaaataattaaatcaaccaatcaactaagattagctggtttgatcgagcgccttgcatgcaacccgagcagtcgtagctcgtgcccttgttttctcagcacttgggcatgttagggggacgtggcatcatctgagcgtccgggcccttgccatttttcacaatgaacacagtgtccatgccccacaccgtgtgacgatcaaagtggcaatgcataaaccacacacc

SEQ ID NO: 13261 - DNA, 528 bp, Zea mays
  Clone ID: cC-zmpo14820017d11d1
aacccgaccatcgacatcctcgacgcctactacgactccatcagcggcgtttacgagccggacttccccaacaagccgcccttgttcttcaacttcaccgctcccaacccgccacaggacctctggttcacgaagcggggcaccaaggcgaaggaggtggagcacggcaccgtcctggaggtggtgtaccaggacacggccatcctcggcgccgagagccaccccatgcacctgcacgggttcagcttctacgtggtgggccgaggcttcggtaacttcgacaaggacaaggaccccgccacgtacaacctggtcgacccgccgtaccagaacaccgtctccgtgcccacgggcggatgggctgcaatgcgcttccgagcggcaaatcctggtgtgtggtttatgcattgccactttgatcgtcacacggtgtggggcatggacactgtgttcattgtgaaaaatggcaagggcccggacgctcatatgatgccacgttcccctaacatgcccaagtgctgagaaaac

SEQ ID NO: 13262 - DNA, 449 bp, Zea mays
  Clone ID: cC-zmpo14820017d12a1
atataacttgtcaatccatttcttaactcttctgttttaaacaacagcgaagtctcactctagctatatatggagatggagaagatggagaaggaggatgacgccattattgttggcgccagcatcactgtcgtaatagggtagtggtagcaaatagatatcacggtccaatgcatgcatgtgtaatgcattgcttgggatccaacccaatctagtatagctagcatagtccggcttaaagtattggtagcactaaagttaattatttggcggtgtaggcggtgttggccttccagttggcagggatgacatcgtcgtagacggtcttggtgcctccctctgtagtgaggcggacggtgaggggtcccttaagcggtttgtcgctgtccttccttcagatggcaccccaagagtggtttaggggctcgtacgtggtcgagcccttttct

SEQ ID NO: 13263 - DNA, 529 bp, Zea mays
  Clone ID: cC-zmpo14820017d12d1
ccaagacaaaatatggctgtgaatgtgagcaccatgtggtcgttgatgcaggcacaagttgcgatggttgtggcgttgtccttcttggtgagcggtgcatggtgcggtcctcccaaagtcccccctggcaagaacatcacggccacctatggcaaggactggttagacgctaaagcaacatggtatggcaagccgacgggtgccggtcccgacgacaatggtggcggctgcgggtacaaggacgtgaacaagccccccttcaatagcatgggcgcgtgcggcaacatccccatcttcaaggatggtctgggttgtgggtcctgcttcgagatcaagtgcgataagcctgtggagtgctccggcaagcccgtggtggtgcacatcacagacatgaactatgagcctatcgcggcgtaccacttcgatttggcaggcacggcgttcggcgccatggccaagaagggtgaggaggagaagctgcgcaaggcgggcattatcgacatgcagtttcgaagggtcaagtgcaagt

SEQ ID NO: 13264 - DNA, 475 bp, Zea mays
  Clone ID: cC-zmpo14820017e01a1
gagacaacatccacaggaagcccaattagaacatgttgtttcatcagaagaactccgtggaggaaaataatgggagacatggaaggttagtttgttacatggtgtggccggtcgagagtgtctgtcccgacctatggcaaactggatagaattgaagtggcttctgcttgcttgatcacagtatcacgcactgaacatcaggcatcgtcagccaattatattaattggcacgcatgcacggacagtcgatcagctttgctgcgccagcttctcctttccggccttctcggcgttcttcttcgccttcaccgtcgtcgtggtctcggcggcggtggcgaccttttcctctgcatgggctgctgccgctggcttctccttctcgacgacggtcttctccacggcttcctccttcttgtggtcgggctcggcgacggccgcctttggagcgagcaccttattaggcttttgatgctta

SEQ ID NO: 13265 - DNA, 523 bp, Zea mays
  Clone ID: cC-zmpo14820017e01d1
gggtcgaccacgcgtccgcaagcaccttctcttcccccgccgggcaacaactcagccgccgtaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaagaaaaggtcgccaccgccgccgagaccactacgactgtggaggcgaagaaaaacgcccaggaggccgggaaggagaagctggcgcaacaaagctgatcgactgttcgtgcatgcgtgccattaatataattgggtgatgatg

SEQ ID NO: 13266 - DNA, 512 bp, Zea mays
  Clone ID: cC-zmpo14820017e02a1
tcggtcgccaccatggcgggtgtttcctcctcgacgggaggagggcccaccttcctggacgacgaccctggctgcgacagcccggccatctggtcggggtcgatggagctgatccgtatcaccgacgtgctgccgctgctgttctgcgggttgttgaactcggagcaggtcttcctgatctcgccttccgtccccgtgagcaccttgagcacgctgagcttctccatggccttggcgaagatcgggacgaagtcggtggtcttgtccgacatggccttcactatgggctccgtcttcttgtccatccccatcaggcggtcgatggtgagcggcatcttcttctccagcaccaggccgaagtagctcccgtccaggtcgttgggcgaggtggagtccatggggacggagcccgagtccttgccgtcgcacgcgtcgctgatcgtcttcttgtacttggggtcgatgggcgccgcgtcggtcttgatgaagagcacctgcagacgccgatgctg

SEQ ID NO: 13267 - DNA, 519 bp, Zea mays
  Clone ID: cC-zmpo14820017e02d1
ggacttttgggtcgatcacgcgtccgcccctctccatctctgcgtgatggacgcccgccttgttttccttctcctcctcgccgccgcggcgtccgcgccgggggcctgggcgcagctctcggcggatttctacaagacgtcgtgccccgacgccgagaagatcatcttcgacgtcgtccagaagcggttcaaagctgaccccggcaccgccgccggcctcctccgcctcgtcttccacgactgcttcgcaaatggctgcgacgcgtccatcctgatcgacccgatgtcgaaccaggcctccgagaaggaggccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggcgggcccgagtacgcggggcccctggggcggcgcgactcgctcgtgttcaaccgcgaggacgccgacaacct

SEQ ID NO: 13268 - DNA, 469 bp, Zea mays
  Clone ID: cC-zmpo14820017e03a1
gggatgatgatcatgggtggggcaaattcgatgtaatgtacattactccataaccattccactcacgaaagggaagatgaaaccaccgtatatattttattttcaaagggatgcacatttcaatggtagtaacacagaagggactttttaagcgaaggctgcacacacataagggtcatttccagagaagtctgcagggcaagccctcttgcttctttctttcctttacagatacttgacgagaaaccaaactatgactgcaagaatcacgatggggacaaccgatttgaagcaggcacctacatgagccgccacctttggtgcgcttgctcagaattgcaagccttttttgcacgcgctgaagacgtgaatttgtaacattaacatgatcttcaagggcatctattaaatctgggtgccgggtaaagtctttattgactggtaatgcaatatgctttgtgctcaacac

SEQ ID NO: 13269 - DNA, 637 bp, Zea mays
  Clone ID: cC-zmpo14820017e03d1
gcttcgtcaaagacacgccgaaaagagggggaggcgactcggcctaggtccggttccgaactccggtcctccgatgtgcgcgtccggatctaccagccatggcatcatcttcggacccgtggatgaaggagtacaatgaagcatccagacttgctgatgacatcagttccatgattgctgatagagggtcccttccacaatcaggcccagaaattatgcggcatacttcagccatccggagaaaaataactattcttgggactagactggatagcttggagtcgttgcttggcagaattcctccaaagtcaatcactgacaaggagatgcataagcgccaagacatgttttccagtttgaagtctaaagcaaagcagatggcgacaagtttcaacatgtcaaactctgctaacagggaggatctgcttggtcagagtaaaaaggcagatgacatgagcagagttgctgggttagataaccaagggattgttgtccttcagaggcaaattatgaaagagcaagatgagggtcttgagaaactggaagagacagtgctgagcacaaagcatattgcattagcagtccatgaagaacttactctgcacacaagaatgatagatgaccttgaagatcattg

SEQ ID NO: 13270 - DNA, 448 bp, Zea mays
  Clone ID: cC-zmpo14820017e04a1
agttctcttggtatgtgtacattaatgaaaacattagatcgtacacttttacagctttacaatatgtgcagaagaactttcttgaagctgaattctgtcgcaaggtgcgttgatttcaagttttcaacctgtattgaaattattatgtttgcaaggcatgctatccgtaccgtcttatgtctgtacaaaattcttgagtacaaagaacgtgatatacacactaccggttgcgctcattctgtactcaacccacttgcctggcaccattagtctccgtgtatctcaggacatgtcatacgattaccacctgtgtccgataaatcttcactcaaagttgtgtgtagaaaaatggtcgtgtatgttgaaatggtaacgatagccccattggggacgtgtgtaccatggcacgtttaagggttcctatgcttggaccttttttaaggtattt

SEQ ID NO: 13271 - DNA, 503 bp, Zea mays
  Clone ID: cC-zmpo14820017e05a1
atccgttctatttactagttacaactggcggcatgcctttttattattacccattcaatcgatgaaaaacacacatttgcgtgacattacatttggagttccatcgacggtatatttggaaaaaaacaattagcttaaaaaatgccagattaataggaatacaatatatagttccggccatatcagatggttatcgcatgcgtggccagccggtgacgacgtacgtatagactcgcttagcgcctgagctgaacgccacgttaccccggggcatgcatacatgcatgcatgcatgggtcattcatttcaaggggcttcgctgaggcgcgggttcttttccttggcgcaggtgacgctgcaggccttggtgaccttggccgcctttaccacgtacgccttgtcgcactcctcctggcagacctttatgggcggcgccgtgatgcccttctgctcggtgcacttgcccttggactggatcccgacgtacaggaccaggttggact

SEQ ID NO: 13272 - DNA, 415 bp, Zea mays
  Clone ID: cC-zmpo14820017e05d1
cccacgcgtccgagcaaacctgcagtcatctcctccatcaccaccaccaagctcaacaacagccagctggcgaaaaggatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgt

SEQ ID NO: 13273 - DNA, 356 bp, Zea mays
  Clone ID: cC-zmpo14820017e06a1
aaaatgccaaattttggttaggggattgcatggatgctggggcatcctttacatctggctatgcctaagccatgttttccattggaaaaggaaattttacttccaaagccaaggacaatgcccaagggcttgctaattgaccaattttgtcaagcctgccactggtttttgggatcccctttaacccttatttcccccaaagcccggaatcctgcttttgggttgacttctgatgctgtttaattgagggggggggactttaaacaggaattgcgggttggaaaccccttttttggttcataaagtttttttgcccagtttttgactgaggctgctaaaattttctggtgagtaac

SEQ ID NO: 13274 - DNA, 565 bp, Zea mays
  Clone ID: cC-zmpo14820017e06d1
cgagcacccggcgtcgggcgacggtggcgccatgggtggctgccactccgccatcgcggccaccaagctgaagatgctgcgccgcggaggccggggtgccgctgccgtcctccccgtcaccaaccacgacggcccgtgctgctcctccgaccacggcagcaaggagaagaagaagaaaaagaagggcgccaggaagggcaggaaacgcgcctccatcctgggcgacgccggcaccttcgacccggacttctcgcggcggtaccggctcggcgcggagctcgggcgcggcgagttcggcgtcacgcggcggtgcgaggacgccgccacgggggaggccctggcgtgcaagacgatccggcggaagcggctgctcctgcgcctcgccgggcccgacgcgaccgacgtgcagcgcgaggtggagaatcacgcggcgcatgtcggaggtgagcggtggcagggtcgcgtgcctgcgcgaggcgtgcgaggactacgaccgtgtgcacctcgtcatggagctctgcgagggcggcgagctcttcaccgcatctttgagcggaagcactac

SEQ ID NO: 13275 - DNA, 598 bp, Zea mays
  Clone ID: cC-zmpo14820017e07a1
gactataaggctataattagccttaatctgcctttgttcagtaaagcggcaagattatgcatacacatggctacaaatcatattcagacaagtttccacgatcctcctgtagtcctgtttacaacgaaagttagctccaagatgcagcgcatcgtccaaacgaaaaggcattcggtgttaaggtcgttgtcaagtaggtggagacgacaatttaaagcagcacatgcacagtccatgaacctagatcgcccacgccccccatactgagctcggtatacgtggttccaacgtcgcaacttcttcgagtgtatggagatgcactaccttgctgcaatgttaggtatgaccaagttcaattgctagcaggtgagaagcatgtatgatggcatgtcctggatcctctggatgtcttctagcaacagctccctctcgagctggcgccgtgtagatttaataaccacattgaaatccatgtaactggcgtgcatttcaagccatttctgatccatcagtttgaaggttatgcagtaaagaatgtcaaacgctcgatcattttctaagagtagaattaggaaaactgcttcaaccaatgacggtg

SEQ ID NO: 13276 - DNA, 542 bp, Zea mays
  Clone ID: cC-zmpo14820017e07d1
ggaacagaacgacggctcgttcctcgccgtgcgacgcctctcctgcggcgccatccaccaccatcgccaccactcttcgccggctgaggtcgtgggcgtgtccacggcgtggatcgggaaggggcttacgtcgtgcgtgtgcgcgcaggggacggagagcgacgggcgcctctccttcgatttgagtcccattcaggaagagtgcttgcataggttgcagaaccggatagaggtgcagtatgatggttcaaatctagagcatcagaaagcactggtggccctttggcatgcttcttttcctggaactgaacttctaggattagtatcagaccagtggaaggagatgggatggcaagggaaagatccatctacagatttcaggggtggtggttttatatctttggagaatttactgtatttctctaagaaatattcaaaatccttccatgagctccttcgtaagcagaatggtgatagagcatttggggaatacccctttgctgagcttggggtaaatatacaaccatgctaattcaaatgct

SEQ ID NO: 13277 - DNA, 514 bp, Zea mays
  Clone ID: cC-zmpo14820017e08a1
agaaaaaatataatgtcattcagataattttctcatgttattatcgttacatagtcaagaagaaacatagtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcagaatcgtcgccggacgatggtgctggggcgctggaggtgccatcagaagatgggcctggtgcggcggaggactcagacgacgacgatggcgctggtgcgctagagggaccggatgaggccgccgccgccggagcatcagcagccgacgcgctggcaccagcaccggacgccggcgcgtcgtcaccagacgggccgctggcgctcgcatggcccttggaagccccggcgggggcatcggcggaacccccggaaggcgtccgcgggccctaagaaggcgcttccgcgtttgaaggtggcaaggc

SEQ ID NO: 13278 - DNA, 512 bp, Zea mays
  Clone ID: cC-zmpo14820017e08d1
cgaagagagaaacgcgagcaaccagcgatcgccccatggccgccatggctcgttccgtctccctcgtcgtggcgcccctgctcctcctctccctcctcgtctccgccgcggccagcgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaaggggtccgggatggccaccttcgtgcaccgcaagtacagcgacaaggaggacagcgacatgttcaggtgctacgacagctgctccgacgacgtggaggaggccgtcgcccacctcaacggcctcgtccgggagcccaccgacgccaagttcctcgagctcaagtcgtggctcttctccacgctcggcggcacctccacctgcgaggacgcctgcaaggacctgcccaagaccagcgacaaggacgac

SEQ ID NO: 13279 - DNA, 422 bp, Zea mays
  Clone ID: cC-zmpo14820017e09a1
aatacctggctgggatgtcccggtactaatgaaaaccctgagctttcattagctcgtctatatatatatataagcaaaacatctcatcagtaaagagattagagattcgtgtctctcgcttttgcttcgtactcaaatagatatatcgtgtggcatgcgtcgctacttgggcggtggctggatccacgtgtcgccgaggacgtagtgtgtgccgacgaatggcttggcctgcgcctcggggaggtccagcgcccaccccaccctcttcttcttcttggcgtcagcgccggggccaaagcacttgaactcgccgtaatagatgccgctgctctccggcttggcgatctgccagccgtcccaacccacggggaccaccttcttccccatcttcgtgtacgagtagaccacccgggaggagtccc

SEQ ID NO: 13280 - DNA, 531 bp, Zea mays
  Clone ID: cC-zmpo14820017e09d1
cggacgcgtgggtaggtgcattgcttcggtggtccaccatggcgcagcgagcggtggccacgatgacgactaataagcccctcctcctcctcgccctggcgtccgcactccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatcttcaagcccggcgctcagttccgcgagaagctgttcctgaacatcagcaagccgttcatcacgttccggtcggaccccaagaagcccgccgtcgtggtctggaacgacactgcggccactaacggcaaggacggccagccggggggcacgggggggagc

SEQ ID NO: 13281 - DNA, 527 bp, Zea mays
  Clone ID: cC-zmpo14820017e10a1
gacaagaataaccgacacccggttgccatgtttcataatattaataatgcgcggtcactcccccctcactccctcagctcctcccgtcgcgtgcaacattatacatgtccagagatggaacgcacgcgtctgcttaatttctccgccaccacgaagacgaagattcctgccagcagccgtacgtacgtgacgtgctcccgagctccacgcccctcctctacaggacgatgtcgcgccgcttcttggggttggacggctccgggtctcctttcctcatcatcgccgcgaactcggtgtagttgatccgcccgtcgttgtcggcgttcacttccgccacgatctccttgatgtctcggccgtccagcaggcccttctcccttagggcttgctccagctcttccatcgtgatgtacccgctgttgtccttgtcgaagtactggaacgcggtgtacaggtgctcgtcgcgatccatcccgttcatgtgcatcgtcgccctgatgaactcctcgtagtcgatcgtcccgttc

SEQ ID NO: 13282 - DNA, 527 bp, Zea mays
  Clone ID: cC-zmpo14820017e10d1
catggaggacgtgagggccacctacgccgtgggcaaggagctctggcgcgggcagttcggcgtcacgtcgctgtgcacgcacaaggccacggggcacaggttcgcgtgcaagaccatcatcaagcggaagctgtccaccaaagatgacgtggaggacgtgcggcgcgaggtgcaaatcatgtaccacctgtccggccagccgggcgtggtggagctcaagggcgcgtacgaggacaagggctccgtgcacctcgtcatggagctctgcgccggcggcgagctctttgaccgcattatcgccaggggccactacaccgagcgcgccgcggcgtcgctgctccgcaccatcgtcgagatcgtgcacacctgccactccatgggcgtcatccaccgcgacctcaagcccgagaacttcctcctcctcagcaaggacgaggacgcgccgctcaaggccaccgactttgggctcttcgtcttcttcaaggaaggggaggtgttcagggacattgtcggcagcgcctactaca

SEQ ID NO: 13283 - DNA, 500 bp, Zea mays
  Clone ID: cC-zmpo14820017e11a1
ataatatgatcctaggtactttattaatttgcatgctctcttttttgtggttgatgttttcaccactagcaacaaatttggcatggaaaggagctggagcaatgtatgcattgtagtgagccacaaaatataaatcccaaaatataaattcaacaacattgcctgctcaaaggcatgcaatcccaaacatagtagcttatatgaaaaacactcaaggaataaataaaatggagccgaagggggacccagagcttagaagcacttccgatgaacaatcccaggtcctgactcgtcatactcagcctttgagatccacatctgttggaaggtgctcagggaggcaaggatggatcctcctatccagacactgtatttcctctcaggcggtgccaccaccttgattttcatgctgctcggcgcaagggcagtgatctccttgctcatacggtccgcaataccagggaacatggtcgtgccaccactgagcacaatgttaccat

SEQ ID NO: 13284 - DNA, 579 bp, Zea mays
  Clone ID: cC-zmpo14820017e11d1
ccacaacctcttctcccctgtttcctctcgtgcgttctccgcaggagcgaggagggctcgcggcagcggcagggtctccggtgtttttgttccagaatctgtagcaaatggctgacggcgaggacatccagccccttgtttgtgacaatggaactggcatggtcaaggctggttttgctggtgacgatgcgccaagggctgttttcccaagcattgttggacgcccacgtcacactggcgtgatggttggcatggggcagaaggatgcgtatgttggcgatgaggctcagtccaagaggggtatcctgactttgaagtacccgatcgaacatggcattgtcaacaactgggatgatatggagaagatctggcaccacaccttctataacgaactccgtgttgcgcctgaagagcaccctgtgctgctgaccgaagccccactcaacccaaaggctaacagggagaagatgacccacatcatgtttgagacttttcatgttcctgccatgtatgtcgccattcaggctgtgcttttcctgtacgccagtggacgtacaactggtattgtattggactctt

SEQ ID NO: 13285 - DNA, 331 bp, Zea mays
  Clone ID: cC-zmpo14820017e12a1
gggcaaatgaaatctatattcactcacaatgttagactacaacacgacgagtttacaagtagatacaacccacaactacggaatgggttccctcctatgatacattgcatacatgcacggagctatgtcacaggcagtgtagctaaaaaggcatctagctttacattatcggtacgagacatgaacttgatgcagatgggcgcccgcgcatgcatgagtgccatcgtggatgacaagagcatccctagcccgtccccacagatcattcctgacgccaccgccatcgagaacgtctgcgccttgctagggtcggcacgccttcacaggtaca

SEQ ID NO: 13286 - DNA, 545 bp, Zea mays
  Clone ID: cC-zmpo14820017e12d1
ctgctctgccatcacattcagcggagggtttggcacgtacgtgctcgccatgggcaagaacgcggccggaggagacgtcagggacggcaagaacatcgtggagccgagcattggccgaacggttgctttcctcttcctcgtcagtttctccggcatgttcatcctaatgccgttcaggaaggtcatgatcatccggcaccgcctcacgtaccctaacggaatggccacggcgcacctcatcaacagcttccacacccctcagggagccagtaagacagcaagtggagatgctgtttaggtcactgggaggaaccatgctgtggaacatgttccagtggtttttcgctgctgcaaagggctgtggcttcggagtgttccctatctttggcctcgaggcatataaacacggattctacttcgacttctccatgtccaacatcggcatcggcatgctgtgcccgtacaccatcaccgtgtccatgttcatcgggagcgtcatctcgtgggggcttgtcttgccgtacctcgcgaccaaggcgggcgtc

SEQ ID NO: 13287 - DNA, 503 bp, Zea mays
  unsure at all n locations
  Clone ID: cC-zmpo14820017f01a1
gtcgtcgctgtccttcttggtgtcgatgacagtctcgaaggcgccgacgagcgccttgaccttgctccgacgcttctccagcagcttcgtgcgcgcctcctcgatcacgtcggtgctccgcgccacctctcggcgacgcggctgctccgactccgctcgcgcctccaacgccgtcctcacacggctgccctggaacctccgcattgcctcctgcttctcgtcctcctgcgcctgctgcttcttgatcgcctccttcacaaccgtcacgaacttgtccgccaccacgtcttccactgctgctacggcaacgatggcctccggcgccggcgccggcgacagagccgcttcttgcttgggcgattccaccacctcctcctcctacttcgaggttgcggcggcggcggcggcgataggctccggcgccggcgacagagccgcttctttcttgggcgactccaccttcttctactactnctactttgaggttgcggcggtggcgatga

SEQ ID NO: 13288 - DNA, 535 bp, Zea mays
  Clone ID: cC-zmpo14820017f01d1
gtcttctttcacctctccaacatgaaggtcaacaccaagatcaagctggagccggtcatggcgccgtcgtcgtccctgccggggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccgatgaagcggcggcggctaccgcggtgccgcctgcaggtgccagtgccaagaccttcagcagcaacgatgcccgcgacggcgccatgggcagcgtgc

SEQ ID NO: 13289 - DNA, 395 bp, Zea mays
  Clone ID: cC-zmpo14820017f02a1
aaaattgggtcagggcactttcatgtttgaacaggcaatacacggtgaataaattgccatcatatgctgattggatcactctgggctcaatttaacgagagaaattctgactcaagtgtgaccggcagggtgtcaggcaggagatcgggtggtgacgacgaagcaaccaaccagttacaggtcatgaggggccagggccgaggatcatgaggtggggctggaactgcggcaggttgtcctcgttaccgtcgccgtcgaggtctatgcctgcgtccggtagtaccatccctacgcccttgggcttgcacgacttgtccgtggccgggttgcacccgtaggtggagccgcctggaattcgggacgccttggcagcagcgtctgcggaccttacgagc

SEQ ID NO: 13290 - DNA, 578 bp, Zea mays
  Clone ID: cC-zmpo14820017f02d1
agccacttcagtgcttgcgatcgcgtcggccacgatctcttgcgaaaaagcttaccctgtgtctgtctgtccgaccgtcagggcgtctaacaatcgatttccatgacgacgtccccgcgcgtgtggctgctcgccatggcactggcgctcgcctgcgtgctgctcgtgaggtccgccgacgctgctgccgaggcgtccccgactccaggcggatccacctacgggtgcaacccggccacggacaagtcgtgcaagcccgagggcgtgggggtggtgctgccgggcggcggcatcgacctccactgctacggtgacgaggacgagctgccgcagcttcagccccacctcatgatccttggccatggccactgatgagtgtaaatggctggttggttggtcagtctcagtcgatctactggacgacacgatggcggtcacattcgcgtccgaatttctcttgttaaattgatgcccgaggggattaatgagcatatgatggcatttattcaccggtattgtctgttcaacataaagtgcactgattcaatttaaaatccttttatatatacctctaaaaa

SEQ ID NO: 13291 - DNA, 389 bp, Zea mays
  Clone ID: cC-zmpo14820017f03a1
gaataagcccccaaattgggggggctcggcctaaaaaaaatcccctcgggggggtttgggatgaccccaagaagaaaaaaaactcccaccccccggggggctggtgggggggagacgtggaattgccggaaaaaagggggggttcccaagggggattttttttataagatctgcctttttgctaattggttcaaatgccggcgaacctctttgccaaacccatggactttcccatgggggttttgcaaacggccctggttttgttgccggatccatttggcttgagttctaccttctccagacttatcccctggcatggaaggtttttggcccattttaacgtgatggccccccgcctattgaaggggccccggatgtttttgaaaacc

SEQ ID NO: 13292 - DNA, 559 bp, Zea mays
  Clone ID: cC-zmpo14820017f03d1
gacaaagtgacggtcaaggcccccggcgacagccccaacacggacggcatccacatcggcgactccagcaacgtggccatgagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagatcatacacggcaccttcaacacgccggaggccatcacgctcaactgcgccaacaacctgccatgccagggcgtgcagctcgtcaacggttacattcagtacaatg

SEQ ID NO: 13293 - DNA, 423 bp, Zea mays
  Clone ID: cC-zmpo14820017f04a1
caaacaacaaacttattcatgatttgccatagttctgggtagtacgcacacacaacacaaccggtccatttttaaaccaacactgacacgaacagcagatacttcgacaacctccatatggagagggcaccaaacgacgcaggcacatgggcagtttaaacgacccatgacttactgaccaccacggagacggagcacaagggggagggggctctccttttggatgttgaagtctgctagggtgcggccatcctccagctgtttgccggcaaaaatcaaacgctgctggtccggggggatgccctccttgtcctggatcttcgccttcacattgtcgatggggtccgagctttcaacctccagggttatggtttttccagtcagggtcttcacaaagatctgcataccacccctgtggcggaa

SEQ ID NO: 13294 - DNA, 492 bp, Zea mays
  Clone ID: cC-zmpo14820017f04d1
ccttgaggtggagtcttcggataccattgacaatgtcaaggccaagatccaggacaaggagggcatccgaccggagcagcagcgcctcatcttcgccggcaagcagctggaggatggccgcaccctggcggattacaacatccagaaggagagcactctccacctggtgctccgcctcaggggtggcatgcagatttttgtgaagacattgactggcaagactatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcaagggtgggtatgcagaactttgtgaagaccctgactggaaaaaccataacccctggagggtgggagctctgacaccatcgacaat

SEQ ID NO: 13295 - DNA, 537 bp, Zea mays
  Clone ID: cC-zmpo14820017f05a1
aggaacatgaccaacacccgcagggttgtatcgggttgtatataatatacattattatattatagttacagggaagacaagaaaaagcccgtgcttaaaagtaggcagatcggcgaacatattaggcagaaaccaaggcgtggagtcatcagttcttgtgtcgcctctgaatcccatggatctagccttgcagcagttaataatagctcgcacgtctgatgaccattttgatcaaatgcgtcaggtgtcatcaacggtgactattgttggaacttcttggtcagtgaaatcgatcttgttcaacctgacgcagcagaggacctgctcagggagctccgactgcttctgggcctggatcgttaaccccagatcgaggatgccgttcttgaggcgtgccctgaacgagtccagccccttcctagcaatgtagctgaaccggtggatgtcaaggtccacctcaaggtagtcctctccctgtagaagctgtgcttgggccgccagaggactggcttctcgttgtacgcctggacagctttc

SEQ ID NO: 13296 - DNA, 468 bp, Zea mays
  Clone ID: cC-zmpo14820017f05d1
cgctgcctactatccgataggcgttgacctgtttgcctgccccaagaaggtccatcacatcgcccagcagctcgaccttccgcagatcaagacgcaccccaagatcccgtcgctcctcatcgtgaacatccagatgcctacctaccccgctgctatgttcctcggcgacagcgacggggaaggcttgagcctcgtcctgtacttcagggtgtccgaatgctacgacaaggaggtttccgaacatttcaaggagtctatgatgaggtttttcgaggacgaaaccgagaaggtgaaagggttcacgtcagaatccactgtgagctacagagatcggctgaagatcatggccggcctggtcaacccggacgacctccagctgggctctacggagaggaagctcgtccaggcgtacaacgagacgccagtcctctcgcggccccagcacagcttctacgaggtagaggacta

SEQ ID NO: 13297 - DNA, 548 bp, Zea mays
  Clone ID: cC-zmpo14820017f06a1
aaacagtaatcagccaaacttaatgaagcgtaataaagtccaattagcagggaaaggataatcagctaatacattatgaccacattcctacaccataatcgaaagaagcaagaaaaaacacgaaagcagaagataagctttacccacagcaaacaggaattcctctgccaccggctctatactgtatgacctgtcaacccaatgatccacatcaatctcggatagtgggttcacgatagacctcgaccgaacgtgcagggagctcacatcgcaaccgaatgtacagggagctcacaggccaaacagttctgctcagcgcaggtggccattaccattcggcttgaggtctgatgatccaaaaacgcagtgcccgttgcgcttgggtgagtcagcagacccatacgcatggtggccgttccgcttgggtgagtcagttgaaccgtttgtgcggtggccattctgcttggaggagtcagcggatccgtttgtttggtgaccattctgttgatagagtcaggtgatccatagccataagggttcttgctggc

SEQ ID NO: 13298 - DNA, 547 bp, Zea mays
  Clone ID: cC-zmpo14820017f06d1
gactatgcaacaagagatgggactggggtccgagattacatccatgtggttgaccttgctgacggacatattgctgcattgcagaagctttttgagaactctagcatagggtgtgaagcgtacaaccttggaaccggaagaggtacatctgtgctggagattgttaaagcatttgagaaggcttctgggaagaaaatacctctgatttttggtgaaagacgcccaggtgatgcagagattctgttttcagagactactaaagcagagagggagcttaactggaaagcaaaatacggtattgaagagatgtgccgcgaccaatggaactgggccagcaagaacccttatggctatggatcacctgactctatcaagcagaatggtcaccaaacaaacggatccgctgactcctccaagcagaatggccaccgcacaaacggttcaactgactcacccaagcggaacggccaccatgcgtatgggtctgctgactcacccaagcgcaacgggcactgcgtttttggatcatcagacctcaagccgaatg

SEQ ID NO: 13299 - DNA, 456 bp, Zea mays
  Clone ID: cC-zmpo14820017f07a1
caagaacacaagaacgaggatgattttttagaccttgataccatgagtcgatacagttaactaacaacatgataacacattgaaaatcaaacagaaatgaaaaagagggagagcaaggatgtatccatggatgaccacacattattatggattcatggttataaagacatcgctcatatattgcttccatgtcttggtccaaatttaaccgggccgacatgtgtggcctcagttggtggagtcatcatcgtcatcctcattgcctgacaggccttcgacaccctgggggccaggtgcagcagccggcccgctaggtccatcggccggcgcgtcagccacaggggcatcggcagactttgcctcggccatcggtgctacgaccatggcgacgaataggagagcagcaatgacaaagacgacgctagcgcgagccatgggtacggtgtctagctttta

SEQ ID NO: 13300 - DNA, 484 bp, Zea mays
  Clone ID: cC-zmpo14820017f07d1
cacagagacaccaagcgttgaactcgcctaagcagctaccaaccaaccctagaaagctagacaccgtacccatggctcgcgctagcgtcgtctttgtcattgctgctctcctcttcgtcgccatggtcgtagcaccgatggccgaggcaaagtctgccgatgcccctgtggctgacgcgccggccgatggacctagcgggccggctgctgcacctggcccccagggtgtcgaaggcctgtcaggcaatgaggatgacgatgatgactccaccaactgaggccacacatgtcggcccggttaaatttggaacaagacatggaagaaaaatgagagcaatgtctttaaaaccatgaatccataataatgtgtggtcatccatggatacatccttgctctccctctttttctttctgtttgattttcaatgtgttatcatgttgttagttaactgtatcgactcatggtatcaaggtctaaaaaata

SEQ ID NO: 13301 - DNA, 340 bp, Zea mays
  Clone ID: cC-zmpo14820017f08a1
aggtgaaccgggaaaaaacctgttttgggaccggacctgtccctggatctttaaaggccccaggggccctgaaaaaaattccccacaggatttaaggggggttcaatgggggatccaaatgccgacgggcccattgtacattgggcgcaacccgttatcctttattggcccgggagggaaccctgacccctttggaaccaattgttcccccccattgggcgtcccccaacagggcctgggaatacgggcttcacgaccatgcccaatttccacggccggccccgtggcccggaacctgggaaggcccccccccgtttttgggaaaaccaattgggggggg

SEQ ID NO: 13302 - DNA, 532 bp, Zea mays
  Clone ID: cC-zmpo14820017f08d1
gcattacgaggccaaaagtaagctgctgctgttcttcgacccgtcccgttcgttcgattcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcctcgccggccgatgaaggatgaacggttgcggccgatgatcgatgtgtccgtcggcatgtcgatcactcattgaaaccccctcttatcctgtgcggcattattttcattgcacctgtggccattaaagatccatggacacctacagtaccaatacttgattctttacagttcaactttctct

SEQ ID NO: 13303 - DNA, 402 bp, Zea mays
  Clone ID: cC-zmpo14820017f09a1
aaaaaaaatcgtttaaattattaaaggggggaccccctaaaattacaaagacaaaccaaggggacaaaacaaaacaacccttgggttattggcccctccccatccgaaaaagctatttcccaaaagccaaattcgggcccccccttaaaaaaacgggcccgggggaactcagaaaaaaaatatgggtaccacagtagggggaaccccccggagggggactccccttccaaggggaccacccccgggggcataaaaatcccgggggccctataaaggcccataaagggggggggacccccccttggggggggattcccaagggaaaggggcaaaacccttgttcgggagaaaaaaccgggtaaaaggggggggtgtccgatcggaaattggaccaaaatttcc

SEQ ID NO: 13304 - DNA, 461 bp, Zea mays
  unsure at all n locations
  Clone ID: cC-zmpo14820017f09d1
cccacgcgtccgcccacgcgtccgggaagtctggtccagctgccgcgccgaccaccgccgcctctacaccgtcttcttccactnacaaataattgaacggttggccgtcgggatggcaccgggaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccagggaccgtgtcgtccagggtgggcacgtagttggctgtgcggtaattgctcgtctggtcgggagggaccaataacgcacgtgttgctttgctttgctcacttcgtttgctcttgtaactttatggggtcaaccgttattataactgaaacgatttgatttaaaaaatatacttctgaccctttagtctccctctaa

SEQ ID NO: 13305 - DNA, 470 bp, Zea mays
  Clone ID: cC-zmpo14820017f10a1
aaaacaaagggagtatgttaagattgtgttgtatcgtgtacttaaaaaacaggatcctatcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcaggtcacctggttgttgcagcagcaggagcaggaccaggagggaagttcacccactgcagcttgagctgtatctccccgcgtttgacgttcctgagccggaggatcatgtcctgcgcgaacttgccgttcctccagcacacgtggcttttgtcggcgaggcagttcctggcgctcggccgctcggacctgatgatggcgccggtcctcagactctcctcccgcgggttcatgctcacc

SEQ ID NO: 13306 - DNA, 578 bp, Zea mays
  Clone ID: cC-zmpo14820017f10d1
agcgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccacgtgtgctggaggaacggcatgttcgcgcaagacatgatcctccggctcaggaacgtcgagagcggggagatacagctgcagctgcagtgggtgaacttccctcctggtcctgcttct

SEQ ID NO: 13307 - DNA, 218 bp, Zea mays
  Clone ID: cC-zmpo14820017f11a1
cacgccaaatagctacgctcatatcagaatataaggccactgggcaacagaccatgacgaagaccaaaccaccgtatgcgattctaacaacgctgttctttctcgggctggctggtatcctcactggaggccgacttgtggcactagaaccaggatccggccgacatttatcgccattggagaccgaagcaaaacatgcggaatcacatttagagggc

SEQ ID NO: 13308 - DNA, 188 bp, Zea mays
  Clone ID: cC-zmpo14820017f11d1
acgaggatggcgtccacgagatcaaggacgctgctgccccaaactaatctgagaagggtcagtgagatggattcagggttgcgacccgcttctgctaatgctgaggacacatactaggacagcactttaaacatgcaccctacgggccacaactttgccctatcgacttccgaccccaactaggatgg

SEQ ID NO: 13309 - DNA, 456 bp, Zea mays
  Clone ID: cC-zmpo14820017f12a1
aacataaaatatatgtttatgggcgtgaagcttcgtacatgacagtcaccaaaacataataatgggaatatactgcatacatgaataaaataatgaaccttgagtacatgaacaagataatgaaccttgagctcattagaagataattcatacatgaacaaaataataaatattgagttattcataacatacttaatacatgaacaagataatgaaccttgagcatacatgaacaagatacatgacagtcatcagaatatacatgacagtcaccagaacatacatgacattcgtcataaataagaacgagataatgaacgttattaagaataggttgtcgatgcatggcaagcgatcgagcgatcttgtttagcactgcctattgcaaatgcagcggcggcggaaggtgctgcacctgccggccaagaagccctcaccgcggcacacattggcgca

SEQ ID NO: 13310 - DNA, 479 bp, Zea mays
  Clone ID: cC-zmpo14820017f12d1
cccacgcgttcgcccacgcgtccggtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcacctttcgccgccgcttgcatctgcactaggcagtgctaaacaagatcgctcgatcgcttgccatgcatcgacaacctattcttaataacggtcattatctcgttcttatttatgacgaaatgtcatgtatgttctggtgactgtcatgtatattctgatgactgtcatgtatcctgttcatgtttgctcaag

SEQ ID NO: 13311 - DNA, 505 bp, Zea mays
  Clone ID: cC-zmpo14820017g01a1
cctacaagaacgcctccccccgtagggcggcccacacatgtccggaagccccggttttgttgggtggaaaaaaggccgggggcccccaggttttagcccccccggccccctcccccagaaccccgacccacgggccgcccccagccccagccgggggccaacccctcaaacgaaattttccccaaaccccgccccaacgcggaaaatcagtttgggccccgggacccccttccccccaaagccccccccgtagcacgccagcatctccccgggccggaagggccccccccccaaaacctcgccgttcacacggcactccccgaaaaaggcctctgtggcgccccccttaaccccccaccccctcagattttggcccggaaacttttcccacaggggttccccaccggacccccccctgttacctcttttccgggcatatccccccccccccctggtccccccgaattcccggccccccccgggcgcccccctttcccctgggggc

SEQ ID NO: 13312 - DNA, 456 bp, Zea mays
  Clone ID: cC-zmpo14820017g01d1
gtcggcaatcaccccgacaacagctacaaccagagtgcgctcccgatcgtcgacacccttatggtaaagaatgtccagggccagaacgtcagggaggctgggctgatcaagggcatcgccaactcggccttctcccggatctgcctgtcgaacgtcaagttcactggtggtgcgcctgtccggccgtggaagtgcgaggctgtcagcggtggcgctcttgacgtgcagccgtccccgtgcacagaactgacttccacgtctgggacgagcttctgtacaaattcgctttgatgctttgccagctagctgagcctgagctgctgctatgcttctgtatctacgagtatgtatactggtgctttaaagcttgggcacccaagtatttatcttcccgaaaattaatttggtttccggaatttatttgaacctctatacgaagagaataattcttgaaaa

SEQ ID NO: 13313 - DNA, 502 bp, Zea mays
  Clone ID: cC-zmpo14820017g02a1
agggttgaatgggatgcccttagctgattaattggaggtagaccatatcaacatatttctcctaaaatcttaaataaataatttatttagtttatgtaataatatcaacccaacacaacaaggcatcagaagggacatgtagcatcacatatttcttgggtggtttggtgccacaaaataaccatagaaaaaatattgtcttgctaacatgagcaccaggtgagctcttttgaaatataattcatcatcagaggctgattagatgctgagtgtggtcttataggtggtgccggccttgaaatcagcggggatgacgtcgtcagcgatgcggtagccaccggacttgacagcaaagcggatgcaaagggggtacttgagcggggccttggtgtcgagcgttcaggtgccggtcgggccctccttgagcgtaaaggagaagtcatcgcccccgtgcttcttgatctccacgtcggatatgggtgcaacattgggggtgaggatc

SEQ ID NO: 13314 - DNA, 607 bp, Zea mays
  unsure at all n locations
  Clone ID: cC-zmpo14820017g02d1
catcaaagaaacaggcacacaagaacaaatacctggctaccaacaatggccttcaggtcctccatcctacttgcaacgtcgatgctggctgcgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcatccccgctgatttcaaggccggcaccacctataagaccacactcagcatctaatcagcctctgatgatgaattatatttcaaaagagctcacctggtgctcatgttagcaagacaatattttttctatggttattctgtggcaccaaaccacccatgaaatatgtgatgctacatgtcccttctgatgcctngttgtgttgtggtgatattatacataaactaaataaattattattaaagatttaggagaa

SEQ ID NO: 13315 - DNA, 482 bp, Zea mays
  Clone ID: cC-zmpo14820017g03a1
gtcgttgtacttgtagcgcgcacagcgtcacatcttgggcatgggcataggcatggcgccgccaacgtcggggccgctgttgtacgcgtcgcagcgccgcctgacctcgccgtcggcgccggtcttgacgccgaacaagctgagcttctccatggcgcggccgaagtctgtgaagaaggcagtggggttggacgcgtagagcgtggccaggggcttggtgcgggggtgcggccacagctcctcgtgggtgctgagcagtccgaggccgcgcttcaggttgacgaagtacatgttgtcgaacttgccgggagtcatgatgtcgttgaacgcggcgatggtggggtccttgaggtagtccttgcacacgttctgcagccccctggcgtaggacgggttcatgctggggtcgaacggctccggcttcccgacctggctgcggaagatggagaggcggacggcgaactccttgcagtgggagaagc

SEQ ID NO: 13316 - DNA, 518 bp, Zea mays
  Clone ID: cC-zmpo14820017g03d1
agccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagaggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggcccttggagctggagtgcccccgggtggtgtcctgcgccgacaatcctcgcgctggcgtcgggggtgctgggcaccaatgaccggcggaccctggtacccgatcccgctggggcggcaggactcgctgtcgtcgtcgcccacagcgcccgacggtgagctgtcacacg

SEQ ID NO: 13317 - DNA, 124 bp, Zea mays
  Clone ID: cC-zmpo14820017g04a1
gatcacaactggataacatgtcatttgagtttgcacatttatttacatttctttatctgcactaccaaattcaaacactagcgccacatacactacatcccatccacactcccacactcatcac

SEQ ID NO: 13318 - DNA, 299 bp, Zea mays
  Clone ID: cC-zmpo14820017g06a1
ggcgccggaactgtagacttcataaatcaggaacccagatatgggaaaaagttttaaaattacatgatttttgtaacaaagtacagactatatggatcagaaaccctgatctggatcaagaagcagcaaaccgagatctgaactgatcaagaagcagcaaaccgagacctgaactgcgtcgcgtaccccatctaccacaaattatgacgtccactctcccacttggggagatggtaagccaacgcatccaccaagtgcaatgtgggccattgatctaggccacgggccttcttgatagc

SEQ ID NO: 13319 - DNA, 299 bp, Zea mays
  Clone ID: cC-zmpo14820017g06d1
gctatcaagaaggcccgtggcctagatcaatggcccacattgcacttggtggatgcgttggcttaccatctccccgagtgggagagtggacgtcataatttgtggtagatggggtacgcgacgcagttcaggtctcggtttgctgcttcttgatcagttcagatctcggtttgctgcttcttgatccagatcagggtttctgatccatatagtctgtactttgttacaaaaatcatgttattttaaaactttttcccatatctgggttcctgatttatgaagtctacagttccggcgcc

SEQ ID NO: 13320 - DNA, 333 bp, Zea mays
  Clone ID: cC-zmpo14820017g07a1
ttttttttttttttttttttttttttttttaattttttcttcgtggtatttttatttttttttattttaatttttttttattttttcttatttttttttcccccaaaaatataatcaaaatttttaaaaactctaaaaataatacttggaccaacaaaaaaaaaacacaattaaaaaataactaataacccccgcacaaccccccttaacacatccctattaaaaaaaaaaaagcggggcgtccccaaaaaaataaaacactaatccccggaaaaaaaaattttttttcagagaaaaaaaaaaatccagtggccaaccccccttgcccagggg

SEQ ID NO: 13321 - DNA, 432 bp, Zea mays
  Clone ID: cC-zmpo14820017g07d1
ctcgtcgccacgcagtgatctatccccatggccatgcgtgtgtgtcccgctgtttcgtttcttccctgacatgacgtgatttctactccgctactgatgattcattgattccggccgcccccgcattgttcattatattaggtcgacgtctgcgggcgcgtgcgggggatccatccaaatctctcactctgctattgtttctgtacgtccaagattataatgatactcataataatctcgtcgcaactttcgcgtgaaaaaaaaaaaaatcaaaaaaataataaaaaaataacatgcaaatcaaataaaaacataaccttaaaattaataaaaatatgttcactcatcctctaactatgggggggtctttctataggatccaagttttttttccccgggctttgggaagtcatattttttttattgggcccc

SEQ ID NO: 13322 - DNA, 450 bp, Zea mays
  Clone ID: cC-zmpo14820017g08a1
gctcaaaatagtattaataagggaaatggtcgattacatcatacgtctgagacgtccatatagtccttacaataaatcaaagtgcggaaaagaaacgtagataacgcggccttcacaggcagccgactgggggttgccgctaacccacacctagaactcgtcgtagtcttggaactcctggaagtctccttccacggcttcatcttcgcctgagcagtggttgcaatgctgacaaccttcaccaaacagatgctcagggtcttcaactttgtagaattcgaagagtttggtcacttggtcgtcaaagcttgattggcgattcctcgaagctcggaaacagatcacgatctcgacgtgacgacgcgacttcgacggcggcggacggcgcgacagcaggagcagcgccgcacgacgcgacttttacaacggcggacggcgcgacagcaggca

SEQ ID NO: 13323 - DNA, 539 bp, Zea mays
  Clone ID: cC-zmpo14820017g08d1
gtccggcgcgctctccacccggcgcgccgtgctcatcgtcatgcggaggagccccgtcgagccaccggtgttcgcgccgggccgcgctatgcctgctgtcgcgccgtccgccgatggataagtcgcgtcgtgcggcgctgctcctgctgtcgcgccgtccgccgccgtcgaagacgcgtcgtcacgttcagatcgtgatctgtttccgagcttcgaggaatcgacaatcaagctttgacgaccaagtgaccaaactctttgaattctacaaagttgaagaccctgagcatctgtttggtgaaggttgtcagcattgcaaccactgctcaggcgaagatgaagccgcggaaggagactttcaggagttccaagactacgacgagttctatgtgtgggttagcggcaacccccaatcggctgcctgtgaatgccgcgttatctaccgtttttttccgcactttgatttattgaaaggactatatggacgtcttagacgtatgatgtaatcgactatttcccttaataatactattttgagc

SEQ ID NO: 13324 - DNA, 530 bp, Zea mays
  Clone ID: cC-zmpo14820017g09a1
aaccgttcaaatcacaagatactttgactattattctcgaaaacaagaaatacataaatatcgtatattacttcatgcaaggaaaacatgtggtgaaagacaaatcagaacaacgattcacagtcatttcatagtatgataacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggccgtccggcatgccgcgccccgcgcaagtgtcgtcccggcagttgtgcgtcttggtgcagatgacgcgggtgtcggcccaacagtcctcggaatggacgggcaggacaaagcctgtgttgatgagaagcagcagaacgaggaggccttgaaccatcgccttgctcgtcggcttcatttcgaggg

SEQ ID NO: 13325 - DNA, 591 bp, Zea mays
  Clone ID: cC-zmpo14820017g09d1
gcagcatccatcgcgtgcgtacattaatctaagcgatcttcatccagccttctgctctgctccctccaaatggaggcgacgagcaaggcgatggcttcaggcctcctccttcggctgcttgggatcaacacgggctgtgtgctgcccggccatgccgaggactgctgggccaacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattgtgggatatttgttatcatactatgaaatgactgcgaatcgctgctctgaattgtctttcaccacatgttttccttgcatgaaagaatatacgacatctatgtatctcttgcttccgagaataatatccaaagtatcctgggatttggacggtt

SEQ ID NO: 13326 - DNA, 317 bp, Zea mays
  Clone ID: cC-zmpo14820017g10a1
gtcaaattaacacaaatcaatggacgacatatatgacagatcaccgtggtcaaacaaattttgtcgagaatttaaatacgggtatatatatagagagaagctacgcacaacgacagcaatggcagtagtttttttcttttctttttggggtgtgtatgtgtaattggggggggatatactgtcggagggccaccggctgctccaccgtccaacggcacgtacggccgcgacgacgacgtcaatgtatggtgtgcgatcggtggagccaggctgcgtgacctggcaggcaggcagaccagaccagaccagaccgaccg

SEQ ID NO: 13327 - DNA, 599 bp, Zea mays
  Clone ID: cC-zmpo14820017g10d1
gcgaaccaagagagcagggtgtgggcgaagagaccccagccagtctatcgttcaagaaaaataccagcttaccaacaacatcatcaacaagcccacccgttcgactacatgggccgcctcggcgccggcaccgtgtgggcgctcctagtgacggtcgcggctgtggccactttcctcgcggtgccggcctcggcgaagtccggggagctgagcgcgatggggttgctggcggcgaatggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcatcggaagccgaccaaccggtacatcagctacgcggcgctgcgcgcggaccatgtgccgtgcaacaagcgcggccggtcctactacagcaactgcgaggcgcagaaggccgtcaacccctaccgccgcggttgcttcgtcattacgcgctgtgcccgcaacatgaactgaacccagcgcttgctgctgccggggcgcgccgtcgtcacccagccggtcggtcttgacttgtc

SEQ ID NO: 13328 - DNA, 518 bp, Zea mays
  Clone ID: cC-zmpo14820017g11a1
atattactatagaaaaaaaggcgagtacatgcatattatgtattttctgctgggagtaaaaggtgttgtaaacccatggaactgaaaagtacgagcaagccagaaaatacgaacgggccatcgtgtcatggtgctaccaggtagataaactctggagctatagcatggcaatctgcattgaacgataccatattctatgtcccgttcaatgcgtgcgtgcgcgcgcagacacgacgcatggtggccgggggccggcgggcagcggcgcccaacacgcaactaaggggcgatgacgggggcggggcttggagcacgtgactcggacacggtatccttggccaccttacccttacccaccaccactgcttcgacgggcttgcgcgggatcatgttggaatcctcatgggttgccgctgatggcttgatcttgcgcttaccacccttgccgcggcggccgggcgctgtgacggtggatggcaacgcggccggcaaaatgggcttgctgacttcatgatgga

SEQ ID NO: 13329 - DNA, 481 bp, Zea mays
  Clone ID: cC-zmpo14820017g12a1
agacagttcaatcacacacacacatatatatatattgttctgggtttacaaaccatacgacaaccaaactttaatttggggatggaatcacaaaattatttgccaaaatgcatggtaccaacaaggaacaaaaatctctggtgatcggcgacgggcaggggagaaatggcagaccaaggatgagagatgattaacagagccactcataatccaaggacgtgtaggggactaaaaatgcgtgcgtagctagaggaggctaccaattaaataatgctggtgttggtatcgttgctgctgctggatgctcgcacattaaatgaatccattcacaggccttgctctacgaagtagtcgccgagcctctcgaccaccatgttgcactggccgggggtcatgggctcgtcttaaatgcccaccaccatcgcttgccctgtcttctttacagttatgccttcagaacccttttttccgggatgacagc

SEQ ID NO: 13330 - DNA, 508 bp, Zea mays
  Clone ID: cC-zmpo14820017g12d1
ctttcgttatcctcctcgatcttaattacaggtcatagctaagcatgtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctgtgaatggattcatttaatctgcgagcatccagcagcagcaacgataccaacaccagcat

SEQ ID NO: 13331 - DNA, 262 bp, Zea mays
  Clone ID: cC-zmpo14820017h01a1
atcatcctgatagtttgttttacgccctatgacgatacaatacacgggcgggatactgaactcttgttctatacaggcacaaccctcttgcgttgatcttccacttggatggaaaaaaccacaaagttgtctaatattccctaatccactcttcagaattttgggcaggcacgcgggtagacgttctgttgcctttcctttttcaggcccctatttgcaatccagatgaaaaggacctgggggttaaagccccccaatttgt

SEQ ID NO: 13332 - DNA, 350 bp, Zea mays
  Clone ID: cC-zmpo14820017h02a1
gggtaaagacattatcgcacacccgtattttaaatttgggaaatttgagaatatgactagctcaccctcgtccgtcggcggtagtgcagaccccacgtgtcaggttgaagaatattggggtggtcgaccgggtgttggtgttacacgttcggacgttggactcaccactctgttcaacttgggttctagggaatattcatcgtttcgaattttcaccgggggcatatcacatgcatttatcgatgcgtcaacgtgcacgaaactagcttagtcaaattgccatgccacgtacagtgggcattgtgtgtaaagttttgacctacgatcggggatcgaccttaccatcccct

SEQ ID NO: 13333 - DNA, 372 bp, Zea mays
  Clone ID: cC-zmpo14820017h02d1
tgactttttgggtggtaccatcgcgttcgagatgatcctgttgtacgaatacatgcacaactgcgtgttcctgtaccacatctacggtagagaggggaaggcgcggctggcgtgcaagcagcggctggagatctgcatcggcgctgcccgggggctgtcctacctgcacacggtcactggtcttgggatcatccaccgtgactcgatcaccaccaacatcctgctgtacgacaactttctggccaatgtgtcggacttcgggctgtccaatgactggcccttcattaaccacctgcactgtgatcaccgccgtaaagggcatctaccggttcctggaccaggagtactaccggtgccagcagttgaccgaca

SEQ ID NO: 13334 - DNA, 262 bp, Zea mays
  Clone ID: cC-zmpo14820017h03a1
gaactgggaagaatcatgttttggaactgtacgtgtccatggatctttaatggccacaggtgccatgaatattataccgcacaggattagagggggtttcaatgagtgatcaacatgccaacggacacatctatcattggccgataccgttcatccttcatcggccggccaggcatccatgaccccatgcgacgcaaatgttcgcgcctattggcagtccgccaacaggcacctgtcaataccggcttcacaaccatgccca

SEQ ID NO: 13335 - DNA, 544 bp, Zea mays
  Clone ID: cC-zmpo14820017h03d1
acccacccgttcgcggacgcgtggggagcatcattacgaggtcaaaagttagctgcttctgttcttcgacccgtcccgatcgtccgaggcgttctttccgccatggaggctcggaggaagcccgtggtgtgctgtgcccttcttgagctgctcattgttttcttcatctcatcggtgtcgactgctcatgactagatcttctgtaaggactactaccaccaccctattttttttcccatagactgtgtggcgacctgtcaggatcacttccacgccttcggccgctgcaactgggcatggtctaggaggccgtatcttgccagtgcctgttggctgactgcccatatgcgcgaacagctgtgtctgcttggcgtcctggctgcctcgcctgcctattaaagatgaacggttgctgccgatgatcgttgtgcccgtcagcatgtttatcactattgcaacccctcttaacctgtgcggtatcatttttatggcacctgtggtatttaaataccttggtcaccttccagaccaattcttgattttt

SEQ ID NO: 13336 - DNA, 292 bp, Zea mays
  Clone ID: cC-zmpo14820017h04a1
ccatgaaccattatccattcttccatccatcaaaaaaaaaatcagttcttgggaccaatttaaaaaatggagcctgccggttttgatggccgactcggcctaaacttattcttacaaacgggacaggggtacccttttgaaatacccatgggtaaacgggttacgattattgcttcccaaacccttacccgtttacccaatggggggaaattttggcccatatccatacccactgggacaattttgggctaatacccgtaccctaataggggaatcccccaagggttatccg

SEQ ID NO: 13337 - DNA, 365 bp, Zea mays
  Clone ID: cC-zmpo14820017h04d1
cgataacccatgaggaattcccctattagggtacgggtatgagataaaaattgtcccatgggtatggatatgggagaaaatctccacccattgggtaaacgggtatgggtttgggaagcaataatccgaacccgattacccatgggtattttatacgcgtacacctgtcctgtttgtatgaatgagttgaggccgagtcggccatcaaacccggcaggctccatttcttatattggtcccaagtactgatttcttttctgatggatggatgaatggataatggttcatggtaacaacaaaattacaatatacaattggataactaactatataatattatttcagctattttaataccatcattg

SEQ ID NO: 13338 - DNA, 250 bp, Zea mays
  Clone ID: cC-zmpo14820017h05a1
atataaaaacaaccaaaaaacccccccacaaaaaaaaaaaccccccaaaaactctacaaagagggacacaaatttaaaaattaaaaaaccaactaacaacccaaattaggacacccccacccccacccaacaccacccacaacaacgaaaaacgggatgccaaaaaacccacagctaaaggaccacaaaactcagagaaacataataccccaaaagctcttccccaaatggaaaaactttataaccccgg

SEQ ID NO: 13339 - DNA, 390 bp, Zea mays
  Clone ID: cC-zmpo14820017h05d1
cgtacaccagcgagggcatggacgagatggagttcaccgaagctttgagtaacatgaacgacctcgtgggcgaatagcagcagtaccaagacgccacagccgaggagtacgacgaggaagagcaggacggcgaggaggagcacgcctgatcgatgcaacgggattcagagtcttcgctgctgtggtacatcaattgggactataagttcctacaatcctatacctaccttaagcatatgtattcatgcacttccgtatttccgttgctgctgctagcttgtgtgtgtgtgtgtgtatctacaatcgagtttgttagtgttttgtgaacttgtgatatgttgtccccgttgtccaggatttgtgcgtatgattattcatatgatgggatta

SEQ ID NO: 13340 - DNA, 498 bp, Zea mays
  Clone ID: cC-zmpo14820017h06a1
gaatgagaaagataataacgattaaagatatgttgtacaacacagcttgctgatgttggtagataacaacattgtttttttttatgagaaaaataaagggtgtaattgggagtgtcttgacatatgcacaatgcacctgaacctgagtcaattgaccgcccctgatacatttccttgccaaaatgtggcgacctatacacaaaacatggaaaactgggtacagttctcgtgttctctgttttagtcgagtttgcaggcagtagacacatcactcaatcaacatcttgttgttctttgacggctgcagcagcaagtggaccattgttactaccaagctttagtgacgcgttcttgaacatcttgcggctgagggtgttgtacaccgctctcgagtactgccgcgacgtattcctccagtccactccagctttcatcatcagcttaaactcctcgtagcttatcttcccgtccctgtctatatcgacgtctaagattatg

SEQ ID NO: 13341 - DNA, 548 bp, Zea mays
  Clone ID: cC-zmpo14820017h06d1
agaggaactatggacaagaaatagatattggagtgcatgagtcttactctacatcttgctatgtggcggcccaccgttctgggcagagactgatgagggcatatcacaggctatcatccggtccaacatcgacttccgcagagagccttggtcaaaggtgtcggaaaatgcaaaagatcttgtgaggaagatgcttgatccaagcccctactgtcggttgactgcccagcaggttctagaacatccctggatacagaatgccagtgcagctcccaacatcccacttggagaagcagtgaggtccaggctgaagcaattcactgttatgaacaagctcaagaagaaggccctgcttgtggtggcagagtacctaccagcccaagagctggaagcaatcagggagttgttccagttgctggacaccaacaaggatgggcatttttacatcgaagaactcaggaaggggatgccattgataggccacaatgtccatgacactgaccttgattatgctcatggagctggcgacatcgacggaaccggaccct

SEQ ID NO: 13342 - DNA, 359 bp, Zea mays
  Clone ID: cC-zmpo14820017h07a1
ggttggttaaggacatcattgaagccatgattaagggcacaaaaatttacaagcaaccaattacagggttggttggaccggacccacgaatacattatttcaaagtttactcaactttgatagatatatgcccattaggaaggggggtaaaatacccctgggggcgtaatttttttcccgaagccaagggtttttttccttgattttttcggggcctatgagaacaaaaatttacaagcgatttacagcatatgggcaaaaatccaaaatgcttttttaaccaattggactgacattttcgtgggtcaaaacacctatggatcacccatttaataggatcaacatgtttatttgtcccc

SEQ ID NO: 13343 - DNA, 507 bp, Zea mays
  Clone ID: cC-zmpo14820017h07d1
aaggaggagaagaagttagagagctcaaagaacagattgcttgtctcagggcagcattagctaggaaagatggaggtcaagagagcattcgaagcactcaatcaagcccagacatatatagaatgagaacgggcaatggattacctgcgttgaggcacccaatagtagatggaagtatagagaacgactcggcattgggagatttcgctgagcactcgccattcgggagcagcaattcgctgccagagttgggaccagatggcacacaagatctagccttctaccaaagaagcagccctgaacagcaatggagctggtccgggtctgttgcaacagaggattccgatgacttcgaggttgcaacgaattgctcgtcagatctggattgcgtgagaccatctagtgccccaaaagcttctggtttaacaaacggagggggctcagttgcaaaaagtcccacctgaggggcaaaagttcagacatataagagggaattctgcaaaaagt

SEQ ID NO: 13344 - DNA, 248 bp, Zea mays
  Clone ID: cC-zmpo14820017h08a1
cttacctcttcctaattttcctggggggaccttcgatcccaagctcatttttttcattcttttatcttactttttttcaaaaagcctcaattttttaaccctttctaaaacttctaaatatcgctcaagatcatctatttataattcactgtatgtgagcatgagtttcctcttaagctttatgataatctgatgtcttggaaacaataccccaattgctcgatcctttagctaaacctcctatctca

SEQ ID NO: 13345 - DNA, 102 bp, Zea mays
  Clone ID: cC-zmpo14820017h08d1
cgaccgcggacgcgtgggcggactcgtgggctcctatacataattcatgttttgtttgtaggagcttagctctaggctctagggatgggttattgtttacaa

SEQ ID NO: 13346 - DNA, 344 bp, Zea mays
  Clone ID: cC-zmpo14820017h09a1
ctcattgggtgggttattttttattatttcttaatctctactttcaaaatcccctttttatttatccccattcaatctttgaaaaacaccctttttgttgacaataccttttgggttccaacggccggttttttggaaaaaaacaattaaattaaaaaatgcccaattaataggaataccaaatatatctccctccatttcaaaaggttatcgaaagcctggcccacccgtgaacactttcgtatatacccatttaagccctgaacttaaccccacttcacccccgggcatggataactgctttcctacaaggttcaatcatttaaaagggcttccttttaaaa

SEQ ID NO: 13347 - DNA, 383 bp, Zea mays
  Clone ID: cC-zmpo14820017h10a1
aaaatgcccaattttggttaggggattgcatggatgctggggcctcctttacatctggctatgcccaaggcatgtattctattggaaatggaaattttacttccaaagccaaggacaatgcccaagggcttgctaattgcccaattttgtcaagcctgccactggtttttgggatcccctttaacccttatttgccccaaagccacggatcccgcttttgggttgtcctctgatgctgattaatcgggggggctggtccttatgtctcacttgggggttggaaacttcccttttgttttataaagtgtgtttctcgggttttcctccctggggggtataacggctttgttcccccaactcctctggctttaaccccctctctt

SEQ ID NO: 13348 - DNA, 400 bp, Zea mays
  Clone ID: cC-zmpo14820017h10d1
cacccgtacggaaactggaagcattgattgctgctgctaacatcatatatatctttcacattttacatacccctcctggtgaaaatgccctctttgatgtcctccttatcactcctatatttactgtataataaatttaaaactatggtccggcttccgcaggggctggctcagagactggaccatctctatttcaattaatattttacccaaacttatatccagaattggcacttgccctgcagttgtctatgtaagaagagcggtcaaggcaacaggctattgcaaataaagctgcttaagatacttttaataccgaacataacaatgtcccaagctcaaacagtgattctgttatggctgaatgagaacctgcctcaaatgccgctgctgttgacaa

SEQ ID NO: 13349 - DNA, 485 bp, Zea mays
  Clone ID: cC-zmpo14820017h12a1
ctggaggaaatcgatatattccccggacaaactccggcgatggccggagcctgaaacgtgacaaaacatttttgtcctcccctccctgctttccctcccggcttggtcacaatacaatctcatctacgccggagctgcactgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggtttccgtttcgtcccgtcccgtcccggccggtcagcttcgcagcgcgacggcggcctcgtgcaccagcgacccggtggaaggacatgacggcctggaccttgagcccggccttgcgcgccatctccatgagctccgcgtagcccgcgaagttgtaccggcccgggccgtcgcgctcgtggatgccccccacacgttcaccatg

SEQ ID NO: 13350 - DNA, 442 bp, Zea mays
  Clone ID: cC-zmpo14820018a02a1
atataacttggcaatccatttcttaactcttctcttttaaacaacagcgaagtgtcactctagctgggtagggagaggaagaacatggacagggaggatgacaccatcattggtggcgccagcatcactgtcgtaatagggtagtggtagcaaatagatatcacggtccaatgcatgcatgtgtaatgcattgcttgggatccaaccaattctagtatagctagcataggccggcttaaagtattgtcagcactaaagttaattatttggcggtgtaggcggtgttggccttccagttggcagggatgacatcgtcgtagacggacttggtgcctccctcggtagtgaggcggacggtgaggggtcccttaagcggtttgtcgctgtccttccttcagatggcgccccaggagtgcttcaagggctcgtacgtgtcagagcc

SEQ ID NO: 13351 - DNA, 446 bp, Zea mays
  Clone ID: cC-zmpo14820018a03a1
gcaatattgtcttcaaaatggcactgcctacaccgagtgactgtgacaccgtagtgacggagcaggtgtactcaccgagcactgtctaaagtagtttacatggagtaagagaacactggcaccggcggtgcaaaaaacggcacacgggtacatgcagaggccgccggtcgatgatgcaagacaaacagctagcactgctctgtcggttccggggcatgcatggcgatcgcgcgagcggatgcgcgtcttcctcttcagagagctcgcgccctgacaatgtccatgctcatctcgctggggtcggtggcctgcagctccagctggatgccctccagctccctcttgaaccggtccttggagctcgcgtacagcatcttgctcctgacccttgaggtgttcggggaccaggagatgaacaagatcttgcttttttggcagttctcgtc

SEQ ID NO: 13352 - DNA, 376 bp, Zea mays
  unsure at all n locations
  Clone ID: cC-zmpo14820018a03d1
cctccttctcgcccggcaccgtcgagctcggctgaggattctgttctatcccatcaaccatggcgaactcggcgtcggggatggccgagtgcgtcgagagcatgctcaagttccaggtgctcaagtcgaagcgaagcttccggttcatcacgttcaagatctacgtgcagtcgctgcaagaggaggtggactggctggggcagccgggcgacacctacgtcgacttcaccggctccatgcccgagtgcgtgtgccgctacgccgtcttcgatttcgacttctccaccgacgtgaactgccagaagagcaagatcttgttcatctcctggnccccggactcctcgagggtcaagatctagatgcttgacgcgagctc

SEQ ID NO: 13353 - DNA, 345 bp, Zea mays
  Clone ID: cC-zmpo14820018a04a1
gggaaaccacccttctccttggttttggtcccccccgccgggggggcccgggtctttttacaaaaaaattttccgcccccgccgcccaatagctgatcatcccatccaattcattgggcctttggggggggggggccctttcctttttagacccccggcttgccgtatcaatgaaaaaaaaccccaagccggggggggtttaacaccgttttaaaaacccatgcgccgatgccggtgtaccccccgccgggggggccaaagtgctttcccaaaacccaaagcgggggggggtttacccacgttttgaaaacccatgccccgatgccgcttcaccccggacggggg

SEQ ID NO: 13354 - DNA, 408 bp, Zea mays
  unsure at all n locations
  Clone ID: cC-zmpo14820018a04d1
gggagcagcggcatcggcgcaagggtcttcaacacgctgctcaacgccgccctgctctgggtcttgaggatgcactgaggcagccgtcggcggcgggtgcagcggcatcggcgcatgggtcttcaacacgctgctcaacgccgccctgctctgggtcttctttcattgctacggcaagcgcggcgtcgacgaaggcagcggcgccgccagcacaaaggacctatgaataggatcggatgatcagctattcggctgctgctgctagaatatttttgtaaataggcctggaccgcccggcggacggaaacaagaacaaggagaaggatcgattccncctattaaagaacagatatggtcaacttgtaacttaagccaattcctcccaaattattaaaaattattattatg

SEQ ID NO: 13355 - DNA, 493 bp, Zea mays
  unsure at all n locations
  Clone ID: cC-zmpo14820018a06d1
ggaaattacaaattacttcagctgagatgccctcattggcgagggctcgtatgccagtgtctattttggtgtgctgtaagatgggacgaaatctgcagtgaagttgcttgactcctgcaaacagcctgatctagaattccttgagcaggtttcagctgtctctagattgatgcatgtgtatgttgtccaactcgtcggattctgcgccgaagggagcacccgcgtccttgcttatgagtatgcaactaggggatcattgcatgatatcctccatggtaaaaagggtgtcattggagcccagccagggcctgtcctgtcatggatgcagcgagctatgatagccgtatgtgctgctcggggtctcgagttcctccacgagatagccgatcctcgagtggtcctccgcgacatcaagncaagcaacatactgctctttgaccttgatgntgcgaagatcggagacttcgacatctcaaaccaggcccctgacatg

SEQ ID NO: 13356 - DNA, 482 bp, Zea mays
  unsure at all n locations
  Clone ID: cC-zmpo14820018a07d1
gacccacgcgtccgattttatcaacgcttctcctgctggttactccgcgcgccttctctttctctcccggacgccgatcgagttcgtcaggacgggctagctagctccctccctcccagccatggcgacgccggacaacaaggggcacgggcatccgctgcccaagtttggggagtgggacgcgaagaatgcggccacgtccgaaggcttcaccgtcatattccagaaggcccgcgacaacaagaagaccaccaccggccctggggctgggaacgcgcgcgcaggcattccgccggccttcaagatcggaggcggcgacggcgggtacaggcccgacttcagagacggcaaccagnacacgccgcccaaacggaagaagagggcctcctgaggctgctgaatcgaagctcgctgagctgctgtgctgactcgaaaggagaacggatcgngcaggagctcaagtgacccaggatgatgggagc

SEQ ID NO: 13357 - DNA, 417 bp, Zea mays
  unsure at all n locations
  Clone ID: cC-zmpo14820018a08d1
gacccacgcgtacgaccatcgcgtccgcccacgcgtccgcccacgcgtccggtcgtagctctgctcacgtcgcgacgaggatctcctcgagaggagacggagagctcgaggagggggcgcacggaggccgttctaggcttgggcgtgggcgtggtctcagagcggcacatcgggcagctggagctcccgcgcatccacgtgtcgatgcagtcggagtggaagtagcgcatgcactcggggagcacccagacgacctctccggcttagaagtcggccaggcacaccgggcacgtngactcgctccaggcctcctccttggggnaccggctcaccaccgccgcgcccaccaggacgacacatgcatggcgcggcgcgctataagtggcccgcgacgatgggggcgggcttggggcacaa

SEQ ID NO: 13358 - DNA, 403 bp, Zea mays
  Clone ID: cC-zmpo14820018a09d1
gcttgctagcgatggctggtgcctgggcactgctcatcgtcctcgcggctgccgtcgcggtcctggccgcgcggccggcgtctgctggcgggggagccgcggcggaggcggagatctgcatgttgactccgtcccccgacctgtgcaccaggacggcggggtagcacgccttcaagtacatggaggtggacgcggtgacagagcttgagatgctagaggacgcgttcttgtagcgcgtgaaggcggcgcggatgctcgcctaggaggaggtcaagacggccgcgacgcccgatgcgcggagggcgctgaacctctgcatgacctactacctggacgccgccgacaacctcagcgcctgcatgcgcgccatcggcttccgcgacgccgtcaccatccgcgccac

SEQ ID NO: 13359 - DNA, 424 bp, Zea mays
  unsure at all n locations
  Clone ID: cC-zmpo14820018a10d1
caaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggggagacgaggcgttcagctcaagcgctgagcgagtctatacgtacgtcgtcaccggctggccacgcatgcgataaccatctgatatggacggaactatatattgtattcctattaatctggcattttctaagctaattgtttttgttcaaatatatataccgncgatggaactccaaatgtaatgtcacgcaaatgtgtgtttttcatcgatcgaatggataataataaaaaggcatgctggcagnnactatttaaataaataaataaaataaatt

SEQ ID NO: 13360 - DNA, 444 bp, Zea mays
  Clone ID: cC-zmpo14820018b02a1
atatgcaaacgaagcacaaattaccactagctcgatacaaggagacttatgacatcacacaataatacaagagcaccaagtaacttttgctatatctatcatggggacaaatgctatatggtcactgccctagcacccaatggatcaaacgacacaatactgctaggaacaccgactgtacaaataaaatgaactgagaaaacggtgccatcgtcaccatagaattaaagcgcatagcacacattgtctatatatattgggtataacaaattatattacttgcattaagaaaaataaaaaacaaacgagagagacatataataaataaagaaataaacaataattaggcaagcacattccatgtgtttgccactcgcattccatacactgatgcacgtacatgtttctatatcatcagggtgcaacgtatatactgttagttat

SEQ ID NO: 13361 - DNA, 390 bp, Zea mays
  Clone ID: cC-zmpo14820018b03a1
gaaaccccttagggtcggttgggtttaaagaagaaatgttttcccctcagaattgggtggttacccccccaaacaaaaaataactttcggatgtctgtccttttactgttgggccttcccaatggattgcctttaatgggcaatgcccggcccaaaaaaaaattttaccttgagggatgggtcaccccacggggggtctaaaaacatgccacctccttggggcaacctttggggcttcccttggggtttgggcataaaaccctggttttgttgtgggggcctcttttctcaacggttacctaattcattgggacccccgtgcatgggaccttttctaagaaaaaaaagttttcggccctccgggtggaagagggtgccgttattttttta

SEQ ID NO: 13362 - DNA, 323 bp, Zea mays
  unsure at all n locations
  Clone ID: cC-zmpo14820018b03d1
atgatccttcccaactcgctggagaaggacttcgagaacaacggggaggtgtccggggtcacgctgctcaactccaagttcttccacatgaacatgtaccggagcaaggacatgctgatcaaggacgtgaccgngacggcgcccggggacagccccaacacggatggcatccacatgggcgactcatccgggatcaccatcaccaacaccgtcattggcgtcggcgacgactgcatctccatcggccccgggacctccaaggagaacatcaccggcgtgacctgcggccctggccacggcatcagcatcggaagcctagggcg

SEQ ID NO: 13363 - DNA, 339 bp, Zea mays
  Clone ID: cC-zmpo14820018b04d1
agctgcaccgaccgaccaaaccctatgagttcagagggcgtctccacttttgcgaagaaagggagcctcgcatagccttggagtcccctaagtagacaacgagacagctcaatcctcctcgacgagcatgtcgataatggtcccttacaaatacttcttgcataggagctagctccaaaagagattactgtgaatcctcccatgactgcaatgatcaaccagataatgttcgcactttctaccagaaagggacagactcctttaggagcctgcgcagaaatgaacatgccgaagtccattgtaactgcccccaaccagcaaccactgaagcgcgtgcat

SEQ ID NO: 13364 - DNA, 474 bp, Zea mays
  Clone ID: cC-zmpo14820018b05d1
cacgatgcacaagaagggcgaggagcaccactagaagggcgaggagcaccacatgaaggacgacggggagcacggcgacaagtccggcgaccacaaggacaaagaccattaggagaagaaagatatgtagtagatgaaagagaagaagcacggagtaggccatgaccatggtgatggtgacggccacagcagcagcagcagcgacagcgactgatctcgcctcgccgagcgccgtacgcacaaatgcaccgcgcaggttattatacgagctgtccgccgaacaccatgcgcatatattatacagtactcgccaagattgtaggtctgcaatcttcgggataaaaaggatctttttttgttttcgttagcctgaggttttcatctttgctggatggatctgaagaacgaagtcgatgttggattcacatgtatgcattgcttggaggatactcaccggatatcggtgctgatgtg

SEQ ID NO: 13365 - DNA, 52 bp, Zea mays
  Clone ID: cC-zmpo14820018b06d1
aaaaaaaaaataaaaataaaaaaataaaataaaaaaaaaaaaaattttaatt

SEQ ID NO: 13366 - DNA, 524 bp, Zea mays
  Clone ID: cC-zmpo14820018b07d1
aaagataggaggctgcaggcactcctttgagctccaaaaggaggtttgggcgaagagggagctcacatggcaatgcgagacattgagcaaagagcgtccctcgtctttgagcagttctgttggcatatggccaccatgcccttttcccctgcattcggaagatagctcctactcttacagccggcagagcaactatgaaggccctatatttgtcatcatgcttgaacatgacaagaagtctgtccaagagctcccagccaactcgactgtagttgatctaatggagcgagtcggggcctacagtccgagatggagcccttacagcttcccactgaaagaggagctgcgaccgatggttaaccacaagcccataagcgacccaaataggaagctcagcatgggcgacgtggaggagctgacgcctgcgctccctgacaagtcgctgtccgagtaccgggaggagatccagcgcatgtatgagcggagagggtttgcgctcgccaccacccctagaagctgacacc

SEQ ID NO: 13367 - DNA, 515 bp, Zea mays
  unsure at all n locations
  Clone ID: cC-zmpo14820018b08d1
gacccacgcgtccggtcaaggcccccggcgacagccccaacacggacggcatccacatctgcgactccagcaacgtgaccatcagcagcgccaccatcggcgtcggcgacgactgcatctccatcggccccgggagcaagaagatccgcatccatggcgtcaagagcggcccaagccacggcatcagcgtcggcagcctggggcgctacaaggacgagaaggacgtggaagacgtgcaggtgacggggtgcacgatcgccggcaccacgaacggcctgcgcatcaagccgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaagaggccgncaacgacgtcgtcttcaagaacatccacggcacctccaacacgccggaggccatcacgctcaactgcgccaacaacctg

SEQ ID NO: 13368 - DNA, 318 bp, Zea mays
  Clone ID: cC-zmpo14820018b09d1
gctatcattattgcccgtggccttgatctttggccctctttgctcttggtggatgcgttggctttccatctccccatgtgggtgtgtggacgtcattttttgaggtagatggggtacgcgtcgctgttctagtctcggtttgctgcttcttgatcagttctgatctcggtttgctgcttcttgatcctgatctgggtttctgatccatatagtctgtactttgttacaaaaatcatgtaattttaaaactttttcccatatctgggttcctgatttatgatgtctacagttccggcgccttattttttttttatttat

SEQ ID NO: 13369 - DNA, 467 bp, Zea mays
  unsure at all n locations
  Clone ID: cC-zmpo14820018b10d1
gaccagtacgccgccgcgcagacggagcccggcgagctcgtgctgcgcgtcgacgcgcccgtctacttcgccaacgccagctacctgcgagagaggatctcgcggaggatcgacgacgaggaggagcgcaccaagatccagggcgagaagggcgtgcggtacgttgtcctcgacatgggtgccatcggtagcatcgacacgagcgggacgagcatgctggacgagctcaacaagtccttggacaggaggggaatgcagatcgagctggcgaacccgggcagcgagatcatgaagaagctggacagctccaaggagctggagcagatcggccacgagagggtgttcccgacggagggcgaggcggaggcgtcgagcgactacgtgctgcactcgcacaagccgggaatggccaatgacagcgccgccgcccacgagagcatggtgagacgagcaccgncacgccaacc

SEQ ID NO: 13370 - DNA, 471 bp, Zea mays
  Clone ID: cC-zmpo14820018c01a1
ctaacaagggctatggtcatcctggggaattgcaatcaaagcaaccaaacaagagctctcaatgtacttgcacaagcctacacaggctaggcgcagcttgcatttgagctgagaaccagtctctcagcatccaacaaccaaacacattgtataactacagagatgggtcaatggtgggtctagaagcatgcgagcgccttcaggcaacccttggcgctgcccttagcgttcttgcatacagccatggtcttgttgttggtgccactgtagttgatgttgagcagcgtgatcccggacacctccccgttgttcacgaagtccatcaccagcgagttgggaaggatcttgcagtcgtactttttgacgcaggagttcttgctccacacggctggcccctgcccggcgagcttttctttgccggtgatgacaaggtttgtcacgcgtagaatctcgatccaattaccatgatcc

SEQ ID NO: 13371 - DNA, 366 bp, Zea mays
  Clone ID: cC-zmpo14820018c02a1
aagcaaaaccgtgcgggttaacttccattccttcttgagattggacactgtacagtatgctctgtgtcagctgacgtgcacatgccaaccccaaaccctgtttggcgaataatcctccgaaaacacaagcgggaggggcgcgcgacgccgatctcgttctcgggagaccaaatgaagttccgggcaacaagtgatctcccgccaactgttggatctttcatgggcaccagccgcaccggcagaagctcgggcaggagcatatgcagcatccgcatttccaccacgggcaccggctggacctggagtaattgaaccagcagcagccggagtatgagcaccccgcgttgacccctccggcgtttcttc

SEQ ID NO: 13372 - DNA, 193 bp, Zea mays
  Clone ID: cC-zmpo14820018c02d1
gggaggagcggaggaggagcaacccggggagctagctgctgcggcttctagctggttcgattactcctggagctgacggagcccgaggaggcgatgcggctgctgcatctgctcctgcccgagcttctgacggagcgggtggagcacatgaaagatccaacagtcggcgggagatcactaggtgcccggaact

SEQ ID NO: 13373 - DNA, 522 bp, Zea mays
  Clone ID: cC-zmpo14820018c03a1
aatgaaccttgagctcattagaagataattgatacatgaacaaaataataaatattgagttattcataacatacttaatacatgaacaaaataatgaaccttgagcatacatgaacaagagacaggacaggcatcagaatatacatgacagtcaccagaacatacatgacattcgtcataaataagaacgagataatgaacgttattaagaataggttgtcgatgcatggcgaacgatcgagcgatcttgtttagcactgcctagtgcagatgcagcggcggcggaaggtgctgcacctgccggccaagaagccctcaccgcggcacacattggcgcagttgtctgcgatcatgcatgccccaacaaatcgctcactgtacttctcgcattcccttgcctgtgccatatcggtggacacaatgagcaggagaagcaggatgacggccggctggaacctgcgtgacgacttcattaccttttatcttgggaggaatatatatatgcacgccttagggattcac

SEQ ID NO: 13374 - DNA, 375 bp, Zea mays
  unsure at all n locations
  Clone ID: cC-zmpo14820018c03d1
gattagaaataatagggaataaattgttcgagaatccctgaagcttgcatatatatattcctgccaagataaaggtaatggagtcgtcacgcaagttccagccggccgtcatcctgcttctcctgctcattgtgtccaccgatatggcacaagctagggaatgcgagaagtacagtgagcgattagtaggggcatgcatgatcgcagacaactgcgccaatgtgagccgcggagagggcttcttggccggcaggtgcagcaccttccgccgccgctgcatctgcactaggcagngctaaacaagatcgctcgatcgttcgccatgcatcgacaacctattcttaataacggtcattatctcgntcttatttatga

SEQ ID NO: 13375 - DNA, 455 bp, Zea mays
  Clone ID: cC-zmpo14820018c04d1
gataaaccgagaggaatacatgcattccaagggatttattcatcgtgacatcaagccagacaacttccttataggcttaagtcggaaagctaatcaagtctatatcattgattatgggcttgctaagaaatacaaagaccttcagactcataaacacatcccatacagggagaacaaaaatctgactggaacagcacgttatgctagtgagaatactcatcttggaatagaacaaagcaagagagatgatctggagtctgtaggctatcttctgctatattttttaagaagaagcctcccatggcagggccttaaagctggcactaagaaacaaaagtatgataaaattagagaaaagaaaatgcttacctcggcagagattctgagcaaatcttacccgccggagttcgtctcatatttccactattgacgctccctgcgatttgaagacaggc

SEQ ID NO: 13376 - DNA, 194 bp, Zea mays
  Clone ID: cC-zmpo14820018c05d1
aatttttctctagtccttgcattgcccattacatgctatccattggtaacgcacaacagtaaaatgacagacatccgacagctatattatgttcgacggtgtaacaccctgaatttgaaggtataaaatttcttctctaaataccaaccaaattcaggtgttataaatttttatttaatttatatttttttttt

SEQ ID NO: 13377 - DNA, 395 bp, Zea mays
  Clone ID: cC-zmpo14820018c06d1
cctccctccccgcgctggagtaggatgagggagaggggacaagctttccggcgccgacgccgacgcggaccccgagccgacacgatccggaggatcaagtgcatcacacctttagggaggccccttggacagcagtttgtgctgcatattctatatagctctgtcgcagcatggcctcggagggcgtggcacgctcttctttgggatttcagaatggcacaagttctagcagtgacccagatcgtcttcccaacgtgtagggcagtatgagcataagggacgacatggacgttgaagatattgtagtcaatggcaatggggcggagcctggtcatatcattgagaccagcattgatgggagaaatgggcaggcaaagcagaccattagttacatg

SEQ ID NO: 13378 - DNA, 361 bp, Zea mays
  unsure at all n locations
  Clone ID: cC-zmpo14820018c07d1
cggacgcgtagggcgagcccggaggcgagcctgaggaacggcgccatcatcctgtcggagcggccgagcgcgacgaactgcctcgccgacgagagccacgtgtgctggaggaacggcaagttcgcgcaggacatgatcctccggctcaagaacgtggagagcggggagattcagctgcagctgcagaggctcagcatccctcctgctgcagccagcaggtgaaggatacgaatctatcgcattttcaacctctttgtgaaagccggattgtaacaacttaaaccagcaattaatggggtcagggtcagtctgggnagctcatgtgttgccctattaatgtacagntggggacagcatgaaa

SEQ ID NO: 13379 - DNA, 270 bp, Zea mays
  Clone ID: cC-zmpo14820018c08d1
aactctcgccgccgcagtgggagcgtacaagccaaccgaccccgccctctaggcaatccaacgccgacgttccaccaccacctgaagagcgagatggagatgaagaggatcctctcatccgtcctagtcgctatcgtcgtctcgggcatcggagtgctggccttcaccgaggccgccgtcgagggcgccccaactgcctccgagtcgagcgtcgaggctcccgctggcactggcgctggcgctatcgctggagcctccgtcgtggagccc

SEQ ID NO: 13380 - DNA, 432 bp, Zea mays
  unsure at all n locations
  Clone ID: cC-zmpo14820018c09d1
acgccttcttcgccgtcggcatgggcccgggcaaatggtcgcctgcgtcccggagcacgtacaacctcctggacacggagagccggcactcgatccaggtgtaccctaagtcgaggacggcggagatgatgacgttcgacaacgcgggcatgtggagcatccggtcctacatctgggagtggcagtacctcggcgagctgctgtacgtgtgcgtcatctcgccggatcggtcgctcagggacgagtacaacatgccggagactagcctccgctgcggcatggtcgtcggactgccaatgccgccgtcctacctctccgtccagagcatgcacgcatctcgctcggtttccccttccttccatcacgtgcgcacggggctgnatacacaatttaaatgagcgagatggcagcggcttctctcgtttccttctt

SEQ ID NO: 13381 - DNA, 428 bp, Zea mays
  Clone ID: cC-zmpo14820018c10d1
caagaagagggcgcgccagatcctcgaggggctcaaccacctccacacccacgacccctgcatcatccaccgagacctcaactgcagcaacgtcttcatcaatggcaacaacggccaggtcaagatcggcgacctcgggctggcggcgatcgtggacaagacgcacgtggcgcacaccatcctgggcacgccggagttcatggcgccggagctgtacacggagacgtacactgagtcggaggacatctactcgtacggcatgtgcgtgctggagatggtcacgcgggaggagccctacgccgagagcggcagcgtcgagcagatcttccacaacgtcacccggggcgtcccgcccgcggcgctcaagcggctcatggacgccgagctgcggagcttcatcgagcgctgcatcggccagccccggaacc

SEQ ID NO: 13382 - DNA, 67 bp, Zea mays
  Clone ID: cC-zmpo14820018d01a1
gggggcgggggattttctttttttttttcttgtggggcaaaacgcgcacacacgaaaggggggaaaa

SEQ ID NO: 13383 - DNA, 413 bp, Zea mays
  Clone ID: cC-zmpo14820018d02a1
aaccgttcaaatcacaagatactttgactattattctcgaaaacaagaaatacataaatatcgtatcttacttcatgcaaggaaaacatgtggtgaaagacaaatcaaaacaacgattcacagtcatttcatagtatgataacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcacgcactggcagaagggcaccaggttggggaactcccagtggcagcggccgtccggcatgccgcgccccgcgcaagtgtcgtcccggcagttgtgcgtcttggtgcagatgacgc

SEQ ID NO: 13384 - DNA, 328 bp, Zea mays
  Clone ID: cC-zmpo14820018d02d1
gtacatttatctaagcgatcttcatccagccttctgctctgctccctcgaaatggaggcgtcgtgcaaggcgaaggcttcatgcctcctcgttctgctgcttctcatcaacacaggctttgtcctgcccgtccattccgaggactgctgggccgacacccgcgtcatctgcaccaagacgcactactgccgggacgacacttgcgcggggcgcggcatgccggacggcctctgccactgggagttccccaacctggagcccttctgccagtgcctgcgccccaactgccactagtccgggcgcctaggattgtgctcacttcgccggc

SEQ ID NO: 13385 - DNA, 336 bp, Zea mays
  Clone ID: cC-zmpo14820018d03a1
ctcggacaaaaggggattcttggggaaaaaaacccaaccaaacaaacgttttatgcacccaatttttaaccggtgccccgggacctttgttgggaggtgtatttatgggccgggtgatgaccatttttttttttttaaggaacattttgttcccgttagagcctcctttggggggcaaaagggaaaccccgggaggaaaaaggaaaaccttaatggaagcccccccaaagaaaaaatatctcaaaaagggtccgggcaaaaggggatctttccccccccacaaaaggcccctcccccccctctgagctaacccccgggaggggttgttaacccccc

SEQ ID NO: 13386 - DNA, 360 bp, Zea mays
  unsure at all n locations
  Clone ID: cC-zmpo14820018d03d1
ggatcatgaccaggcgccatccaccagtctggtcaaagaagctcatgccctcgggctggaagtgtatgcatccggaggtgccaatgatatcgacttgagctacaactacagctacgatcccagagaatatttcttgcagntcatggacaatccagacttctctgaggacggtgtgctcacggacttcccgtccaccgcatcaagatctggtgctagctagggtcattccaagggctatcctctaccgcctcctggaaaggacaccaggccggtgatcatcacccataaaggcgcgagcggagagtttcccgggagcacagatcttgcctaccagcaagcgatcaaagatgccgccgacat

SEQ ID NO: 13387 - DNA, 473 bp, Zea mays
  unsure at all n locations
  Clone ID: cC-zmpo14820018d04d1
gacccacgcgtccgatcttatattacaggtcatagctaagcaagtctgacaggatgtcttggcagacatacgtcgatgagcacctcatgtgcgtgttcgtgggccaccacctgacctccgctgccatagtcggccacgacagcgccgttagggcccagatcaccgcattccctcagttcaagacagaagagaggaccaacatcatgaaggacttcgacgagcccgggttcctggccccgaccggcctcttcctcggccccaccaagtacatggtcatccaaggcgagcccggcgctgtcatccgcgggatgaaaggatctggaggcataactgtgaagaagactgggcaagcgatggaggtcggcatctacgacgagcccatgacccccggccagtgcaacatggaggncgagaggctcggcgactacctcgnagagcaaggcctgtgaatggattcatttaatctgcgagca

SEQ ID NO: 13388 - DNA, 400 bp, Zea mays
  Clone ID: cC-zmpo14820018d05d1
gacccacgcgtccgggccggcgaatctatcaagaacgccacctcctatgttagggcgtgtaggacctgccatgggggacaggccggcgccgatcgagtaggtcgcggagccggtgtagatggccttgttcctccacgccgccgtcacgtcaccgggacgccagctgcatcacagcgcctcgtcgcacgaagcgcccgccgagtacatctcgccgcggacaacaacagcctggtattagcagcagcacctgccggagagccccggggcgtgcctctgctcgccgaccgttcacgatggctcgttccggagcaagctccaccgcggcagcggcagcggctccggcctcctcgagatgatgatgtgctagttggccggcgtatgacgacgcgacgcagcgggc

SEQ ID NO: 13389 - DNA, 538 bp, Zea mays
  Clone ID: cC-zmpo14820018d06d1
cgaagcttccgccggaggagctggccaagctcccgcccgacgagctggccagcatcccgccggagacgctggccaacatcgcggcgtcgcaagggcagctgcagacgagcgagatcctggccaccatcccggcggcgcaggcgcagggccagctgccggcggacctgccgccggaggagctggccaagctcccggccgagcagagccaactgccggccaacattacgcccgagaagatgaccagtctcgccgccgtgcagcagcctgcggctgctggccagcctggggcggccccggctctcccggccgacatccctcagatccccaagaagcccgacctctccgggctggccaacatctcgttcccggcgaagccgtcggagcccaggatgccgcagctgccgcccgacttctcggtgtacgaggacgaggtccccatccctaagttcatcaccaagatgaggcgacggcaatggcgccggcgaggggcaacaaaactgagccgaagcattgtttcgatgttagaggcacctgagct

SEQ ID NO: 13390 - DNA, 377 bp, Zea mays
  Clone ID: cC-zmpo14820018d07d1
aaaacgagacaagttttttttcgcagatacggaaagactggtgcaaatctgtgacataatgatttagggagatagctcacaccttttacaccatgccaacctttaacaggactttgcatatacattttttaatttgccaacccgacgctaattaaatctgtccacaacaatgtgacctgggacgacattagatcgagcaacaagggcaattgatctagtttcactcggacacgactaattcatcgccatcgcaaccacttgtacgggtattatgtatggaagaagatcgtgaataaaacactgacgaggatcagctcgagtgcttcactgaacaagccactacttgagcccaaagcctgagccttgtcttcacaagc

SEQ ID NO: 13391 - DNA, 431 bp, Zea mays
  Clone ID: cC-zmpo14820018d08d1
acccacgcgtccgaggacgcgagggagaaatttattctgattctagctagccactatagtgccatagtagattcacagcttgttaacttggttaccctcctaagagatggaaagcgtagataattgttggcacaaccacaacacagctcctcaaatatatatttttgaagaagttcccttttgataatttatttaaaataaaaaattaaatttataatataataaaaatttaaaaaataataaaaataaattaaaaaataaaataataaaaattatataataaaatataaaaggggggggcgtttttaagatcccaggtttcttcccccgggtttggaactaatttccttttttttggggggccttaatttaatttcttgggccggggtttttaaatccggggtttgaaaaaccctgggggggcccaattt

SEQ ID NO: 13392 - DNA, 442 bp, Zea mays
  Clone ID: cC-zmpo14820018d09d1
cccacgcgtccgcttcctcgcctccatcccatcccgccgccgccttctctacggtcgctaataagccgccgcatcctgggatggagatgaagaagatcgcctgcgccgtcctcgtcgccgcctcggccaccgaggcgctggccgcggaggcgccggctccgtcccccaccagcggctcctccgcggtcgcacccgccatcgtcggggccgccgaggcctccttcttcgcgtactacattcactgagccgccggacgtggagccggactgccggagggaagagaccaagggggggagagacttggctgcgctgcgctgctctgctgctcccgcgcattcccgatgcgtgggtgggtgagctctgattgggcacggcagtggcacaccttcgtcttccttttgtttggtttttttcctttcctctctctgattttcatttaact

SEQ ID NO: 13393 - DNA, 439 bp, Zea mays
  unsure at all n locations
  Clone ID: cC-zmpo14820018d10d1
tgcctcttctcgtacctgcgcatgggcgccgagttcttctcccccgaccacttcccgctgttcttggtgttcgtgcgttgcgtcgtgtgcggcgtgagggtcgtggtcgtcagccccgccgacgtggtgcgtggcatgtctgagtcttgcaatacctgatcctgggaggccattgcggtttgttgcttctactcttcgccgcccccgccttgtctctgtctgctgtctcgttttatttttgatgtgccaaaatacttgctattttccgctgctactagattttgctgagttgttcgtgatgatcctggtatttgtggatctagagttgcaaatgtgggatcccacatgcattttttcttttgccgatgtttcgtcggcttcattgttgataattttttttgtttcatcttgagaccatnnatattatactctctctttt

SEQ ID NO: 13394 - DNA, 111 bp, Zea mays
  Clone ID: cC-zmpo14820018e02a1
gacaaacatatatcctcttatattctaacggtgttttttctgtgtgtgtatgtgtgtacaacaaatgagtacatgtgcaatttcatcacaagtgagaaacgctgcctgcct

SEQ ID NO: 13395 - DNA, 90 bp, Zea mays
  unsure at all n locations
  Clone ID: cC-zmpo14820018e02d1
gacccatcgcgtncgcatgtatctcatttggggtactcacattcacacacagaaatttattcgtttgtatttaagaggatatatgctttt

SEQ ID NO: 13396 - DNA, 498 bp, Zea mays
  Clone ID: cC-zmpo14820018e03a1
gaccgagacgcccgtgccgtcggtgacggcgacggcgacggcgacgatggttccgggcgcccgggctcagcgccggcggcgtggtgctgcgcgtgtccgggcggggactgctcgctggagcccaacccgagcgccaacggcaaggaggacgtcggcgtccggtctctcctcgagcgcaacgacttcttctgcgccgactgcaacccgcacgccgacgccgtcctccccgccagcgccgacgccggcgcggtctacgactcgacgtagcgcaggcccatcgaccggttcagttaggtgctgccacattgccagctactcattcgcgttctccccgcaaacgttgcggcacacaattttctctttttacagatgatggaagaggaaagtttggttccggtggagctggatcggattatcgattccttgctttcttttcttcattgcttccttgcccggaatctgacatgtggttgccggggtgggagccactgatttttg

SEQ ID NO: 13397 - DNA, 75 bp, Zea mays
  Clone ID: cC-zmpo14820018e03d1
acgcgtaggagctttttttcttttttttttgttttttttttttcttttttatttttttcctcttctttttcaacc

SEQ ID NO: 13398 - DNA, 449 bp, Zea mays
  unsure at all n locations
  Clone ID: cC-zmpo14820018e05d1
gggcgatcgggatggggttccagaacacggccggcgcggatatgctccaggcggttgcgctgctggtgcagtcggacaagtccatcttcctcaactgcaagatggacgggttccaggacactctgtacgcgcactccaaggcgcagttctaccgcaactgcatcatctccggcacggaggacttcatcttcggcgacgcggcggcggtgttccagaactgcatcctggagctgcggcggcccatggacaaccagcagaacatcgngacggcgcaaggccgcgcggacgcgcgcgaggccacagggttcgggctccagaagagcgaattcctggccgaggccgagctccgggacgcctagcgcccggccatccgcaactacctgggccggccctggcgcgagtgctcgcgcaccgtcgtcatggagtcggagctcccggactttatcgac

SEQ ID NO: 13399 - DNA, 263 bp, Zea mays
  Clone ID: cC-zmpo14820018e06d1
gacccacgcgtccgggttcgaggatggcggcgccacggcctctcctagctatcgctgctggtcgccgagctagcggaggccgcggatgtcgccaacgccggccacgccaagcccctgacgccaggcgggcgcgtggtacaccacaaccacggcaagttcacagccgggccgaggaaacccgcccacgcgaccttctacagcgggcgggacgggtccggcaccacggcgggcgcgtgcgaggacaaggacacgcgcgcgcaggg

SEQ ID NO: 13400 - DNA, 359 bp, Zea mays
  Clone ID: cC-zmpo14820018e07d1
atatatgtcgcctaattctttcgatcgaattaagcgccttcttcttcccacgctccgtctttatttgtaatctgaagcttacaggaacatttgagtggatcatggacggattggtaggcctcttgaaagtccgggaggtgaggggcatcaaccttgcctaccgagacgcaagaagcagcgatccgtatgtcgtcctacgactttggaagaagaaacttaagacgagcgtgatgaagagatctgagaaccccatctggcacgaggagctaactctgaccgtgacagatcccagcctagctctgatgctggatgagttcgacaaggacacgttcagcagggacgacccgatgggggacgcg

SEQ ID NO: 13401 - DNA, 407 bp, Zea mays
  unsure at all n locations
  Clone ID: cC-zmpo14820018e08d1
catcgcctttcctcttctcaccagcctcctccgacacgctgcttgcccacgtaaattgcaccgagacacagacacaggtaacaaaggcaacagccatggcgggaacccgagccctgtacctcctcgtcgcggctgtcgcggcgctcttagccacgcctgcggccgaggacgcggccacgctggcggagatctgcaggggaaccgcgttccccgacatctgcaccagcacggaggggagcgaagcgcagagcgccggggagtaggacgccatggcggngtagcggatgcaggaggacgcgttcaacaagcgcaccgaggcggcgagggcgcacgtgaaggatgccgccgagatcagaggccccaaggcgcggacagtgctggacctgagcaacaacctgtacctggac

SEQ ID NO: 13402 - DNA, 486 bp, Zea mays
  unsure at all n locations
  Clone ID: cC-zmpo14820018e10d1
ccacgatgcacgcgttcttcgcctctcaccccacgggagaggacgggtggcgagggcgcggcgagccggcgggcgcaatcggatttggggaggcaaaaggaaaattccggagagcagttcctttccgcctccccatttcctccggatagattagggtttgtcctgcgtcgattagtccggcgcccgaacccgcaccaatccattcgccgagggatcgagcaagcgaggcgtggaatcgcaagcggtattccctgcctgcctcttcttctcctccgcctgttcttgccgcggtctccccctccggccgatctggactcgacagatcattatttttttgttggcatacattcccaaccttgatataaagacctccttcattcagaagcctgagtttaggaagggtatttcacaatgaagcccaatcagnagattctatcctatgttgatatacatagggnataccgatacgagatcctaccagagttt

SEQ ID NO: 13403 - DNA, 407 bp, Zea mays
  Clone ID: cC-zmpo14820018f01a1
agaaggaactgccagcatgcgtttttattattatccattcaatcgatgaaaaacacacatttgcgtgacattacatttggagttccatcgacggtttatatatttgaacaaaaacaattagcttagaaaatgccagattaataggaatacaatatatagttccgtccatatcaaatggttatcgcatgcgtggccagccggtgacgacgtacgtatagactcgctcagcgcctgagctgaacgccacgtcaccccggggcatgcatacatgcatgcatgcatgcatgggtcattcatttcaaggggcttcgcttcaagaaggaggaggggtgcaggacctcttgcagttctcggtgaggcgcgggttcttctccttggcgcaagtgacgctgcaggccttggtgacc

SEQ ID NO: 13404 - DNA, 326 bp, Zea mays
  Clone ID: cC-zmpo14820018f02a1
ggcctcaatgttccgaccatgtattaaaatttgacggaaggcaaagattgtggacaacggttgcaggatgcaaagcaagaactggagcccttgatctcaagaaactaagcagggagatctaccggttgcattgtagcagccagcccatacaaaacgacgtgtgcgtggcggcagatcatctgatcagctgatcaattaagagcgcttgctatcattcccttgccggtcctgcagtgtgccgcccccgcacgggcgcgcgcgggcctccgggtgcatgaggagcttgaacctgccgtccttcttgcagggctgcagcaactcctgcg

SEQ ID NO: 13405 - DNA, 283 bp, Zea mays
  unsure at all n locations
  Clone ID: cC-zmpo14820018f02d1
tgctgcagccctgcaaagaggacgggtagttcttgctccttatgcacccggatgcccgttcgcaggccgagcgggggcgagacactgcaggaacagcaagggaatgagagctagcgctcttaatagatcagctgatcagatgatctggcgncacgcacacgtagtcttgtatgggctggctgctacaatgcaaccaggagatctccctgcttagttgcttgagatcgagggctccaggtctagctttgcatcctgcaaccgntgtccacaatctttgccttcc

SEQ ID NO: 13406 - DNA, 430 bp, Zea mays
  Clone ID: cC-zmpo14820018f03a1
aaaaaacaggatcctatcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcatcaggtcacctggttgttgcagcagcaggagcaggaccaggagggaagttcacccactgcagctgcagctgtatctccccgctctcgacgttcctgagccggaggatcatgtcctgcgcgaacttgccgttcctccagcacacgtggctctcgtcggcgaggcagttcctggcgctcggccgctcggacctgatgatggcgccgttcctcagactctcctcccgcgggttcatgctcacc

SEQ ID NO: 13407 - DNA, 256 bp, Zea mays
  Clone ID: cC-zmpo14820018f03d1
cccaagcgttcggcgataatgtgaagggacttcttcgaccctctcttcattagcacgcttacttgttatctgcatgatctaagcaaagactagatttatttatggacggattggttggcctcttgaaagttcgtgtggaccggggtatcaaccttgcctaccgcgacgcaagaagcagcgatccttatgtcgtcctacggctagtctagtataatctgtagactagcgtgaataatagatccgtgaaccccatttg

SEQ ID NO: 13408 - DNA, 363 bp, Zea mays
  Clone ID: cC-zmpo14820018f04a1
atattacagatcattccttgcaaggcctaccaatttcccacagacccgcgggccaactcaccgctagacaccccccccgcccccgggggccccccagttcaactgtaataccctcacaaaaccccccaccccagggaatggaaaaaccggtcccaaaaacaaaggaacctccccaaccaaatcacccaaaaaaaacgcccggaaatcaaaagaggaaagcccggggacaaaaatggcgggccccccccaccaaaaatatcgcccccccacccccaaaggccaaaaacaaaaaaacacgcccccagcttaataaaaaaaccagcaccaccgcgaagaaaggggttttcttcatccccccccccg

SEQ ID NO: 13409 - DNA, 448 bp, Zea mays
  unsure at all n locations
  Clone ID: cC-zmpo14820018f05d1
gacccacgcgtccgccaaaccgacgaaggcgtcgaataagatcggtcctcatcgtcgcggcgatgcttctcatcacgctcgagctggaagccgcccctccggcgaccgccatggactgcaaggccgggtgagacgaggtcacgggcccactccacatgagcatggaggactgcatgaagaggagcaaagagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttagaatcgagtccactcgatcgagagatcgatcgatgcttggtattatatttgnattccacattatatataagaaatacaaattaaa

SEQ ID NO: 13410 - DNA, 418 bp, Zea mays
  Clone ID: cC-zmpo14820018f06d1
cccacgcgtgcgcctggaaccacagaccacaaaggaggggacacacacacacacacaccgtctccgcccgcccgccgagacgcgccatggctatggctcgctccggcgcgcacctcttctttcccatcctccttatgtacaccgcgcccgccgagcgggccatcaccgacgccgccggcggacccggatacctccaggaagcgtgcaacaagacgctgatccccaaagtgggcatgcacgcgctcaagagacaacccagagtgccaggcggagacggcggtcacgccgcgcctgctggccgagctgctcgagtacgtgtcggccgaggagggcatgaccgaggccgcgttcgcgcaccacgagctcaacgccatcaaagacgacgacgtcctgtacaagtgcatcgacacctgctccg

SEQ ID NO: 13411 - DNA, 403 bp, Zea mays
  Clone ID: cC-zmpo14820018f07d1
agactttccgtagatggcatagacagctactgcaactattcccgttcgagaagacattactaagtccttgaaaatgtcaaaagatacagcgatagtgctaacctctttttttcggccaaatctccggttcagcgtaatgcacagcaaaacttctgcctcatcatatggaaaggacttccaagaactgataggggcatataaggcttcatgggaaggacagcaaattcttcatggaattgacactgactccgaaagcagttcatatgaatctctgaatgatagtgcatctgacgatgaagatgcatatgttatttctgcagaccacggggataagaatgtaggaaaaacaaaaactagcatgactttggtagaagaaaacattgaaaatgagttggatttgtat

SEQ ID NO: 13412 - DNA, 368 bp, Zea mays
  unsure at all n locations
  Clone ID: cC-zmpo14820018f08d1
gacccacgcgtccgccttaccctcgaagccgaaagcctggagccttctctttcttccttctaaggagaaggacctgtaaaggggtgagcggggccgccgtagtgctgtacaacaatggcgctgacgctgcctcctgcactggcgtccctatcgcaacaatacaccttcctgacatagagaacatcaatggggatggttccacgatcacctcgggcgcaaacaaccaggtagaggcgttgctcagtgtcagagaatacaccaaggacgaaggccatcggttgacgtttgattgcataagtcccgtntcctggaggagcccttccactcgcatgaagcgcgaggcgttcatccttttagggaaatgttcc

SEQ ID NO: 13413 - DNA, 359 bp, Zea mays
  Clone ID: cC-zmpo14820018f09d1
caagcattgaagccgtagccgccgccgccggacgagactggttgaggcggggcggcaatggccgccggggaccttgaggagctcaccgcgctcgacaccgcgaagacgcaatggtaccacttcaccgccatcgaggtcgccggcatgggattcttcaccgacgcctacgacctcttctgcatctccctcgtggccatcgtcgtgtccgcgtcgttcaaggccaggttcccagccccggcctacgccgtcgaccccgccgggtccacgccgccgcaagccgacttcgtgaggcggatcatcctgatgctgggcgcgaagcccgcggcgctcacctactactggcgcaccaagatgcccga

SEQ ID NO: 13414 - DNA, 290 bp, Zea mays
  Clone ID: cC-zmpo14820018f10d1
ggcggagcacctagctggatgaaggattaccactcggctccgcttgactcgtcctcttttaagagtgagagtgggggcacggctgctgcaaatccctgggcttctcaagagatagtcatggatggagcaagcgtcggagaaacctccttcagggacacgaaaagcgaggcatgcgacgacgcctcgggcacatgccaggacctccccgccgttcccaagaagtccaaccgccggaaaaacaagggaagctccgaggggagcgagagcgccgcggccaaagacaccaccga

SEQ ID NO: 13415 - DNA, 351 bp, Zea mays
  Clone ID: cC-zmpo14820018g01a1
aacccctgaatttggttggtttttggagaataaattttataccctcaaattcaaggttttacaccctcaaacataatatagctgtcggaggtctgtccctttactgttttgctttaccaatggattgcatctaatgggcaatgcaaggacgaaaaaaaaattataactagagagatgggtcactctacggagggtttaaaagcatgcaagctccttgaggcaacccttggtgcttcccttggcgttcgtgcatatagccatggtcttgttgttggtgccgttatactcgacgttgacgtcattcatggtgaccccggtgcatgggaccttggcagtgcagagcatgctaac

SEQ ID NO: 13416 - DNA, 354 bp, Zea mays
  Clone ID: cC-zmpo14820018g02a1
attctcacctttttgtataggtttattatatatcttcaattctttatcttcttcattcatttcaccacaaaacaacacctccaaaacaaagtaagattagactcaaagggccataacacccaaaaaaaaaaaaacgtcccccccctaaaaaaccccccccccccaccaccacaagagaacaaaaaaaacgacataccccacaaaaaaccaccccacctaaactcgaccctaatctaattcccccaaaaacaccccccgtaccaaatgagggggaaaatttctccccacattcccccacaaaaaaaaatttttccaacacccccccccataaaaaccaaattctcaaacctctcc

SEQ ID NO: 13417 - DNA, 348 bp, Zea mays
  unsure at all n locations
  Clone ID: cC-zmpo14820018g02d1
gtcgatcccatcgcgtccgcagttcatagcccaagatgaaagtctgagaacgggttctgaattgagatgtcaaagtgagacccgatacccgataacccatgaagaattcccctattagggtacgggtatgagacaaaaattggcccatgggtatggatatgggacaaaatctcctcccataggagaaacgggtatgggtttgggaagcaataatccgaacccgattacccatgggtatttcatacgcgtacacctgtcctgtttgtatgaatgagttgagagccgagtcggccatcaaacccggcaggctccatttcttatataggtcccaagnactgaaatattata

SEQ ID NO: 13418 - DNA, 240 bp, Zea mays
  Clone ID: cC-zmpo14820018g03a1
ggtatgggttacttttttcacccctttctcccccccccaccaacacctcaaatcccacacacccaacccaatacaatcccacctaaacactaacaaaaacaacctcacaaaaaactctccatcacactcaccactacaacacataaaacaaaaccaaatctccccactaccaaaaatcccaaaaaaccaaaccacaaaactctacgccatcaaacacaacaaccccccaccccccccccc

SEQ ID NO: 13419 - DNA, 467 bp, Zea mays
  Clone ID: cC-zmpo14820018g04a1
gtatcggaatgaaaatccatgaacagtatcatcggtagttgaactgtgaagaatcatgtattggtactgtacgtgtccatggatctttaatggccacaggtgccatgaaaataataccgcacaggattagagggggtttcaatgagtgatcgacatgccgacggacacatcgatcatcggccgcaaccgttcatccttcatcggccggcgaggcagccaggacgccatgcgacgcagctgttcgcgcctattggcagtccgccaacaggcactggcaatacggcctccacgaccatgcccagttgcagcggccgtccgcgtggccgtgatcctggcaggtcgccacgcagtcttcgggaaagcagatagggtggtggtcgtcgtccttccagcagctctcgtcatgagcagtccacaccgttgcgctggaggcgacgatgaacagcacaagaagggcacagcacacc

SEQ ID NO: 13420 - DNA, 449 bp, Zea mays
  unsure at all n locations
  Clone ID: cC-zmpo14820018g04d1
ttcgacccacgcgtgcggcattacgaggccaaaagtaagctgctgctgttcttcagacccgtcccgttcgttcgaatcgctctttccgccatggaggctcggaggaagcccgcggagagctgagcccttctagagcagctcatcggcaactccagcgcaacggtgtcgactggtcatgacgagagctgctggaaggacgacgaccaccaccctatctgctttcccgaagactgcgtggcgacctgccaggatcacggccacgcggacggacgctagaactgggcatggtcgcggatgccgtattgccagtgcctgttggcggactgccaataggcgcgaacagctgcgtcgcatggcgtcctggctgcctcaccggccgatgaaagaagaacggntgcggccgctgatcgatgtgtccgtcggcattgtcgatcactcattgaaacccc

SEQ ID NO: 13421 - DNA, 344 bp, Zea mays
  Clone ID: cC-zmpo14820018g05d1
gcgtccctactgggcaattccccaaacctaactaaccttagcctccgagggagccaccatgggtggccagatgccggacgccgacgggtaagcccgctcggcggactcctcgtcctcttacgggtacccgccgtcagcgccgtcgcagcaccagtacggcacctttggtcccccatccggagcctccggggagtttccgcagccggcggtcggattcccccagccgggggcgccgcctgggatgctgcactacccgcagcctcctccggcgtggtatgccggctaccctcccccgcagcaaccctactcggccgccgagccggactacgcccaaagctaccaga

SEQ ID NO: 13422 - DNA, 343 bp, Zea mays
  Clone ID: cC-zmpo14820018g06d1
caaagacttgatttagttatggacggatatggaggcctcttgaaagttcgcgaggtccggggtatcaaccttgcctaccgggacgcaagaggctgcgatccgtatgtcgccctacggcttggcaagaagaaactgaagacatgcgtgaagtagagatccgtgaaccccatatggcaagaggagctaactctgaccgccacagatcccagccaaccactgaagctggtggagttcgacaagagacaccttcagcagagacgaccccatgggtgacgcggatgtggacgaggcgccactgatggtggcggtgagcatgaacccgcgggaagagagtctgaggtac

SEQ ID NO: 13423 - DNA, 408 bp, Zea mays
  unsure at all n locations
  Clone ID: cC-zmpo14820018g08d1
gagacaccaagcgtagaactcgcctaagcagctatcaaccaaccctagaaagctagacaccgtacccatggctcgcgctagcgtcgtctttgtcattgccgctctcctcttcgtcgccatggtcgtagcaccgatggccgaggcaaagtccgccgatgcccctgaggctgacgcgccagccgaaggacctagcgggccggctgctgcacctggcccccagggtgtcgaaagcctgtcaggcaatgaggatgacgatgatgactccaccaattgaagccacacacgtcggcccggntaaatttggaacaagacatggaagaaaaatgagagcaatgtctttaaaaccatgataatggagaggncatccactcatccatggatacatncttgctctccctctttttcttt

SEQ ID NO: 13424 - DNA, 381 bp, Zea mays
  Clone ID: cC-zmpo14820018g09d1
gacccacgcgtccgaccttccagcagatgtggattgccatggctgagtacgtcgagtctggcccgtccatcgcgcacaggaaaagcttctaattctttgggcccaagagatgcaagccgagatgtgccattatcgccagcctcccgccccgtttctttctgcttttggtgctgtttcttcattagcatgaacaaaggtttctgccggcctgtcggcagccgctttctcctattcatcaagactgtaatgtctattgttgctacctaatgcttctcacttgcgattttggacacatgttcgacctattcaatttttaagagatgcctgatgaggctacttgccaacatttgtaaatgaacaaaaatgcctccggttaacaaa

SEQ ID NO: 13425 - DNA, 323 bp, Zea mays
  Clone ID: cC-zmpo14820018h01a1
gggccacaaatcaacattaacatttttgaaggggatgacagagatcccctaggatagggaattaattccaaaagtttgaggcttctgactaaaaaaaaatacattgtttggttttttgatcatccaaaaaaaaaagaaaattccacccaccggtttttttattcgggggatactttgatagtccttgaaaaaaaaagaggttacaaatagggattattttttttatttatgcctgttagtcaattggtttaaatgcaggcgatctctttttccaaacccattggacttgcctatggtgttctttgcatacggccaatgtcttt

SEQ ID NO: 13426 - DNA, 445 bp, Zea mays
  Clone ID: cC-zmpo14820018h02a1
gcagcggaatttctttattacaaaagggtacaagttacatcaaatttacattaagtttattggagtgattacaaagggattcaaagaaataaatattgaaatggggataaattacttgtaagttcgaaatatatgctatcttaagtgaccatccttaataagaagtttagaagaggtacttatactattaagaaggccgagcccaccggcacttagcaccattcacagcaacacacttctatttttggttcttccttctgcttgggaaccacctttgtacaaaagaatgaaagcttcgcaggctcttcaccaaatgggatggcgtaatcacctccggtcaccgctcaaaagtcgtcttccgctgtgtagatttttcggtgaacaatcccaaggtgccccggaataaatccacccggaatgaccacatgatttgcactggagaatg

SEQ ID NO: 13427 - DNA, 258 bp, Zea mays
  Clone ID: cC-zmpo14820018h03a1
gggttggtgttttttttttatttttttttctttttttttttctggggaaaaaaatcttttcccctaaatttaagggggttcccccctcccacaataaataatcctgtggtagtttgcccctatacctggtgggcccaccacaggttactttttaaggggcacttcctggcccgtaaaaaaatttttccttgaagaatgggctccccccgggggggtctaaaaacttgcaactccctcttggccccccctggtgcttcc

SEQ ID NO: 13428 - DNA, 451 bp, Zea mays
  Clone ID: cC-zmpo14820018h04a1
ttttcttttttttttttttttttttttttttattatatcaagggtcggttctgagttttagtttaaggatgaacatttttacaaaatactacatgcaggcgatatattttgctttgccttgaacaaacaatggagaagttttatcctggcccatataaaaaaaaccacaaatgtttctggctcctatgtacaaaccgaaaaatggacggtaaaatcttcctacccaaaactgccagatttttggcactgttaagatatacaccttggtttgccggttcccttttataaatttatcaaatttctcattatactggggccggggaacttttcagagctgggaagtaacccttcttcgacatcctttagaagattgtcactgtttatattgatacccccatgatattaaccctttatacaaaggccagggtaacaaaactgcagaattggtggc

SEQ ID NO: 13429 - DNA, 356 bp, Zea mays
  Clone ID: cC-zmpo14820018h05d1
ttcatcttcagcaacgctcaggtggtgttccagttctgtctcatccaggagcgcaagagcatggacaaccagcagatcatcggcacggcgctaggcctcaaggagaggcggtcggtgggcggctccgtcatccactacttggacccgtagcgccgcacccgaagttctagaagagcgtctgccggttcaagaccttcctggtccgcccgaggtaggagctctcgcgcacgctctacatccagtcggtgatcggggaggtcatctacccgcagggcttgctgtcgtggctcgggcacttcggcctcagcacctgcttctacgccgaggtggataacctcgggcccggcgcctacttg

SEQ ID NO: 13430 - DNA, 254 bp, Zea mays
  Clone ID: cC-zmpo14820018h06d1
gacccacgcgtgaaaggttttcgagttcgctacatgcgtgtgcaatagccggcctgctctttcccggagacccccgacgccaccggggacagtagacagccgactcgagctcaatctcgaagatctcgccgcctgcggcggcacgaactgcttcggcacgctcacctgcgaaaggagcagcttcttctaccgccgcctcccggagccccgactccgattaaccattcaaaaactagacgactccttcttaaaca

SEQ ID NO: 13431 - DNA, 128 bp, Zea mays
  unsure at all n locations
  Clone ID: cC-zmpo14820018h10d1
acccacgcgtgcgggccgncagcatgaacgccatcggctagtccatcggcttttcaaatgagctcgcctgcatctgaaccaatggactaacttgcctatattagctcctaggtctttgcccgcgcatt

SEQ ID NO: 13432 - DNA, 460 bp, Zea mays
  unsure at all n locations
  Clone ID: cC-zmpo14820021a01d1
gccgccatagtcggccacgacggcgccgtttgggcccagagcatcgcattcccacaggtcaagccagaggagatgaccaacatcattaaggacttcgacgagcctgcgtttttggccccgatcggcctcttccttggccccaccaaatacatggtcatccaattccaacccatctctttcatccacataaataanggagctggaggcggggggggaanaagaccctacaacccctntttatctgcatctacgacnatcccattacccctggacagtgcaacatggtggtcgagaggctcattgactacctcgtagagcaaggcctgtgattgaatgcatccaaacaacgacaccaacgcccacattaattaattagtagtctccatgccctgggattgtccgtggccgctcctttaaacaccaccccatccttcgttcggcattttttgccccttgttca

SEQ ID NO: 13433 - DNA, 603 bp, Zea mays
  unsure at all n locations
  Clone ID: cC-zmpo14820021a02d1
agcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaatactttcatgtgactntntccacaatcnccnncaccacgaacggcctgcgcatcaagtggtacgaggactccaagtcgtcnctcaaggccancaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccatttgactaacatgcatatattatatatataatcactcttcg

SEQ ID NO: 13434 - DNA, 616 bp, Zea mays
  Clone ID: cC-zmpo14820021a03d1
cgaggcccgagttggccagctctccccgtcgtcgtccgtccctctcctcgtctccgcctccccggactccgtcagggagggagggaggtgaacggtccggggagagagatggggccggactcgtcgcccaagaagttgatccttaaggagcaacgcgctgcggacgtggagtgggtcgccctctccgacaaaaaccgatatggccgtctgacggggaacgatgcgctcaggttcttcgccatgtccaacctctccaagcccgagctaaagcaggtttgggcgatcgctgattccaaacgccaaggatatcttggattctacgagttcatgactgccatgcagctggtttctctcgcacaagcagggaacgaaatcaatcaagacacccttccaaatgcagatctcgagaagttgcagctccccacagtggaaggtctggctaaaaaactaaaaaagaactctgggagcaagatcgagtctgctattgttgcatgtcatccatcagaagcacctactatgactgccagctggtttaactccaaagcaggaaagaagattcctttgaaataagtcacttaatcgtcgatgggctaaagaaatccgacattgagaagtt

SEQ ID NO: 13435 - DNA, 545 bp, Zea mays
  unsure at all n locations
  Clone ID: cC-zmpo14820021a04d1
cagagctcctgactgttcctctctccctcctcacgggcgggctccgtctgttccgtccatccaccgccccggtcgtctcccggccagatccctctcctgcaaggtttctttgcgagtggccggacaacatgatgggcggtttcctctccaggggggtnccggccnagggggggctatncctatcctncctataaatgctacaatacctttgaactgaacaaaccacacattgagcagctcatattccggtgtcagcattggattttagttgccctgttgacagttttggagagatttggagattttacattatcatggctaccgttttactcagacgcaaaggcgttgttctttgtatatttgaggtaccctaagacatagggaactacgtatgtttatggaactttctttaagccatatatttcttagcatgagaatgaaatcgaccgaaatcttattgagcgtcaggctagagcccccgatatgtgtgtcctttacttccataaggctgcttcggttgggcaaaatactcttttcgacgtttt

SEQ ID NO: 13436 - DNA, 379 bp, Zea mays
  Clone ID: cC-zmpo14820021a05d1
caccggcacctcctccaccccggaggccgttagcctgctctgcactgccaaggttccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattacatgctatccattggtaacgcacaacagtaaaatgacagacatccgacagctatattatgttcgacggtgtaacaccctgaatttgagggtataaaattttttctctaaataccaaccaaattcaggtgtt

SEQ ID NO: 13437 - DNA, 589 bp, Zea mays
  Clone ID: cC-zmpo14820021a06d1
cttttattgaaagtggagggttcaagatttgtcctcttaagtgtcgcaatggaataccccggactcaggttcagcaccttatgcagattgatctgaagggatggttcttgaactactctacttcctttcagtatcattctttgctgcagatactgaactgtgttgccgatgatattcatataactccaaggattcctgcaatggagagcatggctgatgtgaatttagcacaaaaggacgagaagcttaaagaagttgactccaaaactaaaccagaagatcaacaacaagcagaaaataaaaatatgggaacaattgatgaagaatcagatgacgatgaggactatcatgttcctgaagctgatatagaggaaatcactaacaaatctgacaatgaagctaaacacacagatgagcctccagaaaaaattgatttatcttgcttttctgggatacttcatcatgatccggatgagaaaagccgcaactgttggacagtacctgatagcaagctttttaaagttcgtagcaagaatttcccaaatgacaaatcgaagatacctgctggcagtaatctcatggagcttgc

SEQ ID NO: 13438 - DNA, 540 bp, Zea mays
  Clone ID: cC-zmpo14820021a07d1
atccacaaaagggacttccgttccgtgctagcgcgcgatcgcttcggcctccactccaccttcccgaaaaagcttaccctttgtgtttgtgtgtctgtctggcaatcgatcgatctccatgacgacgtccccgccgcgcgcacgcctgctcgccatggcgctggcgctggcattcgcctgcgtgctgctcgtcaggtccgcggacgccgccacgcccggcggctccgcgtacgggtgcaacccggccacggacaggacgtgcaggcccgagggcgtcggggtggtgctgcccgacggcggcattgacctcgacggcgacggcgacgaggacgagctgccgcagttcgacccacacttcacgatcctcggccatgcccagtgagtgtgagtgcaggtgcagctggctggttggtcatctcagtcggtgtactggacatgcgtcgtaatctctgtcgttcattcgacgcgagaagaattgagtgggcatgtatgtgatggtaaactgttcactgttcaaacttgaaagcgcactgattcaag

SEQ ID NO: 13439 - DNA, 412 bp, Zea mays
  Clone ID: cC-zmpo14820021a08a1
ggggaggaattatgtaagaaccaggtcattacttcattttataggaaaaatacagaaacgggaaaaaaaaattccacattccaaaggccattggagcgttgcatgtccatgcaattcaccctacagaaaaatggtcgagtcaacctcagagggggggggggcgggttaaggccaatcaccaatttctaaatattttatggcgggggggaaaagagccaaagcaaataccccgggaggaaggcctttgctttggtggtactattatgggaaggcgaaactcgaaaccattggggtggacatgcattccagcgggtccgttgtatttccatgccctgttaaagcgggaggtcgcccaccctttccaccaccatgttgcactgcccaggcgttatcggtttgtcgtaaatgccaa

SEQ ID NO: 13440 - DNA, 568 bp, Zea mays
  unsure at all n locations
  Clone ID: cC-zmpo14820021a08d1
gagcgatctcctctccctctccctctccgatccattctccagcgtagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaatatagtaacaacanagcaaaggcctttctcccggcgta

SEQ ID NO: 13441 - DNA, 395 bp, Zea mays
  unsure at all n locations
  Clone ID: cC-zmpo14820021a09a1
gaagcaacaacgtaaacagccataattattctcaataacccggtagcaatgcaggggaattaacaactcttacaacatcaggtgttgtaaaccacacaatacttcagaacatacacacataacacgatagcaggagcaactcacggcagatcacgggataagggcagcacactggcctgatgctgcntcatcaacaaacttctctagtactcgtcaccctcgtcgccatcctcgccctcatcgaactcagcgccgacctcctcgtagtccttctcgagcgccgccaggtcctcacgggcctcagagaactcacctttcttcataccctcaccgacgtaccaatgcacgaaggcacgcttggcgtacatgaggtccaacttgtggtcgatgcggga

SEQ ID NO: 13442 - DNA, 349 bp, Zea mays
  Clone ID: cC-zmpo14820021a09d1
aagtgcggtatcaactaccagccttctatcgttgtgcctggtggcgacctggccaaggtgcagcgtgctgtgtgcatgatctccaactccaccagtgttgtggaggtgttctcccgcatcgaccacaagttcgacctcatgtacgccaagcgtgccttcgtgcactggtacgtcggtgagggtatggaggaaggtgagttctctgaggcccgtgaggacctggcggcgctcgagaaggactactaggaggtctgcgctgagttcgatgagggcgaggatggcgacgagggtgacgagtactagaagaagtttgctgatgacgcaacatcacgccagtgtgctgccctta

SEQ ID NO: 13443 - DNA, 510 bp, Zea mays
  Clone ID: cC-zmpo14820021a10a1
aaaacagcaaaccaaacaagggctatggtcatcctggttaattgcaatcaaagcaaccaaacaagagctctcaatgtacttgcacaagcctacacaggctaggcgcagcttgcatctgagctgagaaccagtctctcagcatccaacaaccaaacacattgtataactacagagatgggtcaatggtgggtctagaagcatgcgagcgccttcaggcaacccttggcgctgcccttagcgttcttgcatacagccatggtcttgttgttggtgccactgtagttgatgttgacgtcgtccatggtgacaccggtgcatgggatcttggcggagcagagcaagttgacggcctccggggtggaggaggtgccggtgatgttcttgaaggtgacgtccttgaccgtgaccttggaggcaccattggcggagcataacttgttggggcagtacttcatgtcgatgatgatggggtagcccgagtcctccatcttgatattctcatagtggatc

SEQ ID NO: 13444 - DNA, 378 bp, Zea mays
  Clone ID: cC-zmpo14820021a10d1
cacaacaagatggcatgtatagacaatgcaatgagagccttgtttcttctagcgctcttctgcaccgtgcatggtgagaaggcaaagtcaaaggacaacgattcaaaagcgtccgggcccggtgggtccttcgacatcaccaagttgggcgcctctggcaatggcaagacggatagcacgaaggctgtgcaggaggcgtgggcatcggcgtgcggcggcaccgggaagcagacgatcctcatccccaagggcgacttcctcgtcggaccactcaacttcacaggcccatgctagggcgacgtgaccatccaagtgaatggcaatctgctggcgaccacggacctaagccagtacaaggatcatggtaattggatcgag

SEQ ID NO: 13445 - DNA, 516 bp, Zea mays
  Clone ID: cC-zmpo14820021a12a1
tttttttttttttttttttttttttttttttttttttttttttttttttttttttttggtttttttttattattttttttttttttttttttttttttttttaaaaaaaaaaaaaaaatcttttttggtaaaaaaaacaccgggaattcccctttaaaaaaattggggggggggtttttttccaaaaacacccctttttttaaaaaaaaaaggttttttttaaaagggtttttggccaccccccccccccgaaaaattgactcccccaaaaaaatttttgaaaggggggcccaatttgggggggctttcaaaggtttccagaaaaggggggaacctttggaaaggggcaaaaacggggggggggggggtttcctcttttttttttgggaccggggggcccacccggaaattcccaaccggtcccgggggggccaccaattttctttatgggggggctaaaaaaacgcggggaaaaaaagggcaaaaactttttctgggggaaaatttttttcccct

SEQ ID NO: 13446 - DNA, 473 bp, Zea mays
  Clone ID: cC-zmpo14820021a12d1
gcgagaaaacaaggaggaactcctcatcctcctcgcttctgccctttccaaaaggttcctccttgtcctggatgacttggagagcccgagcatatgggacaatctgctcaaagattcattgggagagatcatgctgacgtgtacgtacgtgggcggagatgcgattcaaatgcatgctttgattgtacagagagtggctcgtttggcatatagctccgctacatgattctctaatagggtaattccgtgtgattctctaacaaaagtgaatctgctatttgatgaaaaaaaaaaaaaaaaaaataaaaaataaaaaaaataaaatgataacaactgaaattaaaataaaaaaaagctatcaaatggatattgaataagaaaaaaaaaaaaggggggggccgttttaagggatccagtttttcgatcgcgtgcttggaacataaaagttttttttttggggcccctaaattcaa

SEQ ID NO: 13447 - DNA, 506 bp, Zea mays
  unsure at all n locations
  Clone ID: cC-zmpo14820021b01d1
cgaccgggagggagatttagaacaccctatgcggagcatccttaagcgtgggatgtagggatggatggcctcggaccatggcgtttccttgccggtacgggtccgtcgtcgtgccgctgaggttgggcagacctgggcatgcttcgaagggctggcatgcgctgcgccgtggccggaattgttgccgccacggacttgtcttcacgaggtttctactatccaaagaatcaccctggtaactggaatctcaagtgccaggtcaagaacaagtaccacaggatgaagcgcttggaggatgctgttataagttcntaantnntctaagtcatcttctcccactcaactttgggttgctggaccgttgtctccttataatttaattatttattttgtataaaattcatgttatgtagtaaagatatgacattcgatcttgtgccatgattcatcatatgtgtgagactttgtcccagcacacctggtgattatgttcacgtccgggcttt

SEQ ID NO: 13448 - DNA, 536 bp, Zea mays
  Clone ID: cC-zmpo14820021b02d1
cttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacagctccgtttgggcccatagcaccgcattcccacagttcaagccagaggagatgaccaacatcattaaggacttctacgagcctgggtttctggccccaatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaggctcggagactacctcgtagagcatggcctgtgaatgcatccaaacaacgacaccaacgccaacattaattaattagtagtctccatgccctgg

SEQ ID NO: 13449 - DNA, 573 bp, Zea mays
  Clone ID: cC-zmpo14820021b03d1
caaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagcagctcatcagtggcaaggaggatgcagctaacaatttcgcccgtggccattacacaattggcaaggagattgttgatctgtgccttgaccgtatccgcaagcttgctgacaactgcaccggcctccagggcttcctggtcttcatgcccgtggtggtggcaccggctt

SEQ ID NO: 13450 - DNA, 492 bp, Zea mays
  Clone ID: cC-zmpo14820021b04d1
gtctgtgtatactgtgtaaaggtcctaaaggaatgagaagatgctcatattcaaagccaaaaatgggaaaaattaggataataaaataaaataaaaaatatataaaaaaaaaaataataataaataccaatgtgattttttgttatggggcttgggggggtgagagtaaaattattaattagagaggggggtccttttattggggttctattttctttcctgttttttggggcatatatttttttttttcgttgtccttaattcattttgcggggggtttgtttttggtgtcgtttttgtggaaaggggggtgtttcctggttttttcggtgtgtgggaattttgctttttacaggtgggttttatgacttaaggggtggctggggtgtttggttttgttattgggggtgattctcttggggggtagggggcgggctttttgggggtatttaaagtggggggggtgggggtttttctcatgaggatggggtt

SEQ ID NO: 13451 - DNA, 411 bp, Zea mays
  Clone ID: cC-zmpo14820021b05d1
ggagcacagagctagctagccagccagccagcagccagcttgctcgccgcgcctttccttcttcctcgcctccgggccattccgtgccgccctccaccgccgccgccgtattcagggatggagatgaagaagatcgcctgcgccgtcctcgtcgccgcctcggcggccaccgtggcgctcgccgcggaggctccagctccggtcctcaccagcggcttcttccacgacgcgcccgtcgtctgagccgccctcagggccgtcgacccctccttttttgactactacattcagtgagccggtcggtgcgccccgtggccggggaagaaactactgggcgagggagtcacatggctgtgcgcataccgatgcgcgggcgttgtttttggttcgacgcaccttcagccctgtttt

SEQ ID NO: 13452 - DNA, 520 bp, Zea mays
  Clone ID: cC-zmpo14820021b07d1
aaacgagctccgcctctcctctccatctatctatctataaagggcgcatggcggtccctcgccgagaggagttcacgaacgatcctcgccctctccctctgcgtcccccaagcaaagaaaagaagctagctaggctggcgtacaacgaatgacgacgcagggcggcaacaggacgacgacgacgctggtcgccgtcgtggccgtagttctggacgcggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggagtgccggcacttcggcgcgtccaaggagacgctcaaggcggaggcgacgacggacgacagcgggtggtacaagctggagatcgaccaggaccaccaggaggagatctgcgaggtggtgctggcccggagcccccacccggggtgcgcggagatcgag

SEQ ID NO: 13453 - DNA, 321 bp, Zea mays
  Clone ID: cC-zmpo14820021b08a1
aaccaaaaccccctttttaaagccaattttcaaccgggacaaagggggtttttttttaaagggggagggtccccccccaacctgacctttttttttttttttccaggacacacaagttaagcctactgggaccaacaacagttgttggccccccccacaaaattttccaccaagaaaccccaactccaactttaacacgaattcttttgttaagctttctatattccccatttggggaggataaacaaatccccgggttccccctggcaaatgggaacctcattagttttcccgggtgggccctgtatttagggggggggg

SEQ ID NO: 13454 - DNA, 595 bp, Zea mays
  Clone ID: cC-zmpo14820021b08d1
gtgcagcgtggactcattcaacaggaatacagggctatgtatcatgaggaactctcccatcgcatttcatctgaactcaatggaaaccacaagaaagctatgttgctgtggattcttgatcctgctggacgtgatgcaactgttttgagagaagctctaagtggtgacactatggatctgagagcagccactgatattatatgttccaggacaccatcacagttgcaaataatgaaacagacttattatgctagatttggtacttatcttgagcatgacattggtcaccacacatctggcgatcaccagaagcttttacttgcctatgtggggattccacgctacgaaggtcctgaggttgatcctaccattgtgacacatgatgcaaaggatttgtacaaagctggtgagaaaaggctcggtacggatgagaagacctttatccgcgttttcactgaacgcagctgggcacacttggcatctgtttcgtctgcttaccatcatatgtatgaccggaaattagagaaggttatcaagagcgaaacatctggaaactttgaattcgcacttttagctatcctcagatgcgcggaaa

SEQ ID NO: 13455 - DNA, 426 bp, Zea mays
  unsure at all n locations
  Clone ID: cC-zmpo14820021b09a1
caaaaaacgataattttggagtccttgatatcaagaattgatacaattagaggctaagaacatgataacacatcgaaatcaaacagaaagaaaaagagggagagcaagaacatatcacggatgaccacacattattatggatttttggttttaaacaacattgctctcacttttctgggagagcgggggccaaatgcaatcggaccnacntgcttggccttatttggtggagtcatcgtcgtcgtcctcattgcccgatagtccctcgacgccctggggaccaggtgcacctgccggtccgctaggtccatcggcaggtgcgtcagcagcgggggcgggggcatcggcggagggggcatcagcggacttttgcctcggccatcgggcccacaccatggcgacaaagagagagcagcaacgacgaag

SEQ ID NO: 13456 - DNA, 566 bp, Zea mays
  Clone ID: cC-zmpo14820021b10a1
gttaaacatgttctattatattattattacgaggggaaagaagaaaaaaaatcatatttttgtcccacaccagcagcatgcccagcagggtcccactcgtccgactccgatgcatccattcctacccgtggggacaagccacgagcgagacgcgaccccacatcccacagacccacacggtctttgcttcccggaaccggaacccccacgtcgccgcctcgtctgaccggtcaaaccgcacgagctttgacgtatacagcagccatacacacacctctgcgtcaaactcctcccttccgagaagcatcccgtttccaagacgttcacgttcagttcatcctctgagcccgctgacattttggtcccacatgacttcgtccccaccagtaagtgaagccattgcttaataagcgcccccacactagccgcggctggcaattcaccgcgcgactaccggccgtttaaacggcaccccaaccaccgagcaaccactcccggtagccactcctctaccggtgacgcacgcaccccatctctgatctgatctgatctcttcccctggatct

SEQ ID NO: 13457 - DNA, 371 bp, Zea mays
  Clone ID: cC-zmpo14820021b11a1
gggaaacaaacccattttttttttaaaaaaggggggggtttttttaaaggggccccgggggaaacaaaaaaaattcccccccttggagacccccaacccttgggaaaaaaaaaaaggggtgggggaccccccatttgcaaccccggaccccctaaaccccggaacatctcgtttttttaaaaaaaatccaaaccccccggaaatttggaggttttttggcccttcaaaaaaaaaaccaaacccttttctttaacatggggggggcggcaaatattttaaattttaaaccgccttggcccccctggatttggttttgcctaaaacaaacttgccccccctctttggggggggggccgggttctttccccatt

SEQ ID NO: 13458 - DNA, 469 bp, Zea mays
  Clone ID: cC-zmpo14820021b11d1
tgccacttcacgtacctgcgcatgggcgccgagttcttctcccccgaccacttcccgcagttcatggagttcgtgcgaagcgtcgtgtgcggcgagtgggacgaggacgacggccccgccgacgaggagcgtggcatgactgtgtcaggcaataccagatccagggaggccaaggcggtttgaagcttcaactcatcgccgcccccgccatgtctcagtcagctgtctcgttttatttttgaagtgccaaaatacttgcaaatttccgctgctactagatttagctgagaagaacgagatgatccaggtattagtggatcaggagttgcaaatgtgggatcccacatgcattttttcttttgccgatgtttcgtcgtcttcattgttgttaattttttttgtttcatcttgagaccatttatattatactctctcttttctaaattataattcgtttaaatttcaaaat

SEQ ID NO: 13459 - DNA, 268 bp, Zea mays
  unsure at all n locations
  Clone ID: cC-zmpo14820021b12a1
ggaataatccccggattccaaagggggccacctatatatattgtgacggttacctgaaacaacacgacatggaaggaaagaggggggaacacacatatttttcagatcagcatctatccttcactcatttgatgggtaggggccgaacaagcacnttccaatcacatttcaattgcaatggcagaccaatgggtcattagcatcagtgccaaaccgaagggacgaacaaacaaacgagctgaaacgtcaattagcagcatccgtcttg

SEQ ID NO: 13460 - DNA, 556 bp, Zea mays
  Clone ID: cC-zmpo14820021c01d1
ggtgtcctccgcccgtgcgctcatcggcctcctcgtcgccgcggcctccctcgccgtcgcgctctcggatggcggcgggagcgggatggcggcgccggtgtacgggtacgcggcggggagccccaacgggccggagaactgggggaagcttaaccccgcgtacaagctgtgcggggaggggaagcatcagtccccgatcgacatcgtcaccaagcaggccgtccccgccgccaccctcgacaccctcaaccgcacctacggcgccaccaacgccacgctcatcaacgacggccacgacatcacgctggcgctcgagggcaaggttgggacggtgacggtgaacggcaaggcgtacagcttcgagaagctgcactggcactcgccctccgaccacaccatcaacggccagaggttcccgctggagctgcacctggtccacaggagcgccgacggcgcgctggcggtcatggggaacctctaccagctgtgcgccctggactccttctactaccagctgaagcggcagctgggcgagatggcccaggaccggtgcgac

SEQ ID NO: 13461 - DNA, 631 bp, Zea mays
  Clone ID: cC-zmpo14820021c02d1
gaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcaagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaggagatatagatggagaaggagaagccatcgctaagctaattgactgcatgtcaattggctgatgcctgatgatcaatgtgcaagaaagagatcgaccactaattggcatacatgtttaagtcgggagagagactcggtccccttgaaacaaaacaaa

SEQ ID NO: 13462 - DNA, 117 bp, Zea mays
  Clone ID: cC-zmpo14820021c03d1
gcaagtttccagattggccggtatctcactgccaatgagcttttttgcctccgtaacggcgcagggtgtgtaatggcttatttattcctagtatatacaagttggggtgagatgtgc

SEQ ID NO: 13463 - DNA, 544 bp, Zea mays
  Clone ID: cC-zmpo14820021c04d1
ggccggcatcgtgcccatctcctatcgcagggtggcatgcgcaaagcagggcggcatccggtacaccatcaccgggaacaagtacttcaacatggtgacgatcaccaacgtgggcggcgccggcgacatcgcggcggtgtcggtgaaggggagcaagcgcgtcaagtggacggagatgaagcgcaactgggggcaagtgtggcagaccgaggaggacctcacctgcgagtcgctgacgttccgggtgatgactagcgaccaccgcaaggccacctcatggcacgttctccccgctgactggaggtgcggcgtcacgtaccaggcgtccaagaacttctaagtagccactttccctcctcttcttcaacctgcatgcccgcaagcagccatgcagatgataacatgcatcatgcatgcatattcattctttcgctcaatgcactccgatacggtgccagagttaaaaaatgtaaatcaatgtgcaaattctaaaaaaatatagatatatattattttattattatttttattataatttaatatt

SEQ ID NO: 13464 - DNA, 400 bp, Zea mays
  Clone ID: cC-zmpo14820021c05d1
tgcgtccgctacctattccttacgtcccccaagctgagaaaagaagctagctccctcggtttagaacgaatgaccacgcagggcggccacaggtctactaccacgctggtcagccggcgtggccggtgttctggccgtggccgatgcgtggttcttcgccggggtggcgaccggggaaaaagcgggcggataatgggagacggcgtgcgagtgcatgcgacccctgccgagccgggttcgagacgaacgtatccagaagacggaccagaacaacagtggaagtggtgatgacggcacttttatggcgtgcaatgagactctcagggcttgtgctacgacggaccacagccggtggtgcaagcttgagagagacctttaccaccaggaggagatctgcgag

SEQ ID NO: 13465 - DNA, 445 bp, Zea mays
  Clone ID: cC-zmpo14820021c06d1
aaaaaaaaaaaaaaaaaaaaaaaaaaaaaaaaaaaaaaaaaaaaaaaaaaaaaatttttaaagaaaaaaaacaacaggagcataatcgggggctttttctccccggaggctcgtagcccgcatctgtactgtctaggtcccatgcaccggcgctcacctaagatagatgtcaacgccaagattttcggtaccaacagtatgaccatggctatatgcaccaacaccaatggctacaccaaagcatgccttaaggagcttgcatgcttataaacccttcgtcaactgacccatctctctagttataattaattctctcgttcttgcattgcccattagaagctatccattggcaacgcacaacagttaaacgacagacatttcgacagctatattaatgtttgacggggtaacaccctgaatttgagggtataaaatttattcttcc

SEQ ID NO: 13466 - DNA, 479 bp, Zea mays
  Clone ID: cC-zmpo14820021c07d1
ctggcctgcggtgcattccgtgccgcccttcaccggcggcggcgcattcagggatggatatgaagaagaaacgctgcgccgttctcgtcgccgcctcggcggacaccgtggctctcgccgcggaggctccggctccggtccccaccatcgggtcctccgccgtcgcgcccgccgtcggggccgccctcggtgccgtcgtcgacttcttcttcgcctactacattcagtgagccggccggggcgcccggaggtcgaggaagagactaatgggagagagagtgacaaggctgcgctcattccgatgcgtgggcatgttttttgatgcgacacaccttttgggctctgtttctttgaaccctctttctccttaattaaacgaattgatgcatgccgctgatgttcttgccctgagagagggagtaacacttggatcatttcatcgcttgccatttgtgtggaagcattcagcaattgattct

SEQ ID NO: 13467 - DNA, 335 bp, Zea mays
  Clone ID: cC-zmpo14820021c08a1
ggcggccccgaaaaaaagggttggacactaaaattcatccccccctccatgggggcgggatcccccgggggggcggtcccccccccccccaacccccaattttcctccccccccccccccccacattttttttttccccccccccttcaattctcccgggggttttttcttcccctaaaaaacccaaaaccccccccaccgtgtgcggattgtggaacatggccccaaaaaaaaggggccccccccaccctctcaaaaagtccgggggggccccctttgtccccgccgccccttggaaaaaaacccccccccccccccttgtggggaaacccccc

SEQ ID NO: 13468 - DNA, 414 bp, Zea mays
  Clone ID: cC-zmpo14820021c09a1
cgacaactgtcattttctctattctctcgagtctcgttttcactgcgctctaacacgttatcagcacttttgctcgccagaaaagaaagaacttgttgttggagaaagaggaacagtagaggtttggacatcaagaacaaaagtggggggcgggggggggggggcctcatggcattcaatgcatgctccattttctgcatgtcttctttgtgccacccaagtccacgctggatctgtgttggtccctggctgcccccacgcaaaggacctcgtgcacgctgggaccaccggcctgcccgtgcctgagcagggtcacgcgttggggctactgcccgcgccgccgccgaggggagccgcgcgttcgtgccactgcgtaccaggggccgcgtcggcatggaaaaccgcccagcgggg

SEQ ID NO: 13469 - DNA, 536 bp, Zea mays
  Clone ID: cC-zmpo14820021c10a1
aatatgatcctaggtactttattaatttccatcctctcttttttgtggttgatgttttcaccactagcaacaaatttggcatggaaaggagctggagcaatgtatgcattgtagtgagccacaaaatataaatcccaaaatataaattcaacaacattgcctgctcaaaggcatgcaatcccaaacatagtagcttatatgaaaaacactcaaggaataaataaaatggagccgaagggggacccagagcttataagcacttccgatgaacaatcccaggtcctgactcgtcatactcagcctttgagatccacatctgttggaaggtgctcagggaggcaaggatggatcctcctatccagacactgtatttcctctcaggcggtgccaccaccttgattttcatgctgctcggcgcaagggcagtgatctccttgctcatacggtccgcaataccagggaacatggtcgtgccaccactgagcacaatgttaccatacaagtccttcctgatgtcgacatcgcacttcatgatg

SEQ ID NO: 13470 - DNA, 578 bp, Zea mays
  unsure at all n locations
  Clone ID: cC-zmpo14820021c10d1
ctcccctgtttcctctcgtgcgttctccgcaggagcgaggagggctcgcggcagcggcagggtctccggtgtttttgttccagaatctgtagcaaatggctgacggcgaggacatccagccccttgtttgtgacaatggaactggcatggtcaaggctggttttgctggtgacgatgcgccaagggctgttttcccaagcattgttggacgcccacgtcacactggcgtgatggttggcatggggcagaaggatgcgtatgttggcgatgaggctcagtccaagaggggtatcctgactttgaagtacccgatcgaacatggcattgtcaacaactgggatgatatggagaagatctggcaccacaccttctataacgaactccgtgttgcgcctgaagagcaccctgtgctgctgaccgaagccccactcaacccaaaggctaacagggagaagatgacccanatcatgtttgagactttcaatgttcctgccatgtatgtcgccatccaggctgtgctttccctgtacgccagtggacgtacaactggtattgtattggactctggtgatggtgtc

SEQ ID NO: 13471 - DNA, 529 bp, Zea mays
  Clone ID: cC-zmpo14820021c11a1
ggatcgaatgtcacatctttactacataatagaaggtctatacaaaataaataaataaatacattataaggagacagcggtccagcaacccaaagttgactgggagacgacggcctagacctctcacgaactcgtcacagcatcctccaagcgcctcatcctgcggtacttgttcttgaccggcaatcgcagaatgaatacccctggccacggcgcacagcggacatgcggaggagcatgcatttcgtcaacaaattccaagatcttcggccgccaaaccgccgcagaaagttcacctgcccggacctccacgcacggtgagactttccggtacgaatccgtggactatggtgacgagcccacagtgccggacccagcgacccttcagcgcacaggagcagccgcaaacacgcaactgccctaccggcaccgcaacagctgcccaggagcgatcccagtccgtcttcccaaccctgctacgcagggcgcgccgtggttaggcccccagagcaactgctgcagcttgagt

SEQ ID NO: 13472 - DNA, 486 bp, Zea mays
  Clone ID: cC-zmpo14820021c11d1
gtacgggacaccgttttcttctgtggtcttaaccacgctcgatctgtatgcgtgaggtctccggcgagcacgaattcatgagagatcaaaaaaaatcgtctccgtgccgaggagagaaagaaatcgcgccatacgcatggccatggtcgtcgtcggggctttagggccactcaagcttgcagcagttgcttctgggggcctaaccacggcgcgccctgcgtagcagggttgggaagacggactgggatcgctcctgggcagctgttgcggtgccggtagggcagttgcgtgtttgcggctgctcctgtgcgctggagggtcgctgggtccggcactgtgggctcgtcaccatagtccacggattcgtaccggaaagtctcaccgtgcgtggaggtccgggcaggtgaactttctgcggcggtttggcggccgaagatcttggaatttgttgacgaaatgcatgctcttccgcatgtccgctgtgcg

SEQ ID NO: 13473 - DNA, 211 bp, Zea mays
  Clone ID: cC-zmpo14820021c12a1
acatcgcaatcgaaatttagagaacatcttgtagttgacgaggggcctggctgcattctcaaatgaatatgcaggacacaacaacatactcaaaacgtatacttgtcacaaaccaacccattattgcgggggcacaacaaataaccaggggcctgccttcccctgatccaacactaacagcacactccttttctactcagctcacagcatc

SEQ ID NO: 13474 - DNA, 490 bp, Zea mays
  Clone ID: cC-zmpo14820021d02d1
cctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactacgacgacgaccagtaaactataccacggcggcgtcgcggacatgctgcacaaaactacaacgatacagagcgaacgcatggcatggatagcactatctacggaaagaaaaggaagaaatggaaaataaaaaatgtatcagagtgcttgattcacttgctgctgtcacccattccccgttcttaacataacatgtgggccggcttggcccaggcacaagcccatctaaaattatttaaaccaacattttttt

SEQ ID NO: 13475 - DNA, 554 bp, Zea mays
  Clone ID: cC-zmpo14820021d03d1
ctaccacaagagctgcttcaagtgctcgcacggcggctgcatcctgaccacctcctcttatgccgcgctcaacggcgtcttgtactgcaagatccacttcgcgcagctgttcatggagaaggggagctacaaccacatgaacaagaagagcccgtcccaggaggttctgccggacgtggctgacgaggagcaaccgccggaaccagcgccaccgcaagatgagaaagaagaggacaactaggatcggagcgaccaacaaccacccatgcatatatatcacgcagactgaagtctacacgtttgccatatttctttacgacgacgagcgcttctttattccctcctcccttttttttcctcttaatctctctgtgaacccggtttatcatcacgctgcaatcaagtgtgccagatgccttcgttacgtctgaggctcacgacaatggaaaatctgacatggacctgtcttagcctcgcggaaaaaaattgtaactttggtagcagagccacttctttgaatatatgatcctaacaacgctgcccttaatacttat

SEQ ID NO: 13476 - DNA, 509 bp, Zea mays
  Clone ID: cC-zmpo14820021d04d1
agcacagagacaccaagcgttgaactcgcctaatcagctatcaaccaaccctagaaagctagacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacatggaagaaaaatgagagcaatgtctttaaaaccatgataatgtgtggtcatccactcatccatggatacatccttgctctccctctttttctttctgtttgattttcaatgtgttatcatgttgttagttaactgtatcgactcatggtatcaagatctaaaaaattatcgttcttgtgttcttgagcca

SEQ ID NO: 13477 - DNA, 582 bp, Zea mays
  unsure at all n locations
  Clone ID: cC-zmpo14820021d05d1
cccacgcgtccggtcctcgaccatccctgcaaattaccgcgatggctcccaaggtcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgttcttctcagttacttcgaccccatcaagctggacgagatgaagacacgcaccgncatcctccccacgctgctctacgtcaccgacaagaaactcggcgtcctcaactacaccagggccgacgacgggcagatgtacttcggcgctcccggagccccctgcgtggccaagctcgtaaggtcgtcgcagcgcggacgtactctgtgttcatcatggagatcagcgagcccattttgccggtcgggttggcctcccccgtcgcggcgccccgccgccgcggtagggt

SEQ ID NO: 13478 - DNA, 603 bp, Zea mays
  Clone ID: cC-zmpo14820021d06d1
gacccatgcgtccggtcgaggttccgagcgctcgtcggtaccgagcataggccgaaagagagaggattttgagagggacaaccactctagccatctgatgatcatgccatggttcagacgtcgattggtgccatagagaagtcgtcgtcgcttgagaagtttgtgggtagcactatgggacgcgagggtcgaccagagtatgatgagttgcttgctgaaattcgtcgaaccatggtgcaacatcgctgacactcgtcgttggttcaaacaccgaaaagcgaggttacgaggaatctgaagtccaaacttggagaagtgcttggagttaagccaaaaggcagttgtgtcctttatcacattctttgaccttataatattaccttttatgttctcacctaattcactgttaagttaacttgatgggaccttatgttattgaaagggaaatgtgcccttgggccatttctaagtattttggtgattgagtgcaaacacaagggcctaaatgtgaatttatgtacatggatgaacaaggtgaaaattatgaagtaaaggtatgtttttaagccttagtacattgggtttaagtactaagatatttgt

SEQ ID NO: 13479 - DNA, 555 bp, Zea mays
  Clone ID: cC-zmpo14820021d07d1
gcaatcgcgtgcaaggacgccgtggcgatcctgtacatgttcgatctcacgagccgttgcacgcttaataacattgtagattggtacgggaggtcgaggaaatggaataagacggctattccaatcctaatcgggaccaagtttgatgactttgctcagcttcctcttgagatgcaatgggccatcgttaaccaggccagagcatacgcaagagcgatgaaggcgaccctcttcttctcgagcgcgacgcacaacatcaacgtgaacaagatcttcaagttcattacggacaagctcttcaacctcccgtggacggtggagcgcaacctcaccatcggcgagcccatcatagacttctgacgaccccctcctctaactagtaactcggcagcacacgcacgacgacccttggtatatatcatgggttgacagggtcgtgtctttcgatcctcttgccctgtgcgagcccggggagccatgaagtgaccgagcatgcccgtcgtcctcttcttctggtggccggctgcagaggcaagatgccctttgtaaatatag

SEQ ID NO: 13480 - DNA, 489 bp, Zea mays
  unsure at all n locations
  Clone ID: cC-zmpo14820021d08a1
agttcaatcacacacatatatatattggtctgggtttacaaaccatacgacaaccaaactttaatttgggagtggaatcacaaaattatttgccaaaatgcattgtaccaacaaggaacaaaaatcttacgggagaaatggcataccaacnatcaaagatgagtaacagagccacgcacaatccaagggcgtgtaagagactaaaaatgcatccttacctagaggaggctaccaattaaataatgcgggtgttggtatcgttgctgcgaaccatggacaagcgagcgaggttaaatgaatccattcacaggccttgctctacgaggtagtcgccgagcctctccaccaccatgttgcactggccgggggtcatgggctcgtcgtagatgccgaccaccatcggttgccctgtcttcttcacagttatgccttcagatcccttctttccgcggatgacagcgccgggctcgccttgatgaccatgtactt

SEQ ID NO: 13481 - DNA, 528 bp, Zea mays
  Clone ID: cC-zmpo14820021d08d1
tggcagtacatactgtctatgagcacctgaggtgcgagagcgagggccaccacctgacctccgctgccatagtcgggcacgacggcgccgtatgggcccagagcaccgcattcccacagttcaagacagaggagatgaccaacatcatgaaggacttcgacgagcccgggttccttgccccgaccggtctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctgtgaatggattcatttaacctcgctcgcttgtgcatggttcgcagcaacgataccaacacccggattatttaattgggtgcctcctctagctacgcacgcatttttagtctcctacacgcccttggatggtgcgtggctc

SEQ ID NO: 13482 - DNA, 416 bp, Zea mays
  unsure at all n locations
  Clone ID: cC-zmpo14820021d09a1
ccgagaaaagctgcagaattgtttttctattcttttacaactttaatatatttaaactccatgaataatcgattcgatcaaatgattacaccaaattaagcatgcctcctccgcccaagcatatacccgtacgcacctaattaatccntattccnaccctactgggtgcatgaacctacggtctcaccgcggcccaacttaatcggcaccggcaccggcggcaaggactgtctcgagcgtggtgacaaccctggccatggagggccggaccttggggttctggctgaggcactcttacgcgaggcgggccacgcgctgcaggcccatctccgagcagaccttgcccatccgtcggtgcaggatccgctccaactttttgggccggataaggatgggccgggcccagtccaccaggc

SEQ ID NO: 13483 - DNA, 427 bp, Zea mays
  Clone ID: cC-zmpo14820021d10a1
gaacataatgagcaccggcgattattgcaagaaatcgatttattcccgggacaaactccggcgggggccggcgcccacacacgaacaaaagatctttgtccacccctccctgctttccctcacgacttgaacacaaaacactctcacaacccccggagggggagggggctgcactctactcaactacacaaaaaacttatacctccctttacactctgcccccctcctctacacccaaaagagagcccagcactatcccttgctccgttccaagtcccaacccctggatcaacactcaatcgttggcttgcgaacagtacacgcccgtgccggcgcggggaggtccctacttggactggaggtctcgcgctccaacgatcgatcgaaccgacctatagaaaagcttctgtggggtcggatcattggg

SEQ ID NO: 13484 - DNA, 412 bp, Zea mays
  Clone ID: cC-zmpo14820021d10d1
aatcaaattctggttgggatatgtaccttcttgttcccctcatgatgcaaactgggctgcaacaatttgttgcggccgccaaacaaaacccagaggaaaaacacactgcacccaataatgcgatcgcacagaaacttttctctgggggcgttcgatcgatcgatggtgcactaggccgtcctcgcactcaggatctgaccgggcgcgacgggactggacgcaacggaagcctagaaacgactgtacatacaggggttgggacttgggagggagctcgggttcttggagggctttcctttgggtggacagcgagggagcgcgagcgagagccagacgcgctggctatcgtgcagggcaatgaacagcacagcgaggcaattcctgcgtacaagagattgtattgtgaccaagc

SEQ ID NO: 13485 - DNA, 417 bp, Zea mays
  Clone ID: cC-zmpo14820021d11a1
cacaaaaaaaattttaggttttaaaaacggggggggcccaggggggcccttgtgggttacaaagggggaagtccccttaaccttttgaacaaaaaacccttttttgactggggcccatgtttccaactgggactggtttaaagttacatgaaatggggccccaaaatcaacccccccccccttgggggcgggaaaaccctgccaaaaattggaacaacctacactgaacccttgggtggcccctgcccttgattagtacggggagaacaaaacccccctaacttttttgggtacttaaaaaaacattggtcaaaccggtggggttttttgttgcaatgcttggaagggtaaaaaaaccccccttttccacctttcttgggggaaggtggttaccctttttaggacccatgggtttgg

SEQ ID NO: 13486 - DNA, 443 bp, Zea mays
  Clone ID: cC-zmpo14820021d11d1
tcctatcatatatgtttgtacctcatactcatgtgttctataaagtgttagcaacttctcacaagtatggtggaaaaggtggctactttgagccttgcaagcattgcaacaagactacacatcggtctgatcaatggtttcttaagtatccagagaagttagcggagtttcgttctcaccgtactaatcaagggcatgggccatccaagggttcagtgtgagttgctgctatctctggcagtgcttctccgtccacatgggttgggttgttgattctggtgcctcatttcatgtaactttagatcagtctcagttggatacatgtgcaacagtcactaatgggtcttctgttcaaatggttgatggtacttgctgctctgtaactcacaagggctccctctgtacctcccaggtttctatacctgatatttcttttggaaaaa

SEQ ID NO: 13487 - DNA, 285 bp, Zea mays
  Clone ID: cC-zmpo14820021d12a1
aatacaaaacaagcaattcaacatgcacgtgttacaaatacaataccatactgaccaaattccaattcttatcataacaacaacatggatagcttttacatatctcctttctccatccatttttattatattttggatatacacacactttttctctctttgggggggggggggggggaaagcaactccaaccacattcattttcttatatcaatgaataatttacatcctccttattgcccgatatttcctttacgccctttggaccaagtgcacctggcggtc

SEQ ID NO: 13488 - DNA, 391 bp, Zea mays
  Clone ID: cC-zmpo14820021d12d1
tgcgttcggactagttctagatcgcgagcggccgactttttttttgttttttttttatacaaaataagcagtttaacatgtacgtttttcaaatacaatgccatactgtccaaaaccaagttgcagaataacaacaacatttatttattttggaaaactacttactgaatgcttagattgtattattaggataaacacacacggctactcttcgctctgcggctatttcgacggctcttacccctcaaccgtccagaagaccatgtcttcattgggtcaagatggtgctgtactgcgactttcatctacctggactgcttcaattactaggacgagcggtcctttctttacacatacttaaagatcttcggcaatgtccagtgattgtgaa

SEQ ID NO: 13489 - DNA, 593 bp, Zea mays
  unsure at all n locations
  Clone ID: cC-zmpo14820021e01d1
gctttggaagcattggtccatccgttctttgatgaacttcgggatccaaacacccgcttaccgaatggtcgttttcttccgcctctcttcaattttaagccccatgagctgaagaacgtgccggcggatttcatggtgaaattggtccctgagcatgcacggaagcaatgtgccttcntagggtggtgatctctggataaaaagatgacggctggatgattagctgatgaccaacttactgtctgttataaactgccggagatcgacattgccagatgtggtgtggtataagataggcaatatgtgtgattattttttgttcgaggttatcacccccccttgccccataaaagatgagaagatgtcgatgtaacaagccctctgcgcttctgtaagtagatgagtgttgctgcatgccccctgggtacatgtatcggtttgagcagaattctgtttgcctgaatcgtgccatcaccacgcagggatccatcccttggggaagatgttcagcccaacattgtttatggattcaggctattcgtcatttgtactcctcgcatctatggatgcttaagcatatttgcaatttttct

SEQ ID NO: 13490 - DNA, 488 bp, Zea mays
  Clone ID: cC-zmpo14820021e02d1
ccagaatggaacgaggagctcaccctgtccatcacgaacatgatgaacccggtcaagattgggctgttcgaccacgacacgttcaccaaggacgacagcatgggcaacgccgagttctgcatcctcaacttcgtggagatcgcgaagcaggacctgagcgacgtccccgacggcacggtgataaagacgatccgcccggagaagggcagctgcctcgccaccgagagccacatcacgtggaaggacggcaaggtctcccaggacatggtgctcaagctcagggacaccgagaccggagagctcgtcctgcacctcacctgggtcaacatcccaggcgtcgcgatgtgaatcccctgctgcatgaggcggcgacgcctgcccagctggttttactacactaaatatatacgattatacgatatgaagtctgtaaatgtggctccgtacgtttaccaggtattggcaaacatggagacccttgcatgcgt

SEQ ID NO: 13491 - DNA, 526 bp, Zea mays
  Clone ID: cC-zmpo14820021e03d1
cacgagcacaagaagggtgaggagcaccacaagaagggcgaggagcaccacatgacggacgacggggagcacggcgacaagtccggctaccacacggacaaagaccataaggagaagaaagataagaagaagacgaaagagaagaagcacggtgaaggccatgaccatggtgatggtgacggtcacagcagcagcagcagacgacagagagtgatctcgtctcgccgagcgccgtactcacaaatgcaccgagcaggttataatactagctgtacgccgaacaccatgcgcatatattatacagtactcgccaagattgatgttctgcaatcttcgggataaaaagggtctttttttgtttgcggttgcctgtggttctcatctctgctggatggatctgaacaacgaagtcgatgttggattcacatgtatgcattgcttggaggatactcaccggatatcggtgctgatgtgatgatgaaagaacagtctgagggatagctagcatgtatgcgctgcttccatg

SEQ ID NO: 13492 - DNA, 468 bp, Zea mays
  unsure at all n locations
  Clone ID: cC-zmpo14820021e04d1
cccacgcgtccgggaaatcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaaagccgagaggagccattatcgccagcctcccgccccgtttctttctccttttggtgctggttcttcattagcatgaacaaagttttctgccggtctgtcggcagccgctttttcctattcatcaagactgtnatgtctattgttgctacctaatgcttctaacttgtcattttgggcacatgttccccctattcaaatttaaagggaagccccgtagaggcttttttccaaaaaacaaggggtgttttc

SEQ ID NO: 13493 - DNA, 439 bp, Zea mays
  Clone ID: cC-zmpo14820021e05d1
ggtcaccacgcgtccgatgattttggaagaaggcgaacctgaattccttttcttcctgctccggaagttcatactgcctttctactccttcacgctggtctgcatcatcctcccgatgacgatgttcgtgccggaggccgagctccccgactgggtggtgtgctacgtcccggccctgatgtccctgctgaacatcctgccgtcccccaagtcgttccccttcatcatcccgtacctgctcttcgagaacaccatgtccgtgaccaagttcaacgcgatgatctccgggctgttccagctggggagcgcgtacgagtgggtggtgaccaagaagtcgggccgctcgtcggagggcgacctcatcgcgctggccccgcccaaggagcccgtgaagcttcacgcgacgaggacgggctccgcgccgaacctcgacgccgtc

SEQ ID NO: 13494 - DNA, 522 bp, Zea mays
  Clone ID: cC-zmpo14820021e06d1
gcgaccgcagcacagagacgaacggcgtggtatcctcctgcctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaggtgctacaacctgttcaagagcaactgcgaggacttcgcgatatactgcaagactggccttcttgtcgctgagcagggcgttgtcgggcagagcgggcaggctatctccatcatcggtggacctctcgccgcggtggtctcgaccccattccgcttggttaccacgaacatctatgggatggcggtgatggccgttcgggtgtactgcgcgagcaggtatgcagctgatattggcaaccgccgtgatgtggggaaaatggaagtcgaggacctgacggccggactggccagcggcaggatatgtgctgtggagaaca

SEQ ID NO: 13495 - DNA, 504 bp, Zea mays
  unsure at all n locations
  Clone ID: cC-zmpo14820021e07d1
cgacacgatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatnncaagacagacagcacgaaggctgtgcaagangcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgccccagaagtacgactgcaagatcctttcccactcgctggtgatg

SEQ ID NO: 13496 - DNA, 223 bp, Zea mays
  unsure at all n locations
  Clone ID: cC-zmpo14820021e08a1
ggcgtcggacgcgggagccggggcgggggcctcggcggctgcggcggacgccacgagcgcggcggccatggcggcgacggcgacgaacttcatcctgaggccggccatctgctaatctgtaataatcccnntntttattgggccgcacccgatctctcttcnagggtacgaagctctagagagatggcgcccaagcggcttgctggctggctggccccactcc

SEQ ID NO: 13497 - DNA, 205 bp, Zea mays
  Clone ID: cC-zmpo14820021e08d1
tttgtggggtgttcgccatctttatagagctattggcgctcgaggagagatccggggcgggccgctaaacacgcggcttactacagactcgcagatggccggcctcatgatgaagtttggtgcctgtcgccgcatggacgtcgcgctcgtggcgttcgccgcagacgccgagggcggggccccggctcccgcgttcgacgccgct

SEQ ID NO: 13498 - DNA, 439 bp, Zea mays
  Clone ID: cC-zmpo14820021e09a1
ggagaataaattttataccctcaaattcagggggttacaccggcgaacataatatagctgtcggatgtctgtcattttactgttgtgcgttaccaatggatagcatctaatgcacaattcaacgaccaaagaaaaattatgactagagagatgggtcagtcgacggagggtctaaaagcatgcaagctccttgaagcaacccttggtgctgcccttggccttcgtacatatatccatggtcttgttgttggtgcccctatactctacgttgacgtcatccatggtgacgccggtgcatgggaccttggcagtgcagagcaggctaacggccttcggggtggaggaggtgccggtgatgttcttgaaggtgacatcctttgacggtgaccttggaggcgccgttggcagtacacaacttgttggggccggacgcgtgggt

SEQ ID NO: 13499 - DNA, 425 bp, Zea mays
  Clone ID: cC-zmpo14820021e09d1
gccccaacaagttgtgtactgccaacggcgcctccaaggtcactttcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttattctcc

SEQ ID NO: 13500 - DNA, 297 bp, Zea mays
  unsure at all n locations
  Clone ID: cC-zmpo14820021e10a1
ggaaaaccaaatcatattttttattgcattattacaaaaccactttacccaaatttattaattaaatcccctttttttaattaaattttccggtttgccgccccgggtanccatatcacaacacatcaataataatttttccaaacaacccttcaatttacctcttccaaatttaccacctcatcaacattcaccaaaaaccatccattcaactgcaatggcaaccgtggaccgatccattttcttccattcccccgtacttaaacacccccactctttttttatgttattcgccca

SEQ ID NO: 13501 - DNA, 380 bp, Zea mays
  Clone ID: cC-zmpo14820021e11a1
aaaaacaccaaacgccacaaccgatagataataattccccccaaacaccacaaaaaaaaaaaaaaatcggttaactgccgccgggcgccccccccaacccaacccaaaaaacaaaacaacatacccccccccccacaaaaccaaaaccccccccccaaccccccccctccccccccccaccccgacccccccaccaaaaaaaaacgcctacaaagaaaaaaaaaaaaccacccctgttagcccaacaaaacacctcggccccgtgggcacaaaccaacccccccgccccctattaggaacaagagaaaagggataccccccaaaaagggccaccaaaaaaaccccgtcctgcaggaatgaaacacattatttcccccccc

SEQ ID NO: 13502 - DNA, 477 bp, Zea mays
  Clone ID: cC-zmpo14820021e11d1
cccggccggtgcggggcagcggcgatggcggagatcccggtgatcgacctgcgcctcgccggctcgtcgcccgacgagtcggcgcggctgcgcgacgcgtgcgagcgcctgggctgctttcgggtgaccggccactgcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcctcgacgcgccgcccaaagtcagggagaccgtcaagacctacgcggagaagatgcacgacgtgatcgtcggcgtcgccggcgagctggccaccagcctggggctgggcctggaggagcactcgttccaggactggccgtgc

SEQ ID NO: 13503 - DNA, 486 bp, Zea mays
  Clone ID: cC-zmpo14820021e12a1
catcaatcataaccatgaacaatgttctgtacagaaatcctgtgaacgtcacttttttgacatataaccacattccatcagaacatacaacattcaacaacactacagcaccaacttgcaaagctgaccaagtgctaaggtagcagaacactggaaaaacttcttctcaagtccctgcgatacaaatgctacaacatttctgccgcaccttcgtagttcaaaggaataattgtcctgctgtggctattgtacacccaagcaatgcaccagcaaccacctgggttggtgtatggcctaaaagttctcgcagtggtcttgtctcagacaaggggtgttcagaaggaagttcacaaactatttgattcaaatacctctgcttgctttccagcatgcagtctgataccagaagcatcatacattaccacgcttgcaaatatagttgctgttgcaaagagggagcagctaaagccatcctggaatccaaat

SEQ ID NO: 13504 - DNA, 527 bp, Zea mays
  Clone ID: cC-zmpo14820021e12d1
cccacgcgtccggagggagggaggggcaggattaggcagggcagcgccgcgccggccggaccgcccgcccgcccgtccacgagccacggactttcggccatgggggacgctggcgctgacgcctcctcctcgccgccgccgccgccgtccgggtccttctcctacttcgccgtcttccgcaactaccccctcgtcgccgccctgctcggcttcgccgtcgcccagtccatcaagttcttcgtcacacggtacaaggagaacagatgggatcccaagcggcttatcggctcgggtggcatgccgtcatcacattccgccacggttacagcactagcagtagcaattggattccaggatggctttagctgctccctctttgcaacagcaactatatttgcaagcgtggtaatgtatgatgcttctggtatcagactgcatgctggaaagcaagcagaggtattgaatcaaatagtttgtgaacttccttttgaacaccccttgtctgagacaagaccactgcgagaact

SEQ ID NO: 13505 - DNA, 499 bp, Zea mays
  unsure at all n locations
  Clone ID: cC-zmpo14820021f01d1
ctcagctacaacaggatttcgcggattgggcatggtctgtcgaactgcacggccatccgggagctgtacctggcgggcaacaagatcagcgacgtggagggtctgcaccggctgctgaagctggcggtgctggacctgagcttcaacaagattacgacggccaaggcgctggggcagcggggggccaacggggagtggggtggtggcgctcaacctcntanncaaccctntccannccaacatcttcgacaactccctgcgccgggcggtcacgggcctcctcccgagccttgcctacctcaacaagcagcccgtgaagccgcagcgcatcgcgcgggaggtggccacggacagcatcgcgcgcgccgcgctcagcggctcggacagccggagcatccggaagaggacgtcgcggcggctcacgcaaagcccccgctcgtcgtcgttgaccagggcccgtggcggcggcggccgcggttcacccacaccaagaaacacc

SEQ ID NO: 13506 - DNA, 555 bp, Zea mays
  Clone ID: cC-zmpo14820021f02d1
tgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgttcgccatgcatcgacaacctattcttaataacgttcattatctcgttcttatttatgacgaatgtcatgtatgttctggtgactgtcatgtatattctgatgactgtcatgtatcttgttcatgtatgctcaaggttcattatcttgttcatgtattaagtatgttatgaataactcaatatttattattttgttcatgtatgaattatcttctaatgagctcaaggttcattatctcgttc

SEQ ID NO: 13507 - DNA, 501 bp, Zea mays
  unsure at all n locations
  Clone ID: cC-zmpo14820021f03d1
gttcattgggaagcaatcgcggctatatcaaacttggagcattgctggatatcttagctctaagatgttattggactgtccggagatggcatccatactagtatgcgatgaagacttcgagctgctggaaggttgtgcttgcagcttgaataagaatgctcgcaccaaatgctcacgtcgtgcggccaagtcgcaggttcttgtgtanttccatgcctgttcttgacccaaaagctgcaacgctccttcaacttgttgtaattgttcgtcacagaagctggcactagttactagttacttaagcagaatgatcacaaaccacctatgccgatttttttggcgagttcgtggttgatccatttatacaggagtatatgttgttgtctgtacattttatctaatggattttatgtatcctgctggtcaactcaagttgattggtagttttttttatgtaagcagacagcatgtaaatatcaccgctcgttacaaaaaanaaaa

SEQ ID NO: 13508 - DNA, 469 bp, Zea mays
  Clone ID: cC-zmpo14820021f04d1
cgcgtcggcgcccatcaagctagaggtcttcgacaaggacacgttcagcaaggacgacatgatgggggacgcggagttcgacgtggaggcgctggcgcagatcgtgcagatggacctggaggacatccgcagcggcaccgtcgtccgcaccgtccgccccggcggcacgggaagctgcctcgccgacgagagccacatcatctgggacaagggccacgtcgtgcaggacctcctcctcaggctccggaacgtcgactccggcgtcatccacctgcagctcagatgggttgccaccccacctgaagactgaactggaggagacgaactgcagtatgtacgtgctcgctccatatcccccaggaaagaacgtacggattcgttcgcgtgacgatgatactatgcgatgcatgcatgctcaagagtcaagatgtcactggcttctgtgtattttagtacagccacgtacatt

SEQ ID NO: 13509 - DNA, 379 bp, Zea mays
  Clone ID: cC-zmpo14820021f05d1
ctcagcaggatgtgctgagcacactcgaagcgctatgcaagcaagcgcgtgacttcatcctcctcctcccacgcctgccctccttccgacacccctcgaccgacggcgacggcgtcgacgagggtacagccgtctccggcgggcggaagcacgtgtcgttcggcgacctgagcttcgcggagtgggtgtcgttcctggagaggttcgagcagctgctgccggcggcgctagaggccaagaagcgcgctgggctacggacgtcgtcgtcgttctgacttctgagtttctgaccgaagctgaccgtaccacgtactagtcaaccaccaccaccatcaccgtttgcatgcatgcgtgcgtgcgtgcgcgcttgcgtggacgc

SEQ ID NO: 13510 - DNA, 565 bp, Zea mays
  Clone ID: cC-zmpo14820021f06d1
ggcgatagctaaaagcactggtgctcgtggtttaagagccatcttggaaactgttcttttggaggccatgtatgaggttccagacgaaaaaacaggaaatgagcgagttgacgctgttgtggtggatgaggaggcgattggttccgttgataggccaggttgtggggctaaaattctccgaggggatggtgcattggaccagtacataacaagaaccaatgtgatgaatttacaggaaactaacgatggtttggccggggagctcgaggaagcgtacatgctgtctagaattgttagcttgtaatttgaaaggctggggaggaagcgtatatgctgagttctgaccaacttcgtacatcgtgtaacatgtctaccccaacacaggccggctactttttgctcacaaaatcacctgtactctgtctccattcctgttaagctctaacgagcagatagatccggggcacctttttcatgtaaacaggagttgccttttgattgagcaaccgttctgcggagtaaatttggtgcccatttttccccgctgcccccaactgggcagctc

SEQ ID NO: 13511 - DNA, 544 bp, Zea mays
  unsure at all n locations
  Clone ID: cC-zmpo14820021f07d1
tcgcggacgcgtgggcggacgcctgggcggacgcgtggggagagagtgagagggagccaagggaagctctcttctttcgtcctcctccgcggcctctcgaattccgtctcttgtctctgtcctcctcgctcggcttccccggttcttgaaacgggaaataggaggcggagccgaggagagggatgctcacntacaagaggttcccaatgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgcagaccttcatgatcccaggaacgatattcatgtcactgcttgctggtgctctgtttgggcagctccggggcgtggccctggtagtcttcgccgcccctgctggcgctacttcgtgctattttct

SEQ ID NO: 13512 - DNA, 486 bp, Zea mays
  unsure at all n locations
  Clone ID: cC-zmpo14820021f08a1
agacagatagagagtttgggaccagattaatcaaatccattagttacataacgggtgaccccataatgttacaagagcaaacgaattgagcaaagcaaaaaaacactttttcccttcctccccaccacaccaaancnattacagcacagccgatggcggggggaccctaatgtctcaccccaacacaaccattttcggtgagtttaataaaaaaagatcatggtagcaacagcaacggcaacgccggcgatggcagctccactttcaagggcaggagcaccgggggagttattaagagccggtccctcagccgcaggggacaccgtggcggtggattctggcggggaagggctcaactcctcttccgtggaaaaagggggtgtataggcggtggctggcgcggttactggaccagactttctatacgaccattatggggcaacggcggcgacgggggtggacccggcttccggtgctttaacgggg

SEQ ID NO: 13513 - DNA, 524 bp, Zea mays
  Clone ID: cC-zmpo14820021f08d1
ccggccctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgtcaaggcacctgaggctgccaagagaactgctgcccccgcttaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattaaggtggacacgtaattggctgtgct

SEQ ID NO: 13514 - DNA, 198 bp, Zea mays
  unsure at all n locations
  Clone ID: cC-zmpo14820021f09a1
aaaaaattaagaagagagaaaatccccgaacctggtccccctattattaacgggcccaaacccccaaattttcaaccntccaacccnagggggccccctaaaccgggagcggggggggggggggggggatttttttttaaccaaaccaaaaactcccccccgggggggggaccatggctaaaactttttattcttttt

SEQ ID NO: 13515 - DNA, 153 bp, Zea mays
  Clone ID: cC-zmpo14820021f09d1
cgcttcccggtttagacgcgccaccatccggcttggaccgttgcagatttggcaggtgactggcccgttagtgatatgggggagccagacttacgactattattctctctttttaatactattataaatgaacagaagtttataaaaaatatt

SEQ ID NO: 13516 - DNA, 483 bp, Zea mays
  unsure at all n locations
  Clone ID: cC-zmpo14820021f10a1
aaggactgcagaaacgcttttcatgccctgcattttatcaaaagtagttttgtttctcgtagccatgagacccatcaaatcaaattaatgaagcacccatcaacaattatcaagaccgatgaactagcgggggttggggcggaagcacttgcccctgnccacaacctgcttgcactcgccaccgggaaagctctccttcatgcacacatcggcgcatctgtcgctgttgaagcagaagccctcgaactggagactcggcgataagcattgactctcttccttctccgtgcttttctcctccttcttctccgtctcctgctgtttcgctttctccattatcaaggcatgcatgggcatggctactcccattttggcatcgatggttcccacctctgctgcgacgaggagaaacaagaataggacagctccctgagacactgccatccttctctcgttttagcaagaacaggaacggctgaacct

SEQ ID NO: 13517 - DNA, 521 bp, Zea mays
  Clone ID: cC-zmpo14820021f10d1
tctttctaggatcccccccaccttgagacctgcgttgtcacccacccatttaggatggggccgccagcagggtcagccgggcctgttcttgctaaaacgagagaaggatggcagtgtctcatggagctgtcctattcttgtttctcctcgtcgcagcagaggtgggaaccatcgatgccaaaatgggagtagccatgcccatgcatgccttgataatggagaaagctaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttccccgtggcgagtgcaagcaggtcgtggccacgcgcaagtgcttctgcaagaagccttgctagttcatcggtcttgctaattgctgatgggcgcttcattaatttgatttgatgggtcttatggctactaaaaacaaaactacttttgattaaatg

SEQ ID NO: 13518 - DNA, 251 bp, Zea mays
  unsure at all n locations
  Clone ID: cC-zmpo14820021f11a1
aacgaaaacaaaaaagaaccttttttatccagaagattgtagaacaacaatcttggcgagtgtataatatatgcgcatgcatggtgttcggcggacagcccgtattataaccttcncggggcgatgtnggcggggcgctcggcnangcaaaatcaatcnctgtcnctgctgctgctgctgtggccgccgtcaccatcaccatggtcatggccctcgccgtgcttcttctctttcttcttcttcttatcttt

SEQ ID NO: 13519 - DNA, 252 bp, Zea mays
  Clone ID: cC-zmpo14820021f11d1
aaagataagaagaagaagaaagagaagaagcacggtgagggccatgaccatggtgatggtgacggcggccacagcagcagcagcagcgacagcgactgatctcgcctcgccgagcgccgtgcgcacatatgcgccgcgcaggttataatacgggctgtccgccgaacaccatgcatgcgcatatattatacactcgccaagattgttgttctacaatcttctggataaaaaaggttcttttttgttttcgtt

SEQ ID NO: 13520 - DNA, 369 bp, Zea mays
  Clone ID: cC-zmpo14820021f12a1
aaaaaaaaatgtttaaattatataaggggtgcccccataaaggtacaaaagccaacgaaggggccaaaacaaaacgaccctttccttattgggggctccccaccaaacaagcaatttccccaaaaccaaattcctccccacccttaaaaaaacggtccctggtgaacttaaaaaaaaattatggtggcaacacgaacggggaaaccagggatgggggctccctttccaaggggggcaacaccggggggattaaaaaccgccggtcccttaagaggcccattaggggggggggaccccacctctgggggggattcccacggggaaaggcttaactcctctccctgggaaaaaaacagtgttaaggggggg

SEQ ID NO: 13521 - DNA, 581 bp, Zea mays
  Clone ID: cC-zmpo14820021f12d1
cgaaaatgtcgcgcgccacagctgcggtcctcttctacatcctttccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaggagttgagcccttcgccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccagggaccgtgtcgtcgagggtgggcacgtagttggctgtgcggtaattgctcgtctggtcgggagggaccaataacgcaagtgttg

SEQ ID NO: 13522 - DNA, 569 bp, Zea mays
  unsure at all n locations
  Clone ID: cC-zmpo14820021g01d1
tgtcgacgacgacgcgtgttgccgccgccgccaccggcgtgctgctggtcctgtcggcgttggcgaccctggcgcgggccgaggacccgtacctgttcttcgagtggaaggtgacgtacgggaccaagtccctgctgggcgtgccccaaaaggtcatcctcatcaacggcaaattccccggccccaggatcaactgctcctccaacaacaacatcgtcntcaacgtcttcaaccaactcgaccatccgctccttttcacctggaacgggatgcagcacaggaagaactcgtggatggacgggatgccaggcacgcagtgtccgatcctgcctaacaccaacttcacgtacaagtggcagcccaaggaccagatcggcagcttcttctacttcccgtccatcggcatgcagcgggcggcgggcggctacggggccatcagcgtggttagccgcctgctcatcccggtcccgttcgacagcccccgccggagaacgaccacgtggtgctcatcggagactggtacaccaaggaccacgaggtgctagcccggcgtctacgccccgcgcgct

SEQ ID NO: 13523 - DNA, 401 bp, Zea mays
  unsure at all n locations
  Clone ID: cC-zmpo14820021g02d1
agaacttcaagcacacccacgctaaagccggtacgctgtccatggctaactacgggcccgactccaatggctcccagttcttcatcaccaccgtagacgaaaaccggttgcccaagaagctggacgggcgccacgtggtgttcttcaaggtggtgaaannaatngacgtcgtgcgcaagatcgaagccgagggccanctcaccggcgtgcccaaggccaaggtcgtcatagccaacagcggccagctgccagcgcccgccgccgccggccatcgtgacctctgatcgatgacgaggagaacgactcactgcacgatccatcaatccgatcgatctgtcttgttcgttaagaaaccaaacgtgtgcatggttaattatataagacgtgctcttcttcagatc

SEQ ID NO: 13524 - DNA, 584 bp, Zea mays
  Clone ID: cC-zmpo14820021g03d1
ctccttcccggtctcctccgcccgttgccttcgtcccctccatctccggctgcgtcgccggcgagcccgacaccgcgaatcggatccgccgacaaggtgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacgcagggtctcatctttgttgtggacagcaatgatagggaccgtgttgttgaagcaagggatgagctccaccgaatgctgaatgaagatgagttacgtgatgctgtgttgcttgtttttgctaacaagcaagatcttccaaatgctatgaatgccgctgagatcactgataagcttggactgcattcacttcgccaacgtcattggtacatttcaagcact

SEQ ID NO: 13525 - DNA, 485 bp, Zea mays
  Clone ID: cC-zmpo14820021g04d1
cccccaccctccgggcctagcgatccaagcaacacgcccacgttcgaggaccatttgatgccgacattttggtggtgggtgcccgcccgcccgcggcgcggtcctttctgcgccgcgcgctgatcctgatctcgccgttagcgcgcgactcggctcatgtgattttgatctgccgcgcgcgactcgcctgtccagttatggcctgacttcgcctccctctgctcgtcttcgtcgtttccctcctcctggattggatgaccatggccagacctcacgagacgagacgagacaagatcgaggctgggcttgccgcaccgggtggagctcatccgtcacattgggattgccgcatcgggaggttcttgctcaagtcgtctgagaaatccagtgtcgacaaaaagtcaaaaactaacccatgatagagagtagtagatgatcaggccctgacattaccgtttggagaacaagaaccggtaaatttagca

SEQ ID NO: 13526 - DNA, 116 bp, Zea mays
  Clone ID: cC-zmpo14820021g05d1
ttttgcttatatatatatatagacgagctaatgaaagctcagggttttcattattttgaaaaaaaaaaaaaaaaagagaaaaaaaaggaaaaaaaaaaaaaaaaaaaaacaaaagg

SEQ ID NO: 13527 - DNA, 561 bp, Zea mays
  Clone ID: cC-zmpo14820021g06d1
gcgaccacgacgcgtgttgccgccaccgccgccggcgtgctgctggtcctgtctgcgttggcgaccctggcgcgggccgaggacccgtacctgttcttcgagtggaaggtgacgtacgggaccaagtccctgctgggcgtgccccagaaggtcattctcattaacggcgagttccccggccccaggatcaactgcttcttcaacaacaacatcgtcgtcaatgtcttcaaccagctcgaccatccgctccttttcacctggaacgggatgcagcacaggaagaactcttggatggacgggatgccaggcacgcagtgttcgatcctgtctaacaccaacttcacgtacaagtggcagcccaaggaccagatcggcagcttcttctacttcccgtccatcggcatgcagcgggcggcgggcggctactgggccatcagcgtggtcagccgcctccttataccggtcccgttcgaccagcccccgccggagaacgaccacgtggtgctcatcggagactgttacaccaaagaccacaaggtgctaacccgcgcgcttagacga

SEQ ID NO: 13528 - DNA, 408 bp, Zea mays
  Clone ID: cC-zmpo14820021g07a1
cgatgtaagagtattattattagcattcacaaacgcgataacatttttcacatattacatgaacaccacagtatatgacacaggaacactcaataatcgtatatatagatcatcatgcaagggccgaggggacagtcgctttgtgctgacctctgaaactagccaaccaacaccaatgttgcattaattgcaggcacactgaagagtgaagactcatgactagctgaaaaccgaagggactaaacgagcaattagatagagggtctgaatttgttgcacttgctttgaactgaacgtggagcgtgcagtttggacagttagcaacagcagcgtcgtccaccatcaatgagctagcacagcgccaccgctcctccgtacgaggacgcctggagcatcatgtacatgcca

SEQ ID NO: 13529 - DNA, 467 bp, Zea mays
  Clone ID: cC-zmpo14820021g07d1
acccacgcgtacggtcgtcgtctttttctttctcgtgagcagatcatgcgatcttgtcctttcctcgctcaggtcaggtggggataggagcgtgacggggtcatcggcaccaccacccccagcatcctgagctgctgctggcggtggggcaaccgcgtgcgttgctagcgtgctcgatctgcctctcctctggatcccctgtcctgtccctgttaatcgcgcgcgcttgcctatttacaaggcgaaacaagcgcgcagcagtggccatgtcgtccgacgcggtggccgacagcagcaggaagggccggctgaagcagcgctacgacaacgagttccgcctcgtcgcagggtgcgtgccgtaccgggtgaacaagaaagacgacgagggcggcaacccgtgcagcagcctctgcgacgacacggctgcggaggtggaggtgctcatgatctccacgcctaaccgggcc

SEQ ID NO: 13530 - DNA, 499 bp, Zea mays
  Clone ID: cC-zmpo14820021g08a1
aatacataataaatgaataaggcttttattgattgggtttcttctcttcatgcatgtaacaaggccggaaccggaaaccctagaacatatatatatacgtacgtatccaacagcagcacatacatatacatgtaaggaaattaaaataatttgatatagtacgtacgccttggaaagacctgcatgcggcgtggcatcaatataatataaattataatatgcatgcagatcgatgcaagaaggtcgagaagcgatcgatcatagtaaatagcatgcatatatatatatataataattaatcgattcatgcggcggcggcggcgacggcggcgtggtgtgtgaatccgaaggcgatgtgcgccatccgaccgtactccctgtcgtgcgcggcgacggggacattcttctcctcgccctttcacgcgtcctcgcagctatcggaggcgcccattgcggcggtcagctgctccatggccttgccgtagatcttcgccttgag

SEQ ID NO: 13531 - DNA, 536 bp, Zea mays
  Clone ID: cC-zmpo14820021g08d1
acccacgcgtgcgctcaaggcgaagatctactgtttggccatggagcatctgaccgcttgcaatgggctcttacgagagctgcgaggacgcgtggaatggcgaggaggaggatgtccccgtcgccgcgcacgacagggagtacggtcggatggcgcacatcgtcttcggaggggggaccacgccgccgtctccgccgccgcctcatgaatcgattaattattatatatatatatatgcatgctatctactatgatcgatcgcttctcgaccttcttgcatcgatctgcatgcatattataatttatattatattgatgccacgccgcatgcaggtctttccaaggcgtacgtactatatcaaattattttaatttccttacatgtatatgtatgtgctgctgttggatacgtacgtatatatatatgttctagggtttccggttccggccttgttacatgcatgaagagaagaaacacaatcaataaaagccttattcatttattatggattaaaaaaaaaaaaaaagggcggtcg

SEQ ID NO: 13532 - DNA, 519 bp, Zea mays
  unsure at all n locations
  Clone ID: cC-zmpo14820021g09a1
gaaaaagaagtcatgcatatttctctgcaagcaaacaggtgtagtgtacacagcccatggccttgggagcacctactttttaaccattgcacaatgttggtgccagtgccacaaaaaaaaacaagcattatgccacatcaatttaacttaactatctatcnaatcacgacattctgaatgtgtagagctagttggtattagctgaatttcatgttcttcaacaagctgctgataaggggcgcctttgatggagcctgctgcttgtaattattcancagtacttctgcagccaatctctgcagctccgagccatcttcctctttattccttcctttggtcaactgattgattgccgaagtacacagacatacaccaaagagggctcttgtattcttgcctccagtcaattggattgttgatgcatagtacttcttagctgtctgaagattttccaagccacccatagtgtacagaacctcagcataggctatatgatagagtggaatagttggttgggat

SEQ ID NO: 13533 - DNA, 491 bp, Zea mays
  Clone ID: cC-zmpo14820021g09d1
caacgactatctgcagtcctgcgctgcgcccctcctttccgccttcacgctgccgacgtccaccacacagcacggtcgagtcacccgatccctccatggcggcggcggtggcggcggtcgcggctgccacgacggcggaggacgaggcgcgcctgctgcgtatggaggagcacgcggagcacggaggcggctgcgcctgggactacctctggctcgcccgccggatccgcgcccgccgtcccgcccacgtgctccgcgatgggctcgctctgctgaacaacacctacgttcgtttcggtctcgtctaacaacagtggacgctctacgagcaggcggccacggcggtcatggattgccagcgtttggatgtggcaaaggactgtgttggcgtactttcaaagcagttcgctgcgcgcacccgggctgcccggctagaagctcttctgtttgaagcgaaatgtgaatgggctgaagattgaagagcttacacg

SEQ ID NO: 13534 - DNA, 453 bp, Zea mays
  Clone ID: cC-zmpo14820021g10a1
aggagtaactgccagcatgcctttttattattatccattcaatcgatgaaaaacacacatttgcgtgacattacatttggagttccatcgacggtatatttggaaaaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatgcatggttcattcatttcaaggggcttcgcttcaagaaggaggaggggtgcaggacctcttgcagttctcgctgaggcgcgggttcttctccttggcgcaggtgacgctgcaggccttggtgacctcggccgccttcaccacgtacgccttgtcgcactccttctggcagacct

SEQ ID NO: 13535 - DNA, 510 bp, Zea mays
  unsure at all n locations
  Clone ID: cC-zmpo14820021g10d1
aaaataatgaatagccgtagcatggcatcatcggacgcgctcttggggctagccctcgcgctagtggcggccaccgacccacaggtagcggaggcaaagaataagagagcggcggagagcggcgaggcggcggaggcgaataatatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccggccatgaaggtctgccaggaggagtgcgacaaggcgtacgtggtgaaagcggccgaggtcaccaaggcctgcagcgtcacctgcgccaaggagaagaacccgcgcctcagcgagaactgcangaggtcctgcacccctcctccttcttgaagcgaagccccttgaaatgaatgaaccatgcatgcatgcatgcatgtatgcatg

SEQ ID NO: 13536 - DNA, 507 bp, Zea mays
  Clone ID: cC-zmpo14820021g11a1
agagaagaaattttataccctcaaattcagggtgttacaccgtcgaacataatatagctgtcggatgtctgtcattttactgttgtgcgttaccaatggatagcatgtaatgggcaatgcaaggacaagagaaaaattataactagagagatgggtcagtcgacggagggtctaaaagcatgcaagctccttgaggcaacccttggtgctgcccttggcgttcgtgcatatagccatggtcttgttgttggtgccgctatactcgacgttgacgtcatccatggtgacgccggtgcatgggaccttggcagtgcagagcaggctaacggcctccggggtggaggaggtgccggtgatgttcttgaaggtgacgtccttgacggtgaccttggaggcgccgttggcagtacacaacttgttggggcagtacttcatgtcgatgaagaggggttggctgagtcctccatcttgatattctcgtagtggatcttggagacggtgagcacg

SEQ ID NO: 13537 - DNA, 566 bp, Zea mays
  unsure at all n locations
  Clone ID: cC-zmpo14820021g11d1
cgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctgttcatcaccggcaagggaaaccttgacgggcagggcccagccgtgtggagcaagaactcctgcaccaagaagtacgactgcaagatccttcccactcgctggtgatggacttcgtgaacaacggngaggtgtcccgggtcacgctgctcaacttcaagtttttcacatg

SEQ ID NO: 13538 - DNA, 480 bp, Zea mays
  unsure at all n locations
  Clone ID: cC-zmpo14820021g12a1
atagtataactttggtgaacaatgcaaggagaaagaacattctctgttgaacagaaaaaacgctcccaatgcaatgcaatggagagcgaatacatgcatgttacagcaagcaatcanccggctagggtgaatcgtgncacaaaccagacccaggaatgcgcaagctcccacgttcgagctaggcggcctatttggctacgagcttgcgcgcacgctggtttgctcccttcaccctggagttgagctcctccacgtcgccttgcagatgatccagcgcttcgttttgcctgtcaagctcggagcccatgtcgacggccatgcccttgagctggcccagcacgccgctgaggtcgtcgagggcgtcgtcctgcttcttcttctcgatctggactttgtccatggcgtcggtggcctcagcgtagtggcgagggtcgcgcttccctcgcgggctcaggcccagcttgtccctctgctccatgc

SEQ ID NO: 13539 - DNA, 552 bp, Zea mays
  unsure at all n locations
  Clone ID: cC-zmpo14820021g12d1
tgtataagccgttgaacaagaccggggcgttgttggaccaggccctcggcgacgccaagaagcggtacaaggacgggttccgggactcgggcggtctggagaaccagtcggtgcaggagctggagcactacgcggcgtacaaggccgaggagacgactgacgcgctcgccggctgcctgcgcatcgccgaggacatcaggcaggacgccagcgacacgctgatcacgctgcacaagcagggggagcagatcagccggacgcacgagaaggccgtcgagatcgaccaggacctcgccaagagcgagaccctcctcgggagcctcggaggcttcttctccaagacgtggaagcccaagaagacgaggcagatcaagggaccagcgcatgtgtcacgagatgactccttcaagaagaaggcctgccgcatggagcagagggacangctgggcctgagcccgcgagggaagcgcgaccctcgcccctacgctgaggcctccgacgccatggacacagttcagatcgagaagaagaagcaggacgacgccctcgacg

SEQ ID NO: 13540 - DNA, 460 bp, Zea mays
  unsure at all n locations
  Clone ID: cC-zmpo14820021h02d1
acccaaccaaatttcttatacacccactccttctaattatgtcaaaagatcccctccatcatatcctatctcaatcatttttttctatatttttcaatccatcacaacatctcctcaatccctaaaaaatattctttttaaccttaatccactttcattttacaatacttctttttttttcgggggggtgggggggcgcgnacncaccnccaccnacccaaaaaaaaatcctaaatatactaatattcttttacacattctcaaatatatcctttccaaatcttttttatttactctaatattcatcttaatttacatatatttaactttactcaantataaatttctacctcaatcaactctcatatatatataattatgtgaatactatattaacatataaaccctaaaatgatttacacataataaaaaaaaaaatgtcttcctctctatactatcc

SEQ ID NO: 13541 - DNA, 501 bp, Zea mays
  unsure at all n locations
  Clone ID: cC-zmpo14820021h03d1
cggacgcgtgggcagtccttccaggccggcaaggcggaggcccttggcgagtaccaggcggagcacgcggcgcagtgcgtcaaggacaccgccggagccgcggccgacagcgcgcatctgcatcatcaccgctccaccggcaccgtttanccatttncggacacgggccagggcntnnncnncanncctcaangacacaatntcattcaccacttttttcttcaccaacacatttgctttcgtttcctcgggcgtcacgaacacggtgaccggcgcggtggcgggcgtcacgaacacggtgaccggcgcggcggcgggtgttaaggacaccgtgaccggcggccactgatcgacgacccacccaagaatgctgcatgcatggccaagtgttgagggtttgagcccaaagatggcttgaattttcgtccttttttgctttattttttgacattattgttttaacatgtttcattcacccgtctctgatcgggattgtgatca

SEQ ID NO: 13542 - DNA, 309 bp, Zea mays
  Clone ID: cC-zmpo14820021h05d1
tatgtgatgtcatgtgtgtgtttgcaccaccggcgacatgggcagcgtggtagacaggcatggccttaaatgggtaatgcaaacatacgggtgaaggaaaattatggagggaggcgaagggccacccaacgggggagagggaagcatgtgaacacacctttgatttcttgtacagtacgatgtttatgctccctgttctcggaaaattatttgttctgtgcccttgggcctgtaatacagttgtaactggtccctctaagatgatgcgaatatgttggacacccaaccattttaaatatatattttggg

SEQ ID NO: 13543 - DNA, 332 bp, Zea mays
  Clone ID: cC-zmpo14820021h07a1
caccaacaaaaccttctttttaaacggttttttgggccccaacctcccccttttaacttgatcttttcggacaaataaagggggcaggggggggcttaatttgggcattttttaattccccttgatttgaaaaaaacccccttttttattattaaccccgccccccgtgttgggtttttaacgaacaaaaaaaaaaccaccgggttggtgggccggggggccttttcctcttttttgaacaagggggccgtgggccggggggggggggccctggaaaatggccctttttgtttttaaaaaaccttggccttggcccccccggggggggggcc

SEQ ID NO: 13544 - DNA, 529 bp, Zea mays
  Clone ID: cC-zmpo14820021h07d1
gtcggttggctatttatccactgcaactgcacggggggcgaggccatttacggcagcaccatcttctccgacgagaactgtaatcacacccacgctaaagccggttcgctgtccatggctaactacgggcccgactccaatggcttccagttcttcatcaccaccgtagacgaaaaccgggtgcccaagaagctggacgggcgccacgtggtgttcggcacggtggtgaaagggatggacgtcgtgcgcaagatcgaagccgagggccagctcaccggcgtgcccaaggccaaggtcgtcatagccaacagcggccagctgccagcgcccgccgccgccggccatcgtgacctctgatcgatgacgaggagaacgactcacgatccatcaatccggtcgatctgtcttgttcggtaagaaaccaaacgtgtgcatggttaattatataagacgtgctctttttcagatcatggtgaattgaaagactgccaaattaaggccacttgtgttgctttgaatgaacggagag

SEQ ID NO: 13545 - DNA, 408 bp, Zea mays
  unsure at all n locations
  Clone ID: cC-zmpo14820021h08a1
agtattgatgatcctttaattgcactaggaaacataatgtggatgatagtaaagatggcctttttttattgcangccgtctttatcacaatcccaatcacagaccggtgaatgaaacatgttaaaacaataatgtggagggggggggggaggaaaaggaccgaaattcaacccatcttttcactcaaaccctcaacacttggccatgcatgcagcattcttgggtgggtcgtcgatcagtggccgccggtcacggtgttcttgacacccgccgccgcgccggtcaccgtgttcgtgacgcccgacaccgagccggtcaccgtgtttgtgacgcccgccgccacgcccgccaacttgttggtgacgccaaccgtcgggcccgccaccgtgttcttgacgcctggcgcca

SEQ ID NO: 13546 - DNA, 509 bp, Zea mays
  Clone ID: cC-zmpo14820021h09a1
catgaatcttcggaggaacttggccacatttgaacttgtaaaaagcgttacacacagcagcgtcctggatcaaaccccgcaccattagccaattcagttggggggtttgttcatctgggatttctctgctgcaaggattagttcgtatttacaggtgtattgtacagcagcaggttaacatggccatgatggtgtcagcttctatggatggtggcgagcgcaaaccctcccctctcatacatgctctggagctcgtcccggtactcggacagctacttttcagggaacccaagcttcagctccaccacgtcgcccatgctgagcttcctatttgggtcgcttatgggcttgtggttaaccctcggtcgcagctcctctttcagtgggaagctgtaagggctccatctcggactgttggccccgactcgctccattagatcaactacagtcgagttggctgggagctcttggacagacattttgtcatgttcaagcatgatgacaaatat

SEQ ID NO: 13547 - DNA, 350 bp, Zea mays
  Clone ID: cC-zmpo14820021h09d1
ggtcgaaccacccgtacggacagtgcaactattaaggccctatatttgtcatcatgctcgatcttgacaagatgtctgtccaagagctcctaggcaacttgactgtacctgatctaatggagcgagtcggggccaacagtcccagatggagcccttacagtcttccactgcatgaggagctgggaccgaaggttaaccaccagcccataagcgacccaaataagaagctcactgttgttgacgaggtggagctgccgcctgcgctccatgacaagatcttgggcctgttccggcaggagagccaccacaagtgtgagcggaccgggaatgcgctccgctccacccatgga

SEQ ID NO: 13548 - DNA, 440 bp, Zea mays
  Clone ID: cC-zmpo14820021h11a1
gcttggcatttagagaagaaattttataccctcaaattcagggtgttacaccgtcgaacataatatagctgttggatgtctatcattttactggtgggcgttacaaatggatagcaactaatggacaattcaaggacgagagaaaaattataactagagagatgggtcagtcgactgagggtctaaaagcatgcaagctccttgaggcaacccttggtgctgcccttggcgttcgtgcatatagccatggtcttgttgttggggccactatactcgacgttgacgtcatccatggtgacgccggtgcatgggaccttggcagtgcagagcaggctaatggcctccggggtggaggaggtgccagtgatgttcttgaaggtgatgtccttgacggtgaccttggaggcgccgttggcagtacacaacttgttggggcagta

SEQ ID NO: 13549 - DNA, 506 bp, Zea mays
  unsure at all n locations
  Clone ID: cC-zmpo14820021h11d1
catgaacatgctgatcaaggacgtgaccgtgacggcgcccggtgacagccccaacacggatggcatccacatgggcgactcatccgggatcaccatcaccaacaccgtcattggcgtcggcgacgactgcatctccatcggccctgnaacctccaaggtgaacatcactggcgttacctgctgccccggccacggcatcagcatcggcagcctagggcggtacaaggacgagaaggacgtcacggacatcaacgtcaaggattgcactcttaagaagacaatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgccttcaaggtcaccgtcaaggacatcaccttcagaacatcactggcaccttctccaccccggaggccattag

SEQ ID NO: 13550 - DNA, 445 bp, Zea mays
  Clone ID: cC-zmpo14820022a01a1
ggaaatatataatgattatatttatttgtagaccaagcgcaaacagaggtggtttatgttatacaaactgtatacgtatatacacgcgtgtgggattaaaaaaatccctagtgggggtggtggaaaaaaaatgaccaaactgtactgtgatgtgtaacaatgccacaacacagtacttgaaggcaaacgtagattaattagcagaacgacaacctgtgatccatccttgctttcttccatgaaatgaaacgcagccatcgcgacctggcatggccaggccatgagctagaagaagcagtctttgacgcccaccggccggccttcagcacggattgcccgtgcagcaggacagtgtgccggagaagcgggtgagccttgtaacgtaggttcctggcttgggcttgacctactcgttggtgttaacctgtttgggggcgccgtcgga

SEQ ID NO: 13551 - DNA, 324 bp, Zea mays
  Clone ID: cC-zmpo14820022a10a1
aacagttcaatcacacacatatatatattgttctgggtttacaaaccatacgacaaccaaactttaatttgggggtggaattacaaaattatttgccaaaatgcatggtaccaacaaggaacaaaaatctttggtgatcggcgacgggcaggggagaaatggcagacgaaggatgagagatgattaacagagccacgcacaatccaagggcgtgtaggggactaaaatgcgtgcgtagctagaggaggctaccaattaaataatgctgatgttggtatcgttgctgctggatgcttaaaccatgacaagcgagcgagcgagggt

SEQ ID NO: 13552 - DNA, 549 bp, Zea mays
  Clone ID: cC-zmpo14820022a10d1
gagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgtgcagtgcaacatggtggtggaaaggctgggcgactacctgcttgaacagggcatgtaactactacgtaccagctggaatgcatgtcgacgacgatggtttcgagtttcgactttcaattatagtaaccacaaagca

SEQ ID NO: 13553 - DNA, 515 bp, Zea mays
  Clone ID: cC-zmpo14820022a11a1
ggacgagaaggaggtggcgatgcggagattcctgggcagccgggtgaagacagcgatggagccgcggtcagagtcggagcagccgcggcgccgggaggtggctcggagcaacgacgtgatcgaggcggcacgcaccaagctgatgcagaagcgccagtgcagcagggtcaaggcgctcgtcggcgccttcgagactgtcatagacacccagaaggacgccggcgccggcaggccacaacacatctaccgcaggtcagcttaaaacatactgcggcggcggggacgcatcgatcctccacgcttcgtgtcttcgccttaattaattaattaattgttatgatcatgtcggacagcccaacgccgtatgcatgcatgcacacggcgctaattaatccctgtttattaactactccggaatgtagtttctccgatacacgagcagtagtattctgtaaaaggaaaatgtggaaccgatgtgcatctgcatatttataatgggctagtttacacctttt

SEQ ID NO: 13554 - DNA, 521 bp, Zea mays
  Clone ID: cC-zmpo14820022a11d1
gaattccttcagttggcgtattagcggaggcaggaccgccaccactcggaggaggaagcatggcggtgtaccaaagacgacgctgatcggcggtcttcaggcgggccagcgttccgcagatcgacgacgagctcaccgtctgcgtaacaacgtcgccggtaagaaagtagcaacgaccaagcgacgatttaacctagaccagaaagcgacaagctggagtctagcggcccccccatgcgaaccttcatatatatagccgggcacgggtcgccacagtaatgacatcgaattcaccaacagtcacatcgccacccccagacggttcaccagatgatcgagggcaccgttcgtcaccttaaaaaccaagtaacttcaggaatgcccatcaggatgaaccaattcctcgaggggtactgttgggcggagactgaacacagcctcgatcacagagcgaaagccataatttttgtcttatactaaccatacttagggtcacttgcaaggggtctttgattctatag

SEQ ID NO: 13555 - DNA, 443 bp, Zea mays
  Clone ID: cC-zmpo14820022a12d1
acatggtacccttcgctcgattccttcgtcgcctcgtcactccgacgaagactatatccacatagcacgcccgagcaaggcgaagacatcgaatgggtgaagaacggcgcggtctcccttcgaactctctgttgcaagacgaaggctctgtcgaagtctactagtctaacgtcctcaccgcgtacgagaggcccatgcgagtttcggcccactgtaacgggccccgcgcggataagtgcattacgggccgcgtttgtaatagcctttactgtaatgattgtctgtaacctcccctcgtgcgaatattctggggacaaaccgggcatttgagggcataaacgtctttggcaagggacgggtgatcactcgagtagttgagtgcctataaatactcctgtatagtgccctcacatggccagatataatagagctattattatctt

SEQ ID NO: 13556 - DNA, 463 bp, Zea mays
  Clone ID: cC-zmpo14820022b01a1
atgttttgtgttttttttgttttttgtgttattgttggttgttgggcgccgttaaagacaaatcccatttattcaggtccattcccaggttccccaaaaatcaaaccgttttcactggcggtgggatccatttgaaccagagggatcaaatggggttaaatattcttgcttgaatggcccttgttgtttattcacgaacacgacacacacaagtccacacaggccatgcacgcttggaagcgcaagcgcgttaatgcttgcgggggtggttgttggcggcttccgggccgtcccggtcggcgggggcggccttgaaatggtgcgtgggcgttggggtttgcatgagcgcgagcgcccccttgaactgcgcccagggctggttcagcgtgccgttgaaaccgaacttgtgccgcgccgcggacattgccgccggcgggtcccccttccgccgccgggccttggg

SEQ ID NO: 13557 - DNA, 254 bp, Zea mays
  Clone ID: cC-zmpo14820022b10a1
atctttatcaattactgtaagggataccttatcaggacgaggcccagctatatgaagcaagaacatccgaaccaagaagcacgactgcaagatccttaccaactcggtggtgatggacttcgggaacaacggggaggtggtcggggatacgctgcttaacttcaagttctatcacatgaacatgaaccggggcaaggacatgcctattaaggacgctaccgagactgctcccggggacagacccaacacagatg

SEQ ID NO: 13558 - DNA, 631 bp, Zea mays
  unsure at all n locations
  Clone ID: cC-zmpo14820022b10d1
gtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgcttccacgccaacgtggatgcacgcgcgtatggtcgccgctccaacctgcagctgcaggaggaggaagcagcagctaccgcggggcgtgtaaccaaagcagaagaacaggaggcttctactcaagggggagattaaccgcccaattattgcaattgcaattctcatcacccatttatattttctgccatcatntattcttcttttacacgcgtacgtgtgcgtaccccgatcccatcctttttggattattaagcattgtcgatggattacttatattactctctctttctctatgtgtatatatatatgtaagcaagcatattaggatggtttataatatagaaatattttcttaataaaaaaaaaaaagggccgccg

SEQ ID NO: 13559 - DNA, 404 bp, Zea mays
  Clone ID: cC-zmpo14820022b11a1
accacgcgtccgctccgtgcgccgacggtgatctgcgcccacggtggcgaatcatcctcggcgagtgggcctggggcttcggggttgcacgtggagcatacacaatggggtggccatgaccaacgagcgttgaagacaccggaattgctcgccgtcgcttgccccaccgcggattaccgccgtgcgccgtggacgggacttctgggagcttaatactagggaggacacgtgtcacctgaagatcattctggtacctggaatctcaaggcccacgtcaagaccaggtactgcacgatgacgctcatggaggatgctgtgatgagttccttagaggtctacgtcgtcgtcttccaggtaacttttgggttgctggaccgacgtctccttataatgcaattatttat

SEQ ID NO: 13560 - DNA, 364 bp, Zea mays
  Clone ID: cC-zmpo14820022b11d1
ctgagcccagcgctagctgctgccggggcgcgccgtcgtcgccgagccggtcggtctggtctggtctggtctgcctgcctgccaggtcacgcagcctggctccaccgatcgcacaccatacattgacgtcgtcgtcgcggccgtacgtgccgttggacggtggaggaggcggtggcgctacgacagtatatatatacacaattacacatacacaccccaaaaagaaaagaaaaaaactactgccattgctgtcgttgtgcgtagcttctctctatatatatacccgtatttaaattctcgacaaaatttgtttgaccacggtgatctgtcatatatgtcgtccattgatttgcgttaatttgac

SEQ ID NO: 13561 - DNA, 436 bp, Zea mays
  Clone ID: cC-zmpo14820022b12a1
cgaacgtcgtacgagaacctttctccctcctccacctttctccttttcttgccacggcaaaacaccttcgccggcgagagcatggcgaaggcgtaccgtgtcctggaggtcaccctggtgtcggcaaatgacctcaagaaagtgtcgctcttctcccggactcgcatctacgccgcggctttcatctccggattcgacctccgcatcccttcccacagcacccaagcagaccacagcaacggttgcaacccctgctggaacgccgtggtacactttcccataccggctgccgctgacacccgctgactcgcactccacgtgaggctccgcgcccagcgtatatacctgggcgatcgcgacattggcgaggtgttttgtgcccatcgacgacctcctgggcggcgcctacaagggtggctatccgaggcccgtgagc

SEQ ID NO: 13562 - DNA, 480 bp, Zea mays
  unsure at all n locations
  Clone ID: cC-zmpo14820022b12d1
tgattttctagggtgcatataaggtatagaaaaattactttgagagtgaaatagattgaggtttataaagacttttggatgtgctcttaattaggtgacaatactcttgtaccatgataacattgttatattagagccactatgttttttctctagcaatcttgtaatacctttttttgtggccaccaatattttctggatctcctcttaaatttcccctttaagtaaagagcaagttgcatctcccaatagtatgggcatatcgcaatcatcacttttcaaccatctttcctactacacacatgaggggtcagctttcatatatgtatcgagatatgggtattagggaaaatatatccataaaaataatattgggctatccatattaggggatagattattgggatgctagtggagattgagagcacctatgggcggggtgaatagngtgatcctgtaaaacttcaaaacttaagccac

SEQ ID NO: 13563 - DNA, 449 bp, Zea mays
  Clone ID: cC-zmpo14820022c10a1
ccagaatggggggaaagcccatcacgttcgggtttactatatcaccatagcgcccgctgtggcgccctttgttcactctgttcttcctcttcactcctggctgtcagggaaagggattagttattactctctctattcggtggcagactatcgatggagtccgccctatgtcattggccgtgacgtgcctgtgcctagctttccccgaggtcacgctggcgctggtcaacggggcccacggtggaggaccattcggcttcggaggcggacctggacaaggtcacggccgataccttcttggacatccagaacttgctgggactgtttggggacaccgtttctaaaacagcatagaacttccgagcactttgcacaggggagaaaggaattggcaagttcggcaagcctctggggacaaagggtccactttccacaggatcatcccgggt

SEQ ID NO: 13564 - DNA, 362 bp, Zea mays
  Clone ID: cC-zmpo14820022c11a1
catgcgtccgacgacctcgtggaggccagtgaactcgcacacagaaatagtactgtggagtacgtataaatggggagcggtagccaaacagacaggatgtggactccaatcccttcttttattgccatcagcgcctctagggagagacgtggggggtttcttttgtaatcccacgggccgagggatgctgcctacccaaggaagcggaccttggaaaccctagcattcgcgctggcgccttgttcgtaatctctgaccggcgtctattaaagatcatgcactgcgatttaaggggagtattcgggcctacaaagaacgggccaactgaaggtgaaaactgatcttgaccctgctctggcgga

SEQ ID NO: 13565 - DNA, 527 bp, Zea mays
  Clone ID: cC-zmpo14820022c11d1
cccacgcgtgcgctgaaaacatgccgagcgatctcctctccctctccctctccgatccattctccagcgcatcgaagtaaacatgtctgaccgggcaaagatgtcctggcaggcgtacgtggactagcacctgatgtgcgagatcgtgggccaccacctcgcggcggcggacatcgtcggccacgacggtgccagctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcattaccgtgaagaagacagggcatgcactcgtggatggcatctacgacgagccgatgacgcctgtgcagtgcaacatgcgtggggaaaggctgggcgactacctgcttgacagggcatgtaactactacgtaccagctggaatgcatgtcgacg

SEQ ID NO: 13566 - DNA, 274 bp, Zea mays
  Clone ID: cC-zmpo14820022c12a1
acccacgcgtccgagcacctcctcttcccccgccgggcaacaactcagccgccgtaaccgccacatcagccatgggcgcctgcgcaaccaagcccaagacgcttgaggggcaggccccagctgaggccgtcgtctccacacccaaggttgcgcccgaggccactccaatctccgttgaggttgcggctgatgaacaggtagctgacaaggtggtggtggaggagccggctgcggtggccgacgttgagcatcagaaggctaatgaggtgctcgc

SEQ ID NO: 13567 - DNA, 645 bp, Zea mays
  unsure at all n locations
  Clone ID: cC-zmpo14820022c12d1
ggcagagaaagagagagagagatggatgaggagtacgacgtgatcgtgttggggacggggctcaaggagtgcatcatcagcggcctcctctccgtcgatggcctcaaggtccttcacatggacaggaatgactactacggaggagaatcttcgtccctgaatctaaccaagctctggaataggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaggctgttgacgggagctttgtgtacaacaatggcaagatccacaaagtcccggcaaccgacgtggaggccctcaagtcgaacctgatgggcctgttcgagaagcggcgcgcccggaagttcttcatatacgtgcaggactacgaggaggacgaccccaagtcccacgagggcctggacctcaacaaggtcaccaccagggaagtcatctncaaatacggattggaggacgatacggtcgactntatcgggcatgcgctagcacttcaccgggacgacagctacctgacgagccttgcatcgacactgtcaagaggatga

SEQ ID NO: 13568 - DNA, 134 bp, Zea mays
  Clone ID: cC-zmpo14820022d10a1
agacaaagcaggtcaatcacattatatattgtgcccgggttacaaattgttagacaaccaaactttttttggggtctaatcacaaaaatattcgccccaactttacacttatattatatatacactggggaaaa

SEQ ID NO: 13569 - DNA, 563 bp, Zea mays
  Clone ID: cC-zmpo14820022d10d1
tcgctgggcgcgctggtgctccccgacacgcccaactcccttatcgcccgcgggttcaacgacgacgccaaggcggtgctggtgaagatccgcggcacggacgacgtgcaggacgagtacgacgacatggtggcggcgagcgaggaggcgaacgccatcgagcacccgtggcgcaacatcccggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggcacgcagatgttcgtctcccagatcgtggtgggcacgctgatcgcgctccagttcggcaccgccggcgtgggcgagatgtcccgctccaacgcctggctgctggtgctcttcatctgcctctacgttgccgggttcgcctggtcgtgggggccgctgggctggctcgtcccctcggaggtgttcgcgctggaggtccggtcggcggagcaaagcatcgtcgtgtgcgtcaacatgct

SEQ ID NO: 13570 - DNA, 129 bp, Zea mays
  Clone ID: cC-zmpo14820022d11a1
aaaaaactcggaccttttgtatgaggggggctcacatcaccgtacaggcataaattaagtcaagaagaaaagagggagattttctggtccgccggggttgaacacctgctgcctggtttttttttcaac

SEQ ID NO: 13571 - DNA, 550 bp, Zea mays
  Clone ID: cC-zmpo14820022d11d1
cctcatgctcttacatcagtcatgtggctctgtggacctattgctggcttacttgtacaaccctgcgtcggcctctatagtgacaaatgcacttctaagcttgggagacggaggccattcatctttacaggatgcatcatcatctgtatatctgtgatagtcatcggtttctcctcagacatcggttacgctctcggtgacacgacggaagactgcaatgtttacacggggaagcggctgcacgcggccttgttcttcgtgatgggattctggctgctggacttttccaacaacacggtgcagggccccgcacgcgcgctgatggcggacctcgcaggcagccacggacccagcacggcgaacgccatcttcgtgtcgtggatggcgatcgggaacatcctgggctactcgtcggggtccaccgacaagtggcacacctggttcccgttcctgcagacgagggcatgctgcgaggcgtgcgccaacctcaaggccgccttcctggtgtcggtggtgttcctgggcctgtccacggtggtgaccatgatct

SEQ ID NO: 13572 - DNA, 62 bp, Zea mays
  Clone ID: cC-zmpo14820022d12a1
acccacgcgtccgccgactgcaatataaatatattataccacaaaatagcgcgacctttgct

SEQ ID NO: 13573 - DNA, 646 bp, Zea mays
  Clone ID: cC-zmpo14820022d12d1
cccggcgactgccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcaccttcaacacgccggaggccatcacgctcaactgcgccaacaacctgccatgccagggcgtgcagctcgtcaacgtcgacatcaagtacaatggaatccggcacaagaccatggccgtctgcaagaaccgccattcgcagttcatcggcttggcacaggagctcgcctgcatctgaaccattgactacatgctatatatat

SEQ ID NO: 13574 - DNA, 378 bp, Zea mays
  Clone ID: cC-zmpo14820022e10a1
tcggccgaataccagccatgccaatgctgtgccactaaagatggtctctgtttctgcgccatgcccttgtacaactccgggccgggatgcacctttcttgcttcacgttaggcggctgtccgacaccaccggtgagccgagacgagcttcaagaggatggcgttactggaggccgaccttcccgtgcttggcctcctactcctgcatgatgctctaagggagcgggccgtacccacataaccggcccctcatcatggccccacatggaaaacgtaattctgggttgtgtggaccaggaacggcttgaggctgtggcatgggagccgcccaaagaagaaagggaaaggaaaaaaggagctggataaatattagcccctg

SEQ ID NO: 13575 - DNA, 608 bp, Zea mays
  Clone ID: cC-zmpo14820022e10d1
cgcggaggaagccgatccgcgggcactgccggcacagtggacctccgcgaagaagtacaaggccacgatggacgccaagacgcggcaggctttcgacggcgtggtggccgtcgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttctgcgagacctacgccaagacggagaaggccttcagcggaaccatcgcctccggggacacgcccaagagcaagctggggatcacggacgccgtgctcaagctgaggctcgccaccgacgccaacatcaacaaggcctacgcggagggggacatggacaagatcgctaaaatccttgctgcatacggccaggcggccgacgcggtcgctgcggccccgcctcccgagaagctcaaagtcatggaga

SEQ ID NO: 13576 - DNA, 269 bp, Zea mays
  Clone ID: cC-zmpo14820022e11a1
aagacagttggaagttcaggcgttcgttcgaagttcacttgatcttaatcacacgacatagctaatcatgtctgacaggatgtcgtggcaaacatacttaggtgagcacctgatgtgcgagatcgaaggccaccacctgacctccgctgacatagacggacacgacggcgccggttgggcccagagcaccgcatttccacagtttaagacagaggagatgaccaacatcatgaatgactttcccaaccccggtttttttgccccacccg

SEQ ID NO: 13577 - DNA, 626 bp, Zea mays
  unsure at all n locations
  Clone ID: cC-zmpo14820022e11d1
cccacgcgtccgcccacgcgtccgcccacgcgtccggaggccggcaacaagaacatgcacgggctggcggtgctggccaccaggatggccatcgaccacgccgccagcaccgagtccaagatcgacgacctcgcggagctggaggcggcgtcgtcggatccgcaggcgcgcgcccgcttcaaccactgcctggagcagtacggcggcgccgccgacctcctccgcgacgcgctggacaacctcaaggcgaagatctacggcaaggccatggagcagctgaccgccgcaatgggcgcctccgagagctgcgaggacgcgtggaagggcgaggaggaggatgtccccgtcgccgcgcacgacagggagtacggtcggatggcgcacatcgccttcggattcacacaccacgccgccgtcgccgtcgccgccgcatgaatcgattaattattatatatatatatatgcatgctatctactatgatcgatcgcttctcgaccttcttgcattgatctgcatgcatattantaattatattatattgatgccacgccgcatgcaggtctttccaaggcgtacgtactatatcaaattattttaaattcctacatgtatatgtatgtgctgc

SEQ ID NO: 13578 - DNA, 199 bp, Zea mays
  Clone ID: cC-zmpo14820022e12a1
acccacgcgtccgcccacgcgttcgcccacgcgtacggcagaaagccttctttctgttgcaagaatggtagaacttcatggtgcacatgtagtgagccatgaaagaccagacgaggtgaacaatgcacttatggatctgataaaggccaccggatctgtgatgaaacctgaagagtggtcagcccagcctgaaaacaca

SEQ ID NO: 13579 - DNA, 428 bp, Zea mays
  Clone ID: cC-zmpo14820022e12d1
attgccgagacgagccaacgcgtagcgcgaaactggcgaacaagaagccatcactccttgctgaaatggtcaactgggttacatcaatcatgtgggggcgaaggaaagcatctcgcgtgaagttccctattgggcagcgcggcaacaacgtggggctgcttctgctgctcgacaaggctcctagggcaggccacgggcaccagaggcctcccaagaggatctaactaccaaatgagtcatctgtttgtgaagcaaacacatgactgggcttccgcattgctgttcttgcgttcttcttttcaccgtgtctggtgatgtagctttcacatatggaaaccatttttttctcaaaaaaaaacaaaaaataataaaaaaaaacaaaaatcaaaaaaacggcaataaagtacacacattatgccaaacaaaaa

SEQ ID NO: 13580 - DNA, 485 bp, Zea mays
  Clone ID: cC-zmpo14820022f10d1
cgctgtatgcctacgacgaccaacaccaagccttaactgataactggtcaacgtacagtccgcggaccggtcatctcacaataaccagctgcactatagcacataagtctcatagctatgagtatggtttagcagaatcgagggcgtgcaccacgagcccctaggaaaacagggctaagtggccctattcagaaggccctcgtaacaggtgcccaaaaactgaacagagctgaactcgaagtagcctgtgaagattttagcaacatcatcaatactattcctacctgtactgtattcaagggcatattgccaagcggggttgagattggtgttgtctccactaccatatcgtcgagcaaagactggtccatgagtgcggaatcatgctttaagaacaagatagatagactgtcaagggtcaaccacaagaacttcatcaacctccttggctatcgcctagaaaatgagcctttcacgagaatgat

SEQ ID NO: 13581 - DNA, 480 bp, Zea mays
  Clone ID: cC-zmpo14820022f11a1
cgtcggctttaattaatatatatatatatcaaaactgaacatgtttggctttacgaaggtgcacagcagttgttgcagtgaattcttggactatttggtgtttatcccacgccgatggtgccctagcattatcaatgtttgaaactcaatcgacgtctagaacagataaagatccaagagtgggcacattacaaaaacaatgcgcacaccattctcgttgcagaagcaaggagacacacgctctacacagttttcgatttccattttacccggccgcattatgcgttccagccgggctcgtcagacagtggttgcattgacatgaactgttgtatttccaggttaaactttttgtcggtaacggccattgacggccccgacaatggcgccgtagacccgccgccgaaccattcccccggcggtgcgactgttaacatgtcggagaaccccacctttgtcgccgttttcctttcgccggtt

SEQ ID NO: 13582 - DNA, 602 bp, Zea mays
  Clone ID: cC-zmpo14820022f11d1
cactaatccaagacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgcgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctacgcaaggcgggcctcatcgacatgcagttccgaaaggtttagtgccagtacgactcccaggtcaccttccaccttgaaaggggtgccgccccactacctgcactgctggtcagta

SEQ ID NO: 13583 - DNA, 586 bp, Zea mays
  Clone ID: cC-zmpo14820022f12d1
cgacccacgcgttcgggagcacagagctagctagccagccagccagcagccagcttgctctccgcgcccgtccttcttcctcgcctccgtggcgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggtcggtcgcccggaggccgaggaagagacgaagcgggagagagagtgacatggctgcgcgcattccgatgcgtgggcatgtttttgattcgacacaccttttgtcctctttttctttgctccctctttctccttaatttaacgaattgatgcatgccgctgatgttcttccccctgagagagggatttacactcgtatcatcgcttgccatttggttgaattcattcaacaattcgatttaatcaatcatcgcgtttatatttgc

SEQ ID NO: 13584 - DNA, 538 bp, Zea mays
  Clone ID: cC-zmpo14820022g09d1
cgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtcaagcccaagccaggaacctacgttacaaggctcacccgcttctccggcacactgtcctgctgcacgggcaagccgtgctgaaggccggccggtgggcgtcagaggctgcttcttctagctcatggcctggccatgccaggtcgcgatggctgcgtttcatttcatggaagaaagcaaggatggatcacaggttgtcgttctgctaattaatctacgtttgcctttaagtactgtgttgttgcatcgttacacatcacagtacaagttggtcattttttttcccacagagggagtagggattgatttaattccacacgcgtgtatctacgtatacaggttgtataacatggaccacccttgtttgcgattgtccttaaaataaatttattc

SEQ ID NO: 13585 - DNA, 571 bp, Zea mays
  unsure at all n locations
  Clone ID: cC-zmpo14820022g10d1
gcaaggccatttattcaccctcaataatttctaattttgacaacgtattaacatgaatgaaaatgtctaattttgagcaggccggggcgcagagcacaaacccattctctgatgagagcgttcagggatacccacagtacatgaacgggcccaacggcgacaacgcacagccaggccaggacttccaacagcagtctctgaagctaccggcggcgagcccgtacgacaatttcctaagggctgctggctgttaggagtccagttacatggacgacaaccacctcacctcaagatagtcccaacggaagatcctgcaatttttccacattttgcagggaaagaagaggggtatgtccgcgtgtgaggtcttagctagagactcaaaccgggttcgacacccattctttatgtatagctgtacgtggttgggctttgagccctttgctgctgctgctgttgttttcaccaatgcaacgtgtagagagggactgtgggggagcagtgccttctaccagactgtacatgtaacatgttgcagaaatatatgaaganaaaatgacgtttgagggat

SEQ ID NO: 13586 - DNA, 611 bp, Zea mays
  unsure at all n locations
  Clone ID: cC-zmpo14820022g11d1
cggacgcgtgggcggacgcgtgggtgcttgcactggcagtctaaagtatgctcataggacttgtgtacaacgatggtgcaatgagaaaggagatgtaacatgtgaaatatgtcatgagccttatgaacatgggtacactgcacctcccagaggccatcctgatgaaactaccattgatataagtggtgggtggacaattaccggtaccgcatttgacttgcgtgatcctaggatacttgcagtggcacaaaaccacatcatggaagctgaatatgatgattattctgccacaaatgcgagcactgctgccttctgccgctctgctgctcttgttttaatggctctcttattgttgagacacgcactgactctaactgatgaagatgacgacgacacttcagcgatgttttcactttttctgttgcgtgctgctggtttcctgcttccgttctacatcatggcttgggcaatcagtatctcgcagcgccgcagacagagacaggaggcagctgctctagctgcagcggaggtggcattcatcctgcagtcaggccacagaaggggagtgcatttcaccatcgcaccggactccccggncacaccacagcatg

SEQ ID NO: 13587 - DNA, 442 bp, Zea mays
  unsure at all n locations
  Clone ID: cC-zmpo14820022g12a1
gatgaataataattcatggcaaagcgattaattaatgatggagacaacatccacagtaagcccaattagaacatgttgtttcatcagaagaactccggggaggaaaataatgggagacatcgaagaaggttagtttgttacatggtgtggccagtcgagagtgtctctcccgacctatgccgctatgccaactgtagagaattcaagtgtcgtctccttgctcgatcacacactgatcatcaggtatcatcagccaataattatattagttggcacgcgcatgcacggacagtcggtcagctttgctgcgcctgcttctccttcctggcctcctcgacgtccttcttcttcgcctccaccgtcgtcgtggtctcggcggcggtggcgaccttttcctctgcattggcggctgccgctggcttctnctcctcgacgacggtct

SEQ ID NO: 13588 - DNA, 223 bp, Zea mays
  Clone ID: cC-zmpo14820022g12d1
ttcctgtgtcgacccactcttccgcaaaaagaccttgtatttgatagaatgtgctgatccattcctcattcagtcaaaccgaatagaaatgtgaggtcggctgtgattaatcttttgatcttaggtcaggtcaaggttctatcggactgctcgctgttgcaggattgtgtagctgtcactgtgtagctccaattgagaaatattatcagtattaagctgcttt

SEQ ID NO: 13589 - DNA, 513 bp, Zea mays
  Clone ID: cC-zmpo14820022h09d1
ccattcccaggcaggcccgacctcctgcccttgtacaacgcacgcacggtccccgtcccaatggcccagactctgtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggctacaacggcacgctggagcagcgctgggcgcagttcgagcgcgcgctcgcgctcatgcagacgccgacgcccacgcaccatctcaaggccgtcgtcgtcgaccgcgacggccccgaagccgccaacaaccaccaccgcaagcactgacgcgcttgcgctttcgagcgtgcatggcctgtgtggacttgtgtgtgtcgtgttcgtgtatatactactagtgccattcaagcaagaatattaaacaccatctgatccctctggttcagatggatcgatatg

SEQ ID NO: 13590 - DNA, 527 bp, Zea mays
  Clone ID: cC-zmpo14820022h10a1
ggagggaagacccacgcgtccgatcctactcggtgtctctctgtgtctgcaaccgcaagcaaggttattaattaaaagaagatcggcgccatggcggcaacgacgacggggatgcagatgatgcaggcggcggtgttgctgttgtgcttggttgtgttggcggcgtcttcgcgggtcgcgctgggcaactgccgcgacgactgcatggctgcatgcaacgggtggaccatcgattgccagctctcctgtgccagcgcatgctacggagaagtcgggatcacagccttaggtacgtcggctgtattaccgaaagcagaagcgcctgcatcagcaccacaagcttcacaagagcgaggcgccgccgccggcgtgttcgcgctcagagggttcaagctatcatcaccgacgacccgtggccgtggatgaattaattaacgccccatgcattatgcatgcatgcctaagctacctccaatttctttgcttttacaatgcatgcatgcagatattaattaatcattatcaat

SEQ ID NO: 13591 - DNA, 416 bp, Zea mays
  Clone ID: cC-zmpo14820022h10d1
aaaaaaaaaaaaaaaaaaaaaaaaaaaaaaaaaaaaaaaaaaaaaaataaagtccgtaacataaaaaaaagcgccggtcgctgtctggaccctggacaccttacggttgccttcgagggcttaccgttctggtgatgttccgtagaattgaatccctggcggcgggctaacccctgcgctgctgcgaaaaccctgccgtgtcccagttatggctctcaggggttacagctttctgtttccaggtcgcgtttgagcgacgatgcccgcactgagcgcgctttcctggcagtatggcagacgccttggccaacggaatatcccctggccggtgtcgtcgatcgcggcgggcttgtcgcttcccccgcgcgcgccctatggactggtcaggtcactgccccccttgcttttggtctgcg

SEQ ID NO: 13592 - DNA, 435 bp, Zea mays
  unsure at all n locations
  Clone ID: cC-zmpo14820022h11a1
gcggcctaatgatttcgatcctcgaaagtggccatcccctttttatatcatttgataccacaagacctgccatgttaagcaatatgtgcggtgtgcacatgagncacatcacaacgcaacagtgggttccaaatctaaatacgtagccccaccttgcaaggctgacctgtagaagcgaactcctggagagcaaggcgaacaacacattttaatatcagcaacagacgccccaatcgtcaccgcgcccagacctggctccgtatcaagaaggggtgtagccgtgatcaaagtcagttctgatgtattatatggctcgaatctgcggacctttctgaaggtttgccctctcatttgagcaacgggggatgcaactggaacttttacctttagcatgtgggagcttctggcatcctatggctatgccgaactctgctg

SEQ ID NO: 13593 - DNA, 461 bp, Zea mays
  Clone ID: cC-zmpo14820022h11d1
ggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatcgaagctcgctgtgctgctgtgctgactcgaaaggagaacggatcgtgcagcagctcaagtgatccaggatgatgggagcgccgagacacgatggaaggcattaattatttcagccatggtgtttcgccttgctttaaccttttgctcatctctaccgaggaacactagttccatcgggtaactgaacctgcaaatcttcatgatgaaactgtcgcatcatttgtttc

SEQ ID NO: 13594 - DNA, 311 bp, Zea mays
  Clone ID: cC-zmpo14820022h12a1
gagctgaacattttgatttaactcatcataaatctgtctggccatgaaccgtaatctatcttattattgagaaaacatcttgtctttccatttctaccgttgcgtacacttcagtatgctgctagtgatgtttaggttggcacgtcggggctagccactatcatctgacgatgaagacgtccactctccacacatattgtcctcccgcgccaagggcgttcgttgacgtcctgtttgttgagacctcatgctcaaaagatgctcgtgaggtactcaacgaccgtggtgtacttgacattcgggtacagttg

SEQ ID NO: 13595 - DNA, 474 bp, Zea mays
  Clone ID: cC-zmpo14820022h12d1
cgcgttcgcctgcatttatctccatgcctcagccgccgccacaccatttggccgcatggccgagcgcagagcgccttgacgcatccactaccactctctacgtgtcaatttgatccggcacgcgccgtccaggctacaccgccctgacaccaaggccacgaagaaggagctgctggatacattcgatgcggccaagaaggcagccgatgctacaacggcgggggagggcgattcattagaggttgaccgctgcctcgacacgttgcggtagctacgacgcgtcaacaccgacatcctcgcctccacgcagttaagtggtcgtctgtctcggttagattgaccggttgttttggtggtggagaaatccacccttgtcgtgttgttcattcccgaccgatgcgtgcggcgtcggtaatctcactatggccttgtcgcattgaatttgggtctactatagatatgccttatcgatct

SEQ ID NO: 13596 - DNA, 554 bp, Zea mays
  Clone ID: cC-zmpo14820023a01a1
cgccacgcacacgtcgtcttgtatgggctggctgctacaatgccaccgggccaccgcgttgccgaccttccctgcagcgcaccatcttcagcacgaggcagcacgcgcggacgtccctcccgacacggagaaccccgctccgcgcgctcgcattcatcgcgccgtcacccaggtcccagccggccgcgcgcccgcgcccccccgccgccggccgtgccatgccgcggcggggcgagacggcggtggtccccattgacgtggcgtccgccggcggcgggcgaggcgatgagcggcccaagagagagcgccaccggagccacggccccggccgtcacggtccgcaccggagtcgcccgacgcccccgcccccgccggcgttccggccgttccggcggtggatcccgttccttgtgccgctattcatcgtcgctaacatcgtcctcttcgcgctcaccatgtacgtcaacgactgccccgcgcacgcgcgggccaccggcgccgcgataggcggaatcggtcggggagagcgccaccgcgcagggctgctggctcgc

SEQ ID NO: 13597 - DNA, 339 bp, Zea mays
  Clone ID: cC-zmpo14820023a02a1
gctacaacgacacgccatgaattcaggaagagtttacaggagcaacttacaaggagggaggaggacagttacaaatcttcccggtgaaaatgaaaatacgaacgaatctttacaaatatatatatgtgtgtggtttgtatttgtctgcaaaaaaaagcaaataaaaaaactgagtcgagtttacacggtgtagctctgctgaatggtgtcaatgtcgaggcccttgagcttgacgacggactcgacgtgtcccttgagcgtgtgcagctccctgagcctggccacctcggcgcgcttggccgtctgctcggcgagctccgacagctcgcggtagccctg

SEQ ID NO: 13598 - DNA, 622 bp, Zea mays
  unsure at all n locations
  Clone ID: cC-zmpo14820023a03a1
accggcgacctcaacgcgtacaagaggaactggatcgagatccagaacgtcgacaacctgtccatcaacggccacggcaccatcgacgggcagggagccctggtgtggaacaagaacgagtgccagcgttcctacaactgcaaaatcctccccaacagcctggtgctggacttcgtgacgaacgcccagatccgcggcatcacgctgctgaacagcaagttcttccacatgaacatcttcgggagcaagaacgtggtgatcgacaaggtgacgatcaaggcccccgggccacggcatcagcgtcggcagcctggggcggtacaaggacgagaaggacgtggaggacgtgaaggtgacggggtgcacgctcgccggcaccaccaacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgccttcaggtggccgtcaacgacgtcgtcttcaggacatncacgcacctncaacacgccgagccatacgctcactggccacacctgcctg

SEQ ID NO: 13599 - DNA, 230 bp, Zea mays
  Clone ID: cC-zmpo14820023a04a1
gtcgatagactggacgcatgccgacttcatgcggacctagcgcgtgtccttcttttcggtgttgcctcttgcggcgtggcacatgtcttgagaccgtgggatgaaacggctcgttgagaggcacgcgtgtagggcagcctatatatatgattctataacatgctaatttgtgcttctttattactatatatatagccattcatcaatcaattcaactagaaacattcctc

SEQ ID NO: 13600 - DNA, 407 bp, Zea mays
  Clone ID: cC-zmpo14820023a05a1
gcacgaacgccaagggcagcaccaaaggttgcctcaaggagcttgcatgcttctagaccctccgtcgactgacccatctctctagttataatttttctctcgtccttgcattgcccattacatgctatccattggtaacgcacaacagtaaaacgacagacatccgacagctatattatgttcgacggtgtaacaccctgaatttgagggtataaaatttcttctctaaataccaaccaaattcaggtgttacctcttgtctctctctctctcttttccttttgattaaaagtaagtgaattaggcgagggtttaattatttattttgtcaaaacttatgtgagtcatgaaatgttgcatcatgctgagcctaaattattcttttgtttgatgcacatgtttgaaaa

SEQ ID NO: 13601 - DNA, 507 bp, Zea mays
  Clone ID: cC-zmpo14820023a05d1
cccacgcgtccggctttcgttatcctcctcttacattacaggtcatagctaagcaggtctgacaggatgtcgtggcagacatacgtcgatgagcacctcatgtgcgagatcgagggccaccacctgaccttcgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctgtgaatggattcatttaacctcgctcgctcgcttgtccatggttcgagc

SEQ ID NO: 13602 - DNA, 551 bp, Zea mays
  Clone ID: cC-zmpo14820023a06a1
gagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattcgacacaccttttgtcctctttttcttggtccctctttcttcttaatttacgaattgatgcatgccgctgatgttcttccccctgagagagggatttacaccttgatcatcgcttgccattggttgatccattcacatttcgaattaatcaacatcgggtattt

SEQ ID NO: 13603 - DNA, 495 bp, Zea mays
  Clone ID: cC-zmpo14820023a06d1
cgtcctcgcaccagtccctcctccttggaagcgagggaggagagtggagggagagggaggagcgaggcaccggtgagctcgggaggcggcgtggggcttgcacgccggccctacccccagctcactcaccacgctcttctctcaccaactctctctctcttatctccttccaagattcccccatttttttgttgttgtcccccccattcttgctaggatcattccttgatctttcgctcgctccagtacgcccgttttccagctccggagatcccatctcggccacctcctgcggtctccaagctccaagaggccagattccagcacaaatttgaggtcaatttacccgctcagctcgaatcaatccgctcggcaacaagtgtccttggttcccccgatccccgggcttcgattcgatcgaatccgacctaattttattgtgtgtgtgtgtgcgtgtttaaccttctctcgctgcactttttctttcttctccct

SEQ ID NO: 13604 - DNA, 351 bp, Zea mays
  Clone ID: cC-zmpo14820023a07d1
cccatcgcgtccgcggacgcgtgggcggacgcgtgggaaaaaattataataaaaaaaaaaaaaaaaaaaaaaataaaaaaagataaataaaaaaaaactataaaattactaaaatataaataaatgatataaaatggggggtccgctcttaagattccaagtttacgtccccgggcttgcaagtctatggttctttttttgggtctcttaattttaatcttcggcccgtggttttccaacgctgggcctgggaaacccctgtggttccccaattatatgggctggaaaaacatccccttttccccatttggctttacactaaaaaggccccccccatttgccctttccaac

SEQ ID NO: 13605 - DNA, 541 bp, Zea mays
  Clone ID: cC-zmpo14820023a10d1
ccatcctctcaacacgaagatggcgttcatcagcaatgtcgctgtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctccccaatagcttggtgctggattttgtgacgaac

SEQ ID NO: 13606 - DNA, 428 bp, Zea mays
  Clone ID: cC-zmpo14820023a12d1
ggctaaaatttctagtcctcacatgagccctcgagaaaaactgtcttttgtaggaaaaaaaaaaaagagagagagagatcacaccaacgaacaccgaagcatctctgcaacacatggtcgtgtagagtcgtagcacacgttctcttccaaaattcaaaccacacaccgagaaagagagaggaatctactgtggcgccagcccgtcgtcgtagccaccgccgctcctccgtggcccgttctgcaggttcctctcgaactccttgaggtaatccaggagcaggacgaccacgaagaggatgaacgccggacgagctgttgccgccgccgccgccttctcctccgcctcccccgaaccggaacggcggaaacccgacgcccccgtcgtcgagcctcggcttcaccttctctttcactgaacctgacggcgg

SEQ ID NO: 13607 - DNA, 168 bp, Zea mays
  Clone ID: cC-zmpo14820023b02a1
atcgaattccaaagagtggaaaacaagcaaaaggttaaatatacatgccatttttggaggcatttttttcatgagggcatgtttcgatatatggaccactaaatatacatatcatttactttcctacaaatttgctacatccttggaaatgcatagtctgtctccaag

SEQ ID NO: 13608 - DNA, 522 bp, Zea mays
  Clone ID: cC-zmpo14820023b03a1
gctcatggagatggccaggaagaccgggctcaaggtccaggccgttatgtccttccaccagtgcggcggcaacgtcggcgattcagtcaccataccacttccgggatgggtcttggaggagatggacaaggaccaggacctggcctacaccgaccggagtggccgccggaactacgagtacgtctccctgggctgcgacgcgatgcccgtgctcaagggccgcacccccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgagtagcttgaaggcggctgctgatgcagtgggcaagccggagtggggcaacgcgggtccgggcgacttcggcagctacaaggactggcccgaggacacggg

SEQ ID NO: 13609 - DNA, 618 bp, Zea mays
  unsure at all n locations
  Clone ID: cC-zmpo14820023b04a1
catcaaagaaacaggcacacaagaacaaatacctcgctaccaacaatggcctccaggtcctccatcctacttgcaacgtcgatgctggctgcgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcatccccgctgatttcaaggccggcaccacctataagaccacactcagcatctaatcagcctctgatgatgaattatatttcaaaagagctcacctggtgctcatgttagcaagaacaatatttttctatggttattttgtggcaccaaaccacccaagatatatgtgatgctacatgtcccttctgatgccttgntgngctggggtgatattattacataaactaaataaaatatttatttaagatttaggagaaatatgttga

SEQ ID NO: 13610 - DNA, 402 bp, Zea mays
  Clone ID: cC-zmpo14820023b04d1
ggctccagggcaacgagcgagttcctcgtcgaggtgctgatgctcaaactcctgcaccacccgaacctcgtaaagctgatgggctacagaaacgactacaaccagcggatcctggtctacgagtacatgcccaggggctcgctggaggaccatttcctggacttgcccccgagctggaagcccctgccgtggcacacgcggatgcggatcgcggtgggcgccgcgaaaggcatccagtacctgcacgaggcggcaaacccgccggagaactaccgcgaccccaaggcctccaacatcctccaggacgcggacttcaacgccaagctctacgactacgggctcgccaagctgggccccatgggcgaccagagccacgtgagcaccaaattgatgggcacctac

SEQ ID NO: 13611 - DNA, 370 bp, Zea mays
  Clone ID: cC-zmpo14820023b05a1
cccacgcgtccgccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggattaaaaaaaaaaaaataaa

SEQ ID NO: 13612 - DNA, 541 bp, Zea mays
  Clone ID: cC-zmpo14820023b06a1
gcggaaggtcggcggcggcccgcctcgctgatcgcgatggagcggcggagcagcagcggcgcggggagctgcctggggctgctggcggtcgccgtggtgtcgacgagcgtcatcctcgtctcctaccgcctccaccgccgcctggaggcggacctcagggtcatgatactcggcgaaggcgacggagccgcggaccagggccggcgccgcacgaagaagaacaagaaggtgcgcttcgcggccgacgtggcggagccgtcgtcgagccgagaggagtaccggcggcggcgggcgtcgacggcggcggcggccacccgagcaagatagcacgccaccgtcgcgcgccagcctggcttgtggtgcatggctgtgtagcttgcgtgacgtggcggcatgcacgttcagctgccgtacgtaagccgttgcggtttcagtgggctgtaatcaccggtgtgcatacttgttcagtgcgaatcgacgcgtgtgcttgcatgccgtgacatacaaatcggaacaaaccaactcgatcttttcaggcctc

SEQ ID NO: 13613 - DNA, 574 bp, Zea mays
  unsure at all n locations
  Clone ID: cC-zmpo14820023b06d1
gagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcggaccaggtgccgtgcaacaagcgcggccggtcctactacagcaactgcgaggcgcagaaggccgtcaacccctaccgnncggggtgctccgccatcacgcgctgcgcccgcaacatgaactgagcccagcgctagctgctgccagggcgcgccgtcgtcgccgagccggcc

SEQ ID NO: 13614 - DNA, 518 bp, Zea mays
  Clone ID: cC-zmpo14820023b07d1
agatgaagaagatcgcctgcgccgtcctcgtcgccgcctcggccaccgtggcgctggccgcggaggcgccggctccgtcccccaccagcggctcctccgcggtcgcacccgccatcgtcggggccgccgtggcctccttcctcagtccgtactacattcactgagccgccggacgaggagccggactgccggagggaagagaccaagggggggagagacttggctgcgctgcgctgctctgctgctcccgcgcattcccgatgcgtgggtgggtgtgctctgattgggcacggcagtggcacaccttcgtcttccttttgtttgtttttttcctttcctctttctgattttcatttaactaattggtatcgctgatgtaccagtttaatttggtgccccgttatttgttctttccctcgagagagggatcgacacctgtaccattgcttgccatttgtctggaccagttcaacaattcaatttaaccatcgcgtatatgtgtgcgctttggttgaaaa

SEQ ID NO: 13615 - DNA, 549 bp, Zea mays
  Clone ID: cC-zmpo14820023b08d1
gtgatgcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgctggccaagcccggcgccaagggcggccaggcggtggcggtgcggctgttcgggaccaagacgcagatctacaactgcaccatcgacggcggacaggacacgctgtacgaccacaagggcctgcactacttcaagggctgcctcatccggagcagcgtcgacttcatcttcggcttcggccgcagcttctacgaggactgccgcatcgagtcggtggtcaaggaggtggcggtgctgacggcgcatcaacgttcccagtccatcgagggcgccttcacaccggcttctcgttc

SEQ ID NO: 13616 - DNA, 305 bp, Zea mays
  Clone ID: cC-zmpo14820023b09d1
gaataattgtttcatattctaaaaaaaagaaatacaaaattaaataaatagaattacaaaaaaaatatataaaataaggaaagagaggcggctcggcggggggattcatgggttccacgcctagggtgccgggcctcctctgttgtatggtttctccgaggttccctaagttgccctgcctgtcccctctttaccaccgggggaactggggcgaccccgtagtttcccactcttgttcgctcatggtcctcttgcccctttggtcagttagggtatggcctacagggcccgccccgtccgccctg

SEQ ID NO: 13617 - DNA, 162 bp, Zea mays
  Clone ID: cC-zmpo14820023b10d1
tcagtagcctgcaataagagccagccagagtaactattataattttcgccgcttccattcgtgcttacatgccaaccgtctccgttctcaatgttatccagcatcgacgttccttcatcaccgctggagcgagatggttgtgaagaggttctctctttgtcg

SEQ ID NO: 13618 - DNA, 103 bp, Zea mays
  Clone ID: cC-zmpo14820023b11d1
taagaaatatgatcacacaaatctatctggtttcatatgtttgtttataaaagaaaaatgaataaaatagaatagggtatttatatttaaatatattttagtt

SEQ ID NO: 13619 - DNA, 391 bp, Zea mays
  Clone ID: cC-zmpo14820023b12d1
aaaagaaaatatttttccttaaaactcgccggcaagcatacatgcattatttcaaacttcgcaggggggagctcgaccgatatatatgaggactagcctcagtcctaaaatagttttggtttagggacacacgtacgggatcgaccaaagccccatgcaggggccaggggtcatatcatcattatcagggcttcatgggaggggaatggatcggagtacctgcttaaccatgatcaggccacacgtttttttggggggggggggggtatcccgggggagggccgggcgaataaatagtagctggagtttttgacgaacattccctccttggcctcgggggcctcgccggcggaggggtacttgccgagctgccccagggagttggccttgg

SEQ ID NO: 13620 - DNA, 550 bp, Zea mays
  Clone ID: cC-zmpo14820023c01a1
cctcggctaccgcctggcctgtctggactatggacaggccatgtgacccagctgctcggcacgcgccgcgccactgcaccggccccggccccggccgtacccgcaaaagcgaccgggcggtcacggttgcgcgcggacgccccgagacgaggcgcggttcgcagtcacccgttccgtccgtccgtccgcgccttccgccacgtccacgttccagagccagattgggccgcgcgtccacgtccgtcacgctcctcgcgccgtggccgaccctgggtgtgtctggcggttgtccttgtccccccgcctcgcctcgccgaggcgccggcggcggccgattgcccacggcgttttctgttggtttgttgtttccttgcgcgggcgcggggcacggagctgcgcgagcactggccgtatagtggccaacggcgctgcagattccattctcggtgggtgtagggctggaaacgaatcgagtcaagctcggctcggctcggtgcagctcggtggctgaccgagttcggctcggctcggctcgatcatttcacgggct

SEQ ID NO: 13621 - DNA, 524 bp, Zea mays
  Clone ID: cC-zmpo14820023c03a1
cttaatcatgtgaagaccgctgggctgctaggtgatggattcggctccacaccagagatgagtaaacggaacttattctgggtggttagccagatgcaggctatcatcgagcgttatccatgctggggtgatactgttgaagtaaatacatgggttagtgctaatggtaaaaatggaatgcgtagggattggcatatacgtgattctatgacaggtcacacaatactgaaggcgacaagtaaatgggttatgatgaacaaactcactaggaagcttgcaagaattccagatgaagtgcggactgaaatagagccatactttgttgggcgttctgctattgctgatgaagacaaccgcaagcttccaaaactgccagagggtcaaagcacttctgcagctaaatatgtgaggacaggcctgactcctcgttgggctgatcttgatataaaccagcatgtcaataatgttaaatacattgcgtggattcttgagagtgcaccgattactatttttgagaatcatga

SEQ ID NO: 13622 - DNA, 134 bp, Zea mays
  Clone ID: cC-zmpo14820023c04a1
ttacggttccgtagtaaaaaccctagtgatagtttttcgcgggggctccctgtgggggtatttatttcgtttgccctgtattgcattggttgggtcggccgagtagtaaagccctgtcattctgtattcatatt

SEQ ID NO: 13623 - DNA, 446 bp, Zea mays
  Clone ID: cC-zmpo14820023c04d1
ggagcacatgagctagcttgccagccagccagcagcctgcttgctctccgcgcccgtccttcttcctcgcctccgttccattccgtcccgccctccaccgccgccgtcgcattcagggatggagatgaagaagatcgcctgcgccgtcctcgtcgccgcctcggcggccaccgtggcgctcgccgcggaggctccggctccagcccccacctacggctactccgccgacgcgcccgccgtcagcgccgccctcggggccgccgtcgtcttcttcttcgcctactacattcagtgagccggccggtgcgcccggaggccgtggaagatactaaggggagagtgagtgacatggctgcgcgcattccgacgcgtgggcttgttttttgattctactccccttattggctctttttgtttgttccctctttctccttaatttaacgaat

SEQ ID NO: 13624 - DNA, 370 bp, Zea mays
  Clone ID: cC-zmpo14820023c05a1
tctcgtcgatgtatggttgattctttaatttggttccttttgctgtacttttgtgggccatgaaaacgggggaaacttggtaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttaaaagaatcaaatttaactaacccgggcttggaacgaaaaagtttttttatagggcacctaaaatcaaatcaatgggccgatttttaaaaactgttgaattggaaaaacctgggggttcccaaattaaaaggctttgaaaaaaatccccttt

SEQ ID NO: 13625 - DNA, 494 bp, Zea mays
  Clone ID: cC-zmpo14820023c05d1
gcgccgcgtgcaaggcgcggtacccccgcgcgcgggtgaacgcggagcgcgtcgagcccgttaccgagggccgggaagccaaggcgcagaccatcctcgccgagtcccagcgacgcggcgtcgagctcctcgtcataggcctgcgccgcgcgtcctctttctttgggttaagaagcccgagcgggtcgtcgagccgcgggcacgacagcacggcggagttcttgatcgagcatagcaagtgcctgtgcgtaagcgtccagaagaagggccagaatgccggatacctgctcaacacctagacccacaaaaacttctggctactagcatgaacgtacatgtaccttcatgatcgatcgatcagacttgttttcatgtatgtgtagacatacatacattaagcatgcctggcgcgtttgcacctacacgggttgcttgattttaccagctggctcgaaccgagcggcgggggaaaaaaaaaaagaacgaacaatctc

SEQ ID NO: 13626 - DNA, 563 bp, Zea mays
  unsure at all n locations
  Clone ID: cC-zmpo14820023c06a1
cggacgcgtgggttccggtaccgcaagtaccacatcgacgagatcgagatggccacggagcgcttctccgacgagctcaaaatcggcgagggcggctacggccccgtctaccgcgcctccctcgaccacacccccgtcgccatcaaggtgctccggcccgacgcgcaccaggggaggaagcagttcctgcaggaggtggaggtgctcagctgcatccgccaccccaacatggtgctcctcctcggcgcatgcccggagtacggctgtctcgtgtacgagtacatggaccacggcagcctcgaggaccggctgttccgtcggggcggcacgccgccgctcgcgtgggcccagcggttccggatcgcggcggagatcgcgacggcgctgctgttcctgcaccaaacgaagccggagccgctggtgcaccgggacctgaagccggccaacatcctgctggaccgcaactacgtgagcaagatcagcgacgtcnggctggcacgcctggttgccgcgtcngtggctgacaacgtgacgcagtaccggctgacngcgacngcgggcac

SEQ ID NO: 13627 - DNA, 551 bp, Zea mays
  Clone ID: cC-zmpo14820023c06d1
cacgaatctgccatcctctccaacacgaagatggcgttcatcatctatgtcgcagtgaaggcggcggccgtggccgcgctgctgctggtcgcagcggtgtcgcctgccgcgcgcgcggcggcggtggcggtggcgggaggggcgccgtctgtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcattcatcgaccagaagtactgccccaacaacatctgcgtcaagtccggcgcttccaagggggccggcaccgacgtcgtcttcaagaacatccacggaacctccaacacgccggaggccatcacgcttaactgcgccaacaacctgccttgccagggcgtgcagttggtcaacgtcgacatcaagtacaatggatccggcaacaagacca

SEQ ID NO: 13628 - DNA, 528 bp, Zea mays
  Clone ID: cC-zmpo14820023c07d1
caccggtcgtcgagcgagcagtctcccaattccacccaataacttataacatctcctcgaacgccaggttccttggaccactatatccaggagcgacgaagtgatccacccgccagccatggagatgaagaaggtcctctgcgccgccctcgtcgccgccgcctcggacaccgccgtgctggcctctgtcgcctccgaggcgccctccgaggcgcccgccagcgcggccggaggtgcggctggccctagcgcaagcggggccgtcgccgccgtcgtgcccggcgccggggcgctcgaagccttcttactcgtctactacctgcactgaacgacgacgcgcggggcgtgcaacgttgggatgcatcgcgtttggctcatccgaggaagtaattgttttaggtatttacctggctagcgattggttacatggtcgatagttccttcgtttcgcggccaagtgaattggcgaagggttggttttgaagtgtgacctgggccaacatttgtttgaccccaatattttgtttt

SEQ ID NO: 13629 - DNA, 469 bp, Zea mays
  Clone ID: cC-zmpo14820023c08d1
cggacgcgtgggcgtgccggccgccttcgctcatcgtcgtgcaccatgccaactccgagaagacgatcttgcaaggaaagcgcatgcaagaacgtcgtcacatatatagaggagtagcagccagcaggaggtggaatcgacggcttgatcccgagaccgagcgagaccagctgcaaaagctcctagcgcattggccgccggagtgggctgcagtgcaagtgtggatcgcatgcgaggaggatgcgagtgctggaggaggacctgtacccgtcgacgccggggaaggtgaaggtggagcgggcgggggcgatgagccgatacctgcaccgttgcttcgcgtccacggggaccatgttcctgtgggcgctcttcctggtggccatgacggccacgtacctgatacgtcactccatcgtggacaccttctcccgctactttgcggcgtcagtggggcgggctgcactgggag

SEQ ID NO: 13630 - DNA, 529 bp, Zea mays
  Clone ID: cC-zmpo14820023c09d1
gaaggggccgtggacgcaggcggaggacaagctgctgagggaccacgtgcggcggcacggcgagggcatctggaacgccgtgcgccgggagactaggctgcagcgctgcggcaatgagctgccgtctccggtgggccaaccacctccgccccaaccttcgcaagtgccccttctcccccgaggaggagcgtcagatccttctcctccacggactcatcggcaacaagtgggcgcgcatctccaagcacctctcagggaggacggacaacgagatcaagaactactggaacacgcgcttcaagcgccggcagcgcgcgggcctgccgccctacccgccggacgtcgagcggcagatcaagctgctgcgcgcgcagaacgtcaacccgttcgcagacgcagacgccgacgccggccacgccaacgcctacgccaacgccaacgccagcgccggccttccggcgccggcgctcctctacgacgtcggaaacccgttcgcgttgctcttcagcataccggcactgtcgcagac

SEQ ID NO: 13631 - DNA, 550 bp, Zea mays
  Clone ID: cC-zmpo14820023c10d1
gagaggacgaagagggcgcatcgtgggttgggtgatcacggcctgatggggtcgtggcgcaaggcctacggcgccctcaaggactccaccaaggtcggcctcgccaaggtcaacagcgaattcaaggaattggatattgcaattgtgaaggcaaccaaccatgttgaatgccctcccaaggaacggcacgtcagaaaaatactcttggcgacctcagcaaaccgccctcgcgcagacctctcgtactgcatatacgcattgtcaaggagattgtccaagacaaagaactggatagttgcgctcaagacattgatagtggtgcataggcttctgagggagggcgatcccatgttcaaggaagagttcctggcctactcatccagagggaacatcttgcacatagccaatttcaaggacgactcgagccagtcagcttgggattgctccgcatggattcgcgcctatggatgcttcctggaggaacggctcgagtgcctcagggttctcagatacgacatcgaaaccgagcgtctcgtcagatatccccaga

SEQ ID NO: 13632 - DNA, 593 bp, Zea mays
  Clone ID: cC-zmpo14820023c11d1
cacgacgccaagtccgcgtccgccgtcatccgctacgccggctccagcgccccgccggcgccgaacatgaccgagccaccggccggctgggcctggtccatcaaccaggccaggtcgttccgctggaacctgacggccagcgccgcgcggcccaacccgcagggctcctaccactacggccagatcaacatcacccgcaccatcaaggtcatggtctcccgcggccacatcgacggcaagctccgctacggcttcaacggcatctcccacagggaccccgagacccccgtgaagctcgctgaatacttcaacgtcaccgacggggtgttcagctacaaccagatgggcgacgtgccccccgccgtgaacggtcccctccatgtcatccccaatgtcatcaccgccgagttccgcaccttcatcgagatcgtcttcgagaaccccgagaagagcatagactccctccacgtcgatggctacgccttcttcggcgtcgggatggagcccgggaagtggtcgccggaggtgaggaagacgtacaacctgctggacacggtgagtccgcacacgatccaggtgtacccgcggtcatg

SEQ ID NO: 13633 - DNA, 298 bp, Zea mays
  Clone ID: cC-zmpo14820023d01a1
agaagtgagtaaaaccatccatcatgcccagtggggacggaaacttgtacagaatacagatacagactggatccgtttacgtatagattacgactaccaaaacaggctgttcatcgtttgttccatgaacattgtttctctcacttctgtaccgtatgtgtgtactatggattcatagatctttcatgatgatgaggatgatgaggggactacaatattagcctgtggcagctgagttctttatcggccatcatcttcagttgcctctcttgttctgcgactgctagtagtgcttggg

SEQ ID NO: 13634 - DNA, 283 bp, Zea mays
  Clone ID: cC-zmpo14820023d03a1
tgtaattctgctgcaagttcacctctcagtccagtacttcagtcaatagaccatattaagatggtgaaatatgaaaactggtagcttgcatctgttcaatgttatgttttaatcaacgctgaatttaatatttgtcaagtttgaactttgacacctactttttctggtttccttgccactgcgaggccatggaagcgaccaaatttatttatgtttgatgcgggttaaaaaaaacaaaaaaaaaaaccaaaaacaaaaaaagccataaaactaaaaaataaaa

SEQ ID NO: 13635 - DNA, 135 bp, Zea mays
  Clone ID: cC-zmpo14820023d04a1
tgatgtcttatgaatgaataaccaatgacaatccgaagtagcctttttaggcgttttcattatatttgaatggaccggaacatattgtgttcaataattatctgtgtgaagcctgtttatgctacttctgactgt

SEQ ID NO: 13636 - DNA, 562 bp, Zea mays
  Clone ID: cC-zmpo14820023d04d1
acccacgcgtacgacccggccctctccttttgacaccatcacatccagccagccaacaaaaatgtcgcgcgacacagctgcggagctctgttacatgctcaccgttgctggcctcagcgcggccgaggccccggcaaaggcaccgaaggaaggcagggctgccaaggcacctgaggctgccaagagaactgctgcccccgctgaagcacccggagccgggtacacccccgacggcgccggtgccccataatagacggctaggaagtctggaccagctaccgcgccagccaccggctttacaccccctttttccacggacgaggagatgagcccttccccgccagcatccaccgccagggagacccctgcggctgaaggaccggctgatgatgaacccggcggtgctgctgcccttggaagaggagctgccatcgccggcgtagccgctggagatgctaccatgatcttcttctactaaactcacccgcgatggtccgggccgcggagagacattagggggggcacggtaatgggctgggctgtaatcgctctcggtgggggg

SEQ ID NO: 13637 - DNA, 359 bp, Zea mays
  Clone ID: cC-zmpo14820023d05d1
gcgtccggacatgggaccgcgccggcgtcctgctcaccaggaacgtcggcattagcgacaacctgcgccccgccaacccgctcggctacctcaaggacgtgccgctgcccatctgcgcctcgctgctcaaacaggtggactcggacgacgacgacgatcagttatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgttactgcgaggctgtaccaaattctgagtgctggattcttgctattgtc

SEQ ID NO: 13638 - DNA, 412 bp, Zea mays
  Clone ID: cC-zmpo14820023d06a1
gacaaccaatttgtcgtgaatttgagctaaaaaaatgtaatttacatttgatctctctctgctctaccgctacagcagcaggcacaagacgcagactgcttaggggtcacaaacaaggcttacagttacagccccacgaacaaataggaagcagtctgcgcctggtacgcctaacaaatactccatccgtttctttttagttgtagctggatagttcaattttgcactatccagcgacaactaaaacgaaacggagagagtaagtgttacacccttgtccagctacgggatttgttcttctactaacccgtttacaacagcgcgacagagacgacgaatttggtcaatatgatgatgaaagaaggcgtgtcatttgagcgattgatcaatgtccgtgtgaaaagggatgcgg

SEQ ID NO: 13639 - DNA, 228 bp, Zea mays
  Clone ID: cC-zmpo14820023d06d1
gctcgagccagcccgtcgcctgcgcgcatctctctacacttctactgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcagccgccgaggcccccgccccggcccccgcctccgacgcc

SEQ ID NO: 13640 - DNA, 278 bp, Zea mays
  Clone ID: cC-zmpo14820023d07d1
ggaggagcacgcctgatctggacgccaactcatcggtgcaaagcgtttcagtttcatcgctcctatggtacacaaatcgcgactacgtattcctacaatcctactaccttaagtatgtatattcatgtactgccgtattttccttactgctgttattagcttgtgtgtgtatctacagtcgtgtgtgttattgttttctgaaattgtgatatattgccaccgttgtccagattctgtgggtatgtttattcatataattggaatgctctctgttcttg

SEQ ID NO: 13641 - DNA, 294 bp, Zea mays
  Clone ID: cC-zmpo14820023d08d1
caggaaggagaagcaggcgcagcaaagctgaccgactgtccgtgcatgcgcgtgccaactaatataattattggctgatgatacctgatgatcagtgtgtgatcgagcaaggagacgacacttgaattctctacagttggcatagcggcataggtcgggagagacactctcgactggccacaccatgtaacaaactaaccttcttcgatgtctcccattattttcctccacggagttcttctgatgaaacaacatgttctaattgggcttaaaaaataaataagataaaaatat

SEQ ID NO: 13642 - DNA, 431 bp, Zea mays
  Clone ID: cC-zmpo14820023d09d1
ggcgtggatcttcttttcggcatccttgctcatccggcacagctcgatgatctgctcgggggctcccttgctgaccctgtgccaatcgccgttgccgtcgatgtaggtgatggccgcgcgcttctcaaccgggttgaaggggaggaagtggacctccttgatgccggcgcgggcctccttggggtcggcgagcatgccgacgatgcaggtgtcgatggcgtcctggttctcgacgcgggaggccctggcggcgttttggagcaccatgtccttgtctacgcccttgccgcacaccttgattagggtcttgtctacggtgagcttgttgagggtgagggtgccggtcttgtgcgtgcagagcacgtccatgccggccctcttctcgatggctgttatgcacttgatgatggcgccctgctgggacaggcggt

SEQ ID NO: 13643 - DNA, 440 bp, Zea mays
  Clone ID: cC-zmpo14820023d10d1
atctccccttctcacccaaccctccaagcaacattgaccgcaaagggccatccgctgcggtcagtgtaggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcaagaagggcacccgaaagaaccgcaagaagcaggacaagtcggccggcgacgacgcctcgggcacatgccaggacctccccgccgttcccaagaagtccaaccgccggaaaaacaagggaagctccgaggggagcggtagcgccgcggccaaggacaccacc

SEQ ID NO: 13644 - DNA, 338 bp, Zea mays
  Clone ID: cC-zmpo14820023d11d1
gaattttccgagttgactatgggcatcaagaagctgcttccaattttgggaaggatccaagaacttacgatgtcttgacatagcgttctattggcgatggaaatggcatggtgaaggcccttgaggtagagcgtgtgaagtgggagaatgttgatggaagatttcaactcaaggagatggaaggatcagaagagattattgaggctgatctcgtcctcctagctatgggattcttgggtcctgaagcgacaatagctgagaaattgggtttggagatggtcaactgatcaaacttcaaagtgctatttggagactttgcttccagtgttgatggtgtg

SEQ ID NO: 13645 - DNA, 475 bp, Zea mays
  Clone ID: cC-zmpo14820023d12d1
ataacaaacatgaagcatgcttgagcaaagcttgcggcgcgccaaaacagtagggaagttggtaggtgataggttacaacattggatagaataaagtagatacatcttacgagcagtacgacagtgatatataagaacaaaagtatatgcgattctaaaaattcagttaacatgctagcaaacggtacaagcggaacatcgcatcatgaagccacaaggatgacaaatcaggttaaccgatctcgcttccaatgcaagattattgcagtacgtagtcgggggccggtcgtccataaaaccatacacaagtgcctatccgctgaggccgcagctccacccacacccacatccacacccagaatcgacaaggagcctcatttcctgtttacttccatgcaacgcaaggcagccctaactttagagatacatccgaaccatcatcattatcctgtgaaactccagagtgcaacgcagt

SEQ ID NO: 13646 - DNA, 277 bp, Zea mays
  Clone ID: cC-zmpo14820023e01a1
gcggcgaccggcacctacacgatcgagctcaaggacagccacgaggaggacatctgccaggtggtgctggtggccagcccgtctgcgccgcgctgctcaagcagctggactcggacgacgacgacgaccagtaaactgtaccacggcggcgtcgcggacaggctgcacaaaactataacgatgatacagagcgaacgcgcgcatggcatggatagcagtatccactgaaagaaaaggaagaaaaggaaataaaaaaatgtaacagagtgcttgattc

SEQ ID NO: 13647 - DNA, 610 bp, Zea mays
  Clone ID: cC-zmpo14820023e02a1
aaagaaacaagcgcccacgaacaactacctcgccaccaacaatggcctccaggtcctccattgtactcgccacggtgatgttggctgcgctgttcgcggttggtttctgcaccaccccgctcaccttccaggtcggcaagggatccaagcctggccacctgatcctcacccccaacgttgccaccatatccgatgtggagatcaaagagcacggcggtgatgacttctcctttacgctcaaggagggcccgactggcacgtggacgctcgacaccaaggccccactcaagtaccccctttgcatccgctttgctgtcaagtctggcggctaccgcatcgccgacgacgtcatccccgccgatttcaaggctggcaccacctataagaccacactcagcatctaatcaacctctcatgatgaattatatttcaaaagagctcacctagcgcatgtgttacaagacaatattattttttcaatggcttttttttgcaccagaccacccaagaaataagttatgctacatgtctcttctgacgccctgctgcgctgggttgatattattacctaaacttaaatcatatttatttaagatttaggagaaatatg

SEQ ID NO: 13648 - DNA, 539 bp, Zea mays
  Clone ID: cC-zmpo14820023e03a1
ccccaacgacgcaggaagcaggatcgagccgaatcctccggaactcgccgccggggccaaccgacctcacactattgatcgaggatgtcgtacgcctacctcttcaagtacatcatcatcggcgacacaggcgtggggaagtcatgcctgctgctgcagttcacggataagcgcttccagcccgtgcacgatctcaccatcggcgttgaatttggcgcccgcatgatcaccatcgacaacaagcccatcaaactccagatttgggacacggctggccaagaatcattcagatctattactaggtcatactacagaggagctgctggagcccttttggtttatgatatcactaggagggagaccttcaatcatctcgcaagttggctagaagatgccaggcaacatgcaaatgctaacatgacagtgatgctgattggaaacaaatgtgacctttctcatacgcgtgctgtcagctatgaggaaggcgaacagtttgccaaggagccatgtctggtttttatggaggcatctgctaaact

SEQ ID NO: 13649 - DNA, 589 bp, Zea mays
  Clone ID: cC-zmpo14820023e03d1
gatcaagcggagtcgaaaggagaagctgcaagacctgctgggcagcatgctggagctgaggaacctgatggacacgccggcggaggagcagcggcggtgccagggcgaggcctggaacatcgtcgggtccgaggacgagatcacggagcccggcgcgctgaccatgggcttcatacgcaacgtggaggcggaggtgatgaggccggagaacctcaaggagtgccggatgagagaactcgacgtgaagaagcacgaggagctcaaggagatccgccgccgcgcgcgttagtccgaggacgacactaccgacatggggtgcgacgccatggacagcgaagctggacgagctatgaacctggagcgggtggaattggataactccaagggccaagacctggagatcagcccgaaggacgtgctgaagaagaagggccagggggaggcggcgcctgaggaagagcccggcccgaggagacagcagaaacgagaacagatccaacaccgggaaagggacgcacccgggtcaaacgagcggagaagcccctcccctgggggaaaaaggcgggaaaggcggaacctctgggggaaa

SEQ ID NO: 13650 - DNA, 294 bp, Zea mays
  Clone ID: cC-zmpo14820023e04a1
tatacctagtatataatatatgcatgttagtcaattggttcagatgcaggtcattttttagtaatgctatcaagaatcaactcataaatcataacaaatgtcgaagtctatcatttgaaacaaccaaaatttgactcaatgccattattaatcgaaatagacaaatccttggttgataatataggatatgatgatgtaccatggccttcatagaacaattttgtattgtagggtgaaaaattataaaaagctatattctaagcatattgaaagggatggtgagttgtgattatc

SEQ ID NO: 13651 - DNA, 440 bp, Zea mays
  Clone ID: cC-zmpo14820023e04d1
cacagcgtacggacaacacaaggagaaggggaagggcggcgagggaagggctccgcgacggggacctgatgtgactccttctactactgcagtatgcaacaccccaggcaacagcgactggccaccgcaatgactcgagaacccaatacaggacatcagatactgcccccaagatcaaaaggccggaggaggaaaaaaggctagggacgtcggccatgaggaaagcttttccatgctgggtgagtgggaagaagacgacaaacggcggcaggaaggaaagaagcatgaacgaaccctagggaagctatcacctgctcaatggaaaaaagaggtgggacctagccggagtaccaagcgcccaaacccagggaaactgcactggcaggagctcaacgcaaattgcagagaccgggccatacaatcggggagaggctggaagg

SEQ ID NO: 13652 - DNA, 424 bp, Zea mays
  Clone ID: cC-zmpo14820023e05a1
gcgaccgctgccgcgtcccgctcacccgcaacgacggcatcaagcagagcggcgtccgctacgccaaccccatcgccttcctccgcaaggagccgctccccaactgcggcgagctgctccgcgcctacgacctctacaacgagacgtccgagaattcctaagcgtccaaacaaaagttctctcgctcgctttttttttaaaaaaaaatcccatatacatatagcacatttgtttcggtttgttgatgcgcgcatgcatgctagcagacatctttcctaaaaaaatttaaataatctccatctcgcattattttagtagctaccattcatgttttctgagtagttggataaatgctaccaccggcatcttttgtacccggccggaacatacgaaaaacacactatctatgctgtgttgtgaattc

SEQ ID NO: 13653 - DNA, 586 bp, Zea mays
  Clone ID: cC-zmpo14820023e05d1
agccgagcgatctcctctccctctccctctccgatccattctccagcgcagcgaagtaaacatgtctgaccgggcaaagatgtcgtggctggcgttcgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcatgaagggatcaggaggcatctccgtgaagaagacagggcaggcactcgtggttggcatctacgacgagccgatgacgcctgggcagtgcaacatggtggtggaaaggctgggcgactacctgcttgaacagggcatgtaactactacgtaccaactggaatgcatgtcgacgacgatggtttcaaggttcgacttccaataatagtaacaacatagcaaagggccttcctcccgcagtatttgctttggct

SEQ ID NO: 13654 - DNA, 454 bp, Zea mays
  Clone ID: cC-zmpo14820023e06d1
gatcgtttgcttgttgcaaatgttggagattctagagctgttatgtctaaaggaggacaggcgattgcggtttcaagggatcacatacctgttcagtcagatgataggctgagaatggccggtgcagatggctgtcggttgcctcttgggacatctcctagtgcggggtttgctctgtgtctctccagcatgcgtggataaagcttttgccgccgcatggctttggctgaccctgaaaccaaggaggaggtggtcgacagctccctctaattcctcatccttgctagcgacggactctgggatgttgtcactaatgaggaagctgttgccatggtcaagcctatccaggacccccaggaagcagcaaacaagcttctcgaagaagctttccgaagggggaagctccgattacatcacagttatcatcgtccgcttcatagacggaactaccggg

SEQ ID NO: 13655 - DNA, 371 bp, Zea mays
  Clone ID: cC-zmpo14820023e07d1
tctgacttctgacttctgacttctgaccgtgctacgtactagtcaatcactaccggctaccgccaccatttgcatgcatacatgcgtgagtgcgtgcgtgcgtggatgcaaaataatacacgtgtgcatggcagcttgacgggtaactgggcctgcatgtgcatgtacctactagctccgtctggatgccttctgtgtgtctacttctactacgtagggtacgacgaggaggccgtgtaagagagaagccgaccttgtacggtggcattggcatgcatgctgttgggatgggacttgggagttgggacttgggagctgctgtggaacacccttccaagaagctgacgtgtcgggcaatgccacccgatacc

SEQ ID NO: 13656 - DNA, 535 bp, Zea mays
  Clone ID: cC-zmpo14820023e08d1
caaggatttgagcatctaatgtcacttgtgccaactgctgtactaatcactggtgttgctattttggaatctgttggtattgctaaagctttggcagcgaagaatgggtatgagttggactctaacaaagagttatttggtctgggaatagcaaatatctgtggttcattcttctctgcatatcctgccacaggctccttttctaggtcagcagtgaatcatgaaagtggggcaaaaactgggttatctggaatcataatgggcataatcattggtggtgctctcttatttatgaccccattatttactgatataccccagtgtgcattggctgcaattgtgatttctgctgttactggcctggcagattatgaagaggccatcttcttgtgggctattgataagaaagatttctttttatgggcaatcacatttatcacaacattagtttttggcattgagattggcgtccctgttggggttgcattctcattggcctttgtgattcatgagtcaacaaatccacatttagctg

SEQ ID NO: 13657 - DNA, 541 bp, Zea mays
  Clone ID: cC-zmpo14820023e09d1
gccctactgagtttcgtgtggaccgtgtgctccagccgtttgaccctgccaagttcaatttcacaaaagttggccaggaagaggttctcttccaatttgagaatagtggtggtgatgacagctatttcctgaacaacgctccaatcattgctgttgatcgggctccaaatgttattgctatcaatgtaagcccaattgaatatggacatgtgcttctcattcctcgtgttctggaccgcctgcctcagaggattgatccagagagcttcttgcttgcactgcaaatggcagccgagggaggtagcccatactttaggcttggttacaatagcttgggtgcgtttgccaccatcaatcacctccactttcaggcgtactacttgtcagtgcctttccctgttgagaaggcagctacccacaagatcccactctctgaggacacgaaaaatataggggtgaccgtgtccatgctgataaattatcctgtgagaggcctggtatttgagggagggaacaccctggacgacctggccactggggt

SEQ ID NO: 13658 - DNA, 393 bp, Zea mays
  Clone ID: cC-zmpo14820023e10d1
aaaaacaaatattttccactcctacgaatgatgattaatattttttctctgattggggccgcaaatccatccggtctttcaaattctagtatacaggccaccggcttacataacatgacaacatgacccgtcacccgtcggtgggaataccgggggggcggggcgcgtttttttgcacggggacggcaccggggagtgcgccggagtcacccacagcctttcacaggaatccgtctttgggggcttgctcctcggcctttctgttggccgtctgcacggccttgaaccacagaaacccggaggtcgggatgccggggaaaacaaaaaaacccaagagcggggcgtacagggcgctgtcggggccgacaatcccgaacaccggccggtggttgg

SEQ ID NO: 13659 - DNA, 603 bp, Zea mays
  Clone ID: cC-zmpo14820023e11d1
taaaaaaaataaataaaaaaatataaaaaaaaaaaaattgaaatttaaaaaaaaataaaaaaaaaaaaatagatggggataaaataaatagatcttgttcaatttcattatatttactcctattaaatctaatagaaaatatgggggttctttttttagatattttgggggggggcctctttgaggaccctcttctctgttccccgtttttgcgtcttgcgttttttttttgtttgggccttttaattatttacctgtggggctctttcttttcttttctttttgaaaacccccgggtgaccccccttttattccctgtggttttaacttcctttgtcgccgctgggtgttttttttaaatggcctgcccttcctttttttctaaatgtccgcccttttttggcttttatcccccccttttatgggctttcctccccctggtgttttgtttttcccaaattgggcccctttttcggaggtgttcaagcccctttttttctttttctttttttttctagcacttacagcgggtcccttatgtgtttttagtggggcctttggtgtctccttttgttttttgtcgctaggccccaaatttttttc

SEQ ID NO: 13660 - DNA, 537 bp, Zea mays
  Clone ID: cC-zmpo14820023f01a1
gagctgtgtcctagggcgaagcgagactgcttacaggtcctctttctgatgttgaccgaagtccattacgaatgctgcgactagactctggaaccggagtacgccaattggctggtccagtatgtgcgccaactcagcagcactgctacgaccccgatcaagcgcccaaggtgaagttcgacgcgcagacggcggagcggctcgacgtcgcgttctactccgagctgctcgcccgtcgcggcctgctcacctaggacaacgccctcatcgaggacccgcagacgagggcgatggtggagaacttcgaccggaacgagccactgtggcagcagaagttttcccaggcgatgcagaaggtcgggatgcttgacgtgctaatcggcgagggcaagggccaggtaaggaagcagtgccgcctggcgaacgggcaggagaaggagcagaagcagcagcagccaccggaggagcaagaggagcagcagccaccggagctggaggaggaggagcagcaacaagcgcatcagccacaggttacat

SEQ ID NO: 13661 - DNA, 225 bp, Zea mays
  Clone ID: cC-zmpo14820023f03a1
gagacccatgctttcaggtccgacggcgtaatggatttttcctgcggagtcagagccggtggcctaccattggaccttgttaaatgtgcggcgaaacggacccaatcagaaggctaaataggtcctccctttatacggccccaagcctcctaccccggtctatcgccttgatattttttctatcgcggcccctagggggaatcacggggccgggggggaccacct

SEQ ID NO: 13662 - DNA, 405 bp, Zea mays
  Clone ID: cC-zmpo14820023f03d1
ctatcacacggagatgaaactggggacaccacccatgcactactacgaacaggacgacaccgacagagacaaacggtggggaaactgcaccacctgcgagcaaagaacacacaagagcgggctcgggttagacggggcgcttcacagaccccaaggcactaccggaccgggagcatggggacagatgcgaccaggcattcagcgcagccacctaaggcggaaagcagccgaagagcggcgccaaagcgcccggcgaagagaagggccacccacggagacggggggtcgacaaaaggacccttaggaaccgaagcgctgcacgctgatcaggcgactaaggatgggcagacacagccagataatgccagcgtcattaccaggggcggagctcaacaaaggggggga

SEQ ID NO: 13663 - DNA, 364 bp, Zea mays
  Clone ID: cC-zmpo14820023f04a1
tttttgtctttttttttttgtttttttttttttttttttttttgtttgggtttttttcaaaaaaatcatcttattgataaccataaaacccatcagggtactacatgatcgccagaacaaacaggggcccgtcaaaacacgtcccaccaccaccacgcccacacttcctccgccgccggggccgactccatacatacacacgcccgccgacaccttacacagggccccacccgacccgagctggatttacccaccccagaccagacgaatcattttttggggcaggaaccacttttccagggcggatttaccaaaaaaggtacccaaaggcggcggcggcaagggaggccctggcaaggggtcc

SEQ ID NO: 13664 - DNA, 433 bp, Zea mays
  Clone ID: cC-zmpo14820023f04d1
ggtcgacccacgcagacgcaagaacatgctgatcaaggacgagaccgagacggcgcccggggacagccccaacacggatggcatccacatgggcaacacatccgggatcaccatcaccaacaccggcattggcgtaggcagacgactgcaagtacatcggccctgggaccttcaaggggaacatcactggcgtgacctgcggacccggccacggtatcagcattggcagcctagggcgggacaaggacgagaaggacgtcacggacatcaacgacaaggaatgcactcttaagaaaacaatggtcggcgtccgcatcaaggcgtacgaggacgccgccttcgtgctcaccgactccaagatccactacgagaatatcaagaaggaggactcaagcaaccccatcttcatcgacaagaaagactggcccaacaa

SEQ ID NO: 13665 - DNA, 600 bp, Zea mays
  unsure at all n locations
  Clone ID: cC-zmpo14820023f05a1
tcatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgtcgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaggcggctgaggtcaccaaggcctgcaacaccacctgcgccaaggagaagcagcctctgctcagcgagaactgcaggaggtcctgcaccccttctncttcctgaacgcagagcacgcccgccggtcgtcgacttctgcctgcttgcgtgacactgaatcactgatacatcatacatgccatgcatgggatgcgatgacgatttgatgcatgcatg

SEQ ID NO: 13666 - DNA, 454 bp, Zea mays
  Clone ID: cC-zmpo14820023f05d1
cggacgcgtgggctggctcacgacgatagccgaggaattcgaaggaccgaacgagaagctcctgcgtggtgtcaacgtctaccctaccgtaccagctagccaccacacgcgtagcgcgggaaatgccggcggcggcggccatgacgacgaggcgggtggtgctggaggtgctacggtcggcctcccgcgacgccttccaggtggccttctccttcgcggcgaggccgcccgtgtccaccatgctcaagccggccatcaccaagcccctctaccaccaccaccacgacaacgactatatatttcgtcccaattgatgacgtactaccacatttcgtcgctactactctagtaagcaacgcaaaagaaaatgctgtaagattgagcctgagagcttgagtcaccaatgtaaattgtatacgactgatcgactatatagagagcatgctctgtaacc

SEQ ID NO: 13667 - DNA, 399 bp, Zea mays
  Clone ID: cC-zmpo14820023f06d1
ggacgacccacgcgaacgaggacgcgtgggaatccccattatgtgaatatggaggggctccatgccgtatctgctggaatctacaaagacaaccagaccgaaatgctatctgctggatatgcaaacaacccccaaatgatgtaaggagcatattctcctgtttccactgctggagagggccaacaatacttacctgagcactatagcatgtgaaagccttactatcaaccaccagctactcctagcatgggatattcaaactccgaaactggaaaggcccaaggagaccctatgctggagcaagagtattaccttcctgaaggccattcaatattcacccacaccaagggtgatcagtcaacgcattccaaggtcattatgacagaagcacctgacaac

SEQ ID NO: 13668 - DNA, 432 bp, Zea mays
  Clone ID: cC-zmpo14820023f07d1
caagtcgaagcgaagcttccggttcatcacgttcaagatcaacgagcagacgcagcaggtggtggcggacaggctggggcagccgggcgacacctacgacgacttcaccggctccatgcccgagagcaagtgccagcacaccgtcgtggatatcggacttcaccaccgacgagaactgccagaagagcaagatcgtggtcatctactggtccccagacacctcgaggggtaagagcaagatgctggacgcgagctccaaggaccgggtcaagagggagctggagggcatccagctggagctgcaggccaccgaccccagcgagatgagcatggacattggcagggcgcgagctctctgaagagggaaaacgcgcatcccgtcgggcgatcagacatgcatggcccccggaacccgacagaagcagcgctagc

SEQ ID NO: 13669 - DNA, 514 bp, Zea mays
  Clone ID: cC-zmpo14820023f08d1
cctgcgttgtcacccacccatcaaggttggggccgccagcaggttcagccgttcctgttcttgctaaaacgagagaaggatggctgtgtctcaaggagctgtcctattcttgtttctcctcgtcgcagcagaggtgggaaccatcgatgccaaaatgggagttgccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgcaagcaggtcgtggccacgcgcaagtgcttctgaagaagccttgctagttcatcggtcttgctaataggtgatgggcgcttcattaatttgatttgatggggctcatggctacgagaaacataactacttttgataaaatgcaaggcatgaaaagcgtttctg

SEQ ID NO: 13670 - DNA, 468 bp, Zea mays
  Clone ID: cC-zmpo14820023f09d1
cctagcagcatgaagatcaaggtggttgctcctccataaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaaagccgagaggagccattatcgccagcctcccgccccgtttctttctccttttgttgctgtttcttcattagcatgaacaaagttttctgccggtctgtcggcagccgctttctcctattcatcaagactgtaatgtctattgttgctacctaatgcttctcacttgtcattttggacacatgttcgacctattcaattttaatgagatgcctgatgaggctacttgcaaaaatacatgtggtgttctcaatgaataatatcaaatgttgagctctctatg

SEQ ID NO: 13671 - DNA, 445 bp, Zea mays
  unsure at all n locations
  Clone ID: cC-zmpo14820023f10d1
gtcacaaccaagcatgcctttgctactttgtccttcatcgctgagacttttctcttcctgtatgttgggatggatgccctcgacatcgagaagtgggagtttgccagtgacagccccggtaaatccatcggcataagctcgattttgctagggttggttctggtggggagagctgcatttgttttcccattgtcgtttttgtccaacctgacaaagaagtctccattggagaaaataacatttagacagcaaattgtaatatggtgggccggactgatgagaggtgccgtgtccattgctctcgcttacaacaagttcacgagatctggacacactgagctgcacggcaacgcgataatgatcaccagcacgatcactgtggtcctgtntagcactatggtgtttgggatgatgacgaagccattgatccgcttgctgttccctg

SEQ ID NO: 13672 - DNA, 376 bp, Zea mays
  Clone ID: cC-zmpo14820023f11d1
cacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataatccgctggtttgtattttctttcttctttggatcatcacaaaaccaaccgatgtaattattattagaccgacgcctcacaatcttggaacttattcctaataaaaaaataataataaaataataatatg

SEQ ID NO: 13673 - DNA, 456 bp, Zea mays
  Clone ID: cC-zmpo14820023g01a1
gcggaactgaaggaaagaaaactccaaatggaaaaacaggagccaagaagtaagcaactcagttgaaacttcgttttgttgggaccaacttcaccatggccggggacagataaacatgttgatcctatctactgggtgatacattggtgttttgacacacggatatgtcagtcctattggttgagagagcatgctggatcttcggccatatgctgtaaatcgcttgttaatttttgttctactagtacacgaagaaatcaaggaaaaaaaaccttgactacgggaagaaaatcacggccacaggggtattttaacctccttcctaatgcgcatatatctatcgaagttgagtaaactttgatataatgtattcatgggtcacgtccaaccaaccctgtgattggttgcttgtaaacttttgtggccttaatcatggcttcaatgatgttcttcgtt

SEQ ID NO: 13674 - DNA, 455 bp, Zea mays
  Clone ID: cC-zmpo14820023g03a1
cccacgcgtccgggccaccgaccccagcgagatgagcctcgacatcgtcaggagccggaccaactgaccgtcatcgtccatcaacgaccaagcaacaacacatccacactatatactcaattcacattgcatgcatcgttattattacatcatttatttcagaccccccgcccactgctaaccgtagtccataagagattcatcatccgtggactatgctcgatctcttccgtacgatacaattctcaaatatttctatttatttcctaagtgaattattatatatgtactatttcattccaggttcattttacttgtgaccattcttcagttcttttttctgtaaggatcggtatatcggagcatatgtgcatggctatgccagttgttgggcgtaagaatgtatttttttctgtaatatagaaaaaaactattttaagcaacaggttattgtc

SEQ ID NO: 13675 - DNA, 220 bp, Zea mays
  Clone ID: cC-zmpo14820023g03d1
tcgacccacgcgttcgctaacaagaaagagataagaatcaaagagagagtcgcccaatctttgatcgtgcaacgacctcaagattgactaataaggtgttctggttaattatatcttggctgatacagaataaggttgtagcatacgaggggatcttggatttgagccctatgcagaattgcaccatctatcattagtgagacattcatcatagtacaat

SEQ ID NO: 13676 - DNA, 104 bp, Zea mays
  Clone ID: cC-zmpo14820023g04a1
acctgaccgtgtacatactgactaaacgctcgatctgtgacctcaactgttgtatgaatgtttcgctgcagtaaacttactaatgaagggtgtgtttggttctg

SEQ ID NO: 13677 - DNA, 645 bp, Zea mays
  unsure at all n locations
  Clone ID: cC-zmpo14820023g05a1
ctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgtcaacccgctcggctacctcaaggacgtgccgctgcccatctgcgcctcgctgctcaaacagttggactcggacgacgacgacgatcagntatagcacatcgacgacgacgatcgatatgtaatagcacgtcgtc

SEQ ID NO: 13678 - DNA, 550 bp, Zea mays
  Clone ID: cC-zmpo14820023g05d1
atcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcaaagctgatcgactgtccgtgcatgcgtgccaattaatataattggctgatgatgcctgatgttcagtgtgtgatactgtgatcaaagcaggagacgacac

SEQ ID NO: 13679 - DNA, 223 bp, Zea mays
  Clone ID: cC-zmpo14820023g06d1
cttcaacgcccagagggccgccgccggcgtcgccatgtgcccgccggcctcgcaggggatggggcgctgatcatccgtcgaccagccagccagcccgtcggggtttgattcatgtctccgatctgttggttcatgcatgcatgtctccatttaattcatctgttcatatattcatgtctccagatccagacggtacgtataatatattcagttgttttacgtt

SEQ ID NO: 13680 - DNA, 415 bp, Zea mays
  Clone ID: cC-zmpo14820023g07d1
acgcccacgcgtccggaagggctccgcgacgagtccctagtcttcctcctcctgctgctcctgtctacaacaccccatccatcatacgctggcctccgcatagctcttgatcccatccagtacatcgattctccccccaagatcaaaggccggaggaggaagaaaggttagggagtcggccatgggacgctttccatgctgctgtgtggcagatgacgacaacgttggcaggaggaagaagcatgacgatccctatgttcctatccctgctcataggtaaaattgcggacctagccgggttcccagccccaacccctggcatctccactggcagagctcagccaattgcgagaccggccatacatctggaagagctgaaggaaaattacaaaaacttcagcagggatgcccccat

SEQ ID NO: 13681 - DNA, 389 bp, Zea mays
  Clone ID: cC-zmpo14820023g08d1
gaaccgacgggcgcatgggcaatcagagagcccagaattcctcaccgagaggaatcaccgacaccgaatccggcatgcaccgaggttatgcaattatacacctccatttctgactagcaagggaccgtggagcctggagcccagcaagttgaaaataccgagtaagagcccgctgaaggtgaagaggaggtaccaccgggaagagaaattactacgacgagaactaggggccgactccgagtcagctgctggcgtcggagaaaaataatctaagttcgatttacttacttataggtatgtggaaagaacatttgcgatatggaatagaagaatatgacaatcggctataaacaccgagtgataggatatatagaaccaggtaaccggac

SEQ ID NO: 13682 - DNA, 576 bp, Zea mays
  Clone ID: cC-zmpo14820023g09d1
tcgtgatgcgtagattgcgaggaaatttcaaatgcacagatcaatctgtgggagtatccaaccaacttcaacatcttgcatctattattcaggttcttgacccaaagctacatgaccacctagaaactcttggcggaggtgactacctttttgcgttccgaatgttcatggtgctatttaggcgtgaagtatcatttggagactccttatacctctgggagatgatgtgggctctagaatacgaccctgacattttcttcgcaacatgcgaagaacaaggtgcagtacataaaaataaagtttctaaatccaaactgaaaggactgcgccattttggcaagtgggataaggacaaggataaggaagatgataagaatggggctgaggacggtgaagatggtccggatccgatttcagtcttcatggttgcaagtgtcctcaaggagaagagagaaaagctgttacaagaagccagaggactggatgatcttatcaggatatttgacgatgtaaatgggaacttagatgctaagaaagcttgcgctggagcttgaaacttacaaaaatacctgaaaa

SEQ ID NO: 13683 - DNA, 427 bp, Zea mays
  Clone ID: cC-zmpo14820023g10d1
cggacgcgtgggcggcgctggcgtgcccgcccaagaagctcatccagcaggtggtgttcgcgagctacggaaaccccgcgggcatctgcggcaactacaccgtcggcagctgccacacgccgcgcgccaaggaggtggtggagaaggcgtgcctcggcaagcgcgtctgcacgctggccgtggccgccgacgtctacgggggggacgccaactgctccggcaccaccgccacgccttgcgtgcaagccaagggctccaagaagtcggcccagcgcggcgcagaaattcaatcgctcgtcgggacattctattcgtggctgggcggggaacacattggcggtactgtcattgtaagcttaaaaaaccctatattgtactcgtggctgggcggggagcatctaacaatatatttatagattgttcattt

SEQ ID NO: 13684 - DNA, 410 bp, Zea mays
  Clone ID: cC-zmpo14820023g11d1
cgaggcgttcaagaagaagatcagcgacgcctgcgacggcaaggactcgggctccgtccccatggactccacctcgcccaacgacatggacgggagctacttcggcctggtgctggagaagaagatgcccctcaccatcgaccgcctgctggggatggacaagacgaccgagcccatagtgaaggccatgtcggacaagactaccgacttcgtccccatcttcgccaaggccatggagaagctcagcgccctcaaggttctcacggggaaggacggcgagatcaggaagacgtgctccgagttcaacaacccgcagaacaccaacggcagcacgtcggtgatacggatcagctccatcgacgccgaccagatggtcggcctgtcgcagccagggtcgacgtccaggaagg

SEQ ID NO: 13685 - DNA, 388 bp, Zea mays
  Clone ID: cC-zmpo14820023g12d1
aataaatgtgagttcaaaaaaggaaggagaaaagacaatagcggaagcgagaacaaggggggaaaaaccggatacgggaaaaaaaaaaagggcaaagccaaaaaaaaaaaaagttaaaccaccctaggaaaaagaaaggaacgcgaaaacaaaaaaaggggccaggacccacgggaaaccaaagcaggggggccggcgccagggaagaaaaaggggaagggccccaccaaaaaacagggcctggggggggaaaacaaagagggggggggggataaaggccaaaagggagaagcggaatgggcctagggcaaaaatggaaacggccaccgaccccagggggggggggggaacggaaaagaacttaacacggggaagggggacggaaaaa

SEQ ID NO: 13686 - DNA, 545 bp, Zea mays
  unsure at all n locations
  Clone ID: cC-zmpo14820023h01a1
gtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacagattctcttcacctnattacaaatatgtaactgagaaaggaaggaaaac

SEQ ID NO: 13687 - DNA, 563 bp, Zea mays
  Clone ID: cC-zmpo14820023h02a1
gttcttgtgatctgtctagccgtttcttgggtcagtgctggaaggtcaaactgttggtggaaacctcaccggggtgcttcaacgaacgcgaaggtgtcgctgtcatttagcgcgtcttgattggatttgacctgttggcctggtggcgtgttgtcgttgattgagctcgaggatgatgaaatgggggctcagcagcggcacgcccgcggattcctactacgaggtacggtcagattgcacggacggtgtgcccaagagcaagttcaagatcaaggctggcaaaacattaagtgctcggaaatggcaggctgcatttagtcccgatggctgtcttgatattgcctcagtcctaagccggatacaaagaggaggtgtccatccgacagtcagaggagaggtctgggaattcttacttggttgtttcgatcccagaagtacctttgatgaaagggaagagatcaggcaaatacggaggatacaatatgacagatggaaggaagattgtcgacagatggattcgcatgttggtagcggtaaagttatcacagcaccacttatcactg

SEQ ID NO: 13688 - DNA, 581 bp, Zea mays
  Clone ID: cC-zmpo14820023h03a1
cggacgcgtgggcatcgtcctctccggtggcaccaccatgttccctggcatcgctgacaggatgagcaaggagatcactgccttggctcccagcagcatgaagatcaaggtggtcgctcctccagagaggaagtacagtgtctggatcggaggatccatcctggcatccctcagcaccttccagcagatgtggatcgccaaggccgagtacgacgagtccggcccatccatcgtccacaggaaatgcttctaattctttgggcccgagaaatgcaagccgtgggggagccgttaccgccgccagcctctcctgcccccgttttcgttgccgtttcttcattagcgcgaacaaagttttgtgccggtctatcggccgccgctttcctcccctattcatcaagaccgcaataactgtcgctacctatgcttctcacttgtgatttttggacacaatatgttaaggtccattcaattctaatgagacgcctgatgaggctacttcggattgtcattggttattgatgtcttatgaatgaataatataaattttttttggtcaaaaaaaaaaaaaaagggccgcc

SEQ ID NO: 13689 - DNA, 384 bp, Zea mays
  Clone ID: cC-zmpo14820023h03d1
aaaaaaaaaaagaaaaaagaaaaaagaaaaagaaaggaaaaaaaaagaaaagaagagaaggaagagaaaaaaaaagagaaaaaagaaaagagaagagagaaaaggaggaaaagagaaagggggagaaaaaggaaagaaagaaggaaaaaagagaaaaggaaggaagaagagaaaaaagaggagggaaaaaaagaaaaaaaaagaagagagggaaaggaaaaggaaagaagaagagagaaggaggagaggaagaaagagagggagagagaggaaacgaagaggaaaggaagaagaagagaggagaaggaaagagaggaaaggaggagagaaaggaaagaggagagagaaaggagagaaaaaaggagagaagggagagagggagag

SEQ ID NO: 13690 - DNA, 518 bp, Zea mays
  unsure at all n locations
  Clone ID: cC-zmpo14820023h04a1
tcgggacatgcaaccaggtgcacttcaggaagatgtgccagagcttgacgaggctcccgagggtgaccacgccgcgcgagctgctgctggcgtcgatgcgcgtcgcggcggagaaggccagggaggccaagagccgggtggacgagttcgcggcgaggaaccacgagggccggccgatggagtccatcctcggcgcctgcagcaacgggtacggcaacgttgtgcagacgctcgaggaggcgcggaagatcgtcgccacgcgggcggcggcgggcacccaggcccaggccgacgacatgaacacgaagctgtcggccgccgtcacgagcgccagcgactgcgacaacgccttcgccgacttcccggcgattaggtcccccttcttgcccatgcagcggaacgtctaccgnctcgtcgacaacgttctcaacatcttcgtcgtcgtcaaccaagccgagcacgcgcacaagcacgggcactagccgcgtgcgcgctggccggcctgccagttgtaagag

SEQ ID NO: 13691 - DNA, 267 bp, Zea mays
  Clone ID: cC-zmpo14820023h05a1
acgactcactgcacgatccatcaatccgatcgatctgtcttgttcgttaagaaaccaaacgtgtgcatggttaattatataagacgtgctcttcttcagatcatggtgaattgaaagactgccaaattaaggccacttgtgttgctttgattgtacggagagatcatgctgacgtgtacgtacgtgtaccgagatccgtttcaaatgcatgctttgattgtacagagagtggctcgtttggcatatagctccgctacatgattctct

SEQ ID NO: 13692 - DNA, 393 bp, Zea mays
  Clone ID: cC-zmpo14820023h05d1
acccacgcgtccgtgctcaactgcgccaacaacctgccatgccagggcgtgcagctcgtcaactttgacatcaagcacaactggatccggccacaggaccatggctcgtctgcaagaacgccatccgcatgtacatcggtttggcaaaggaactcgcctgcatctgaaccaatcgactaacatgcatatatcatatacataatgactctctgcaacctctctctctttgacgtactctcaagtcttcaccgaatatataatccgctgggctgtatcacctttcttatgtggatgatcacaaaaccaaccgagataattattattagaccgacgcctcacaatcgtgggactaattcattatgctagggcatatttgtaatcccattccatagt

SEQ ID NO: 13693 - DNA, 472 bp, Zea mays
  Clone ID: cC-zmpo14820023h06d1
ctagttctaagatcgcgatctagaactagtgcggctttcaccaacacgatacatagctcggcactagtgccatctcatgttagcaagtgtgcatgtgcccacaccctagggtcagaatttatataagcatgctatgtgtgggctagagatggtaatttagtctcttcataaagattgaatgctgtacccggagcgtacgtacatattactacccagcctgctgttcattgtttgatatcaccgtggatccacgagactgctgcacctgatgagaggctagagctagaagatggatttcagaacatgcgtgtgcccaaccaattgcacatttcaggctttcaaacgtgctgttcatctgtccttctgtttccctttttttttttcaagaaacgagagaacattggaccttgagcaatatgtatttgagcacgaatttaccctgcgactgcaaaaaaaaaaaagaatgtcttat

SEQ ID NO: 13694 - DNA, 465 bp, Zea mays
  Clone ID: cC-zmpo14820023h09d1
ggaacccaccgaatttcgggtcgaccacgcgttcggatccatgtccgaaggcatcgtcctgccaccctacaacgccggtgcgccctcctacagggcggcggcgccgttcggaggtgccgaggactcacccgccaacacctccgagggccctgtcagtgccagcgggccatcagctgttgacgcgcctgcgtatggtgccagcgccagcggcccgactgctgatgctccggcggcggcggcggcggcggcgtcatccgggccctctagcgcacccacgccatcgtcgttctgagtcctccggcgcaccaaggccgtcgtcgtttgatgggtcctccggcgccccggcgccatcgtcgtctgatgggaccttcagcgccccggcgccatcttccggctacgactgatcagcttgaagcgtgagcgatgacacggagttagggtcatttcgtgcctactcatagacga

SEQ ID NO: 13695 - DNA, 450 bp, Zea mays
  Clone ID: cC-zmpo14820023h10d1
gctagcttattgcaaatgttggagattctagagctgttatgtctaaaggaggacaggcgattgcggtttcaagggatcacaaacctgttcagtcagatgataggctaagaattgccggtgcagatgactgtcggtttcctctctggggcatctcctagtgcggggtttgatctgtgcctttctagcatggtggataagctttgagcccatgctgtgctgacccttaaaccaaggaggaggtggtcgacagctccctcgaattcctcatccttgctagcgacggactctgggatgttgtcactaatgaggaagctgttgccatggtcaagcctatccaggacccccaggaagcagcaaacaagcttctcgaagaagctttccgaaggggaagctccggtaacatgacagttatcatcgtcccgttcatagacggaactatcggtgagaaat

SEQ ID NO: 13696 - DNA, 356 bp, Zea mays
  Clone ID: cC-zmpo14820023h11d1
tcgcctgactgttcctctctccctcctctcagggcggtcttcttttgtttcggccatgcaccgccccggtcgtgtgccgggcatatccctctcctgcaaggtattctttagcgagtgtgccggatgacagatgatgtgtcggtattcctcttccagggcctctcctcttccggcatttgatatgccaatttcctgcatgctggcttttggctatgcctactcctgcctatgaatgctacaagaccgttgaactgaacataccacagattgagcagctcatattttggtgtcagtattggattttagttgccctgttgacagtttgggagagatttggtgattttactatttcatgg

SEQ ID NO: 13697 - DNA, 465 bp, Zea mays
  Clone ID: cC-zmpo14820023h12d1
ggtcggtaaacagttgattcttcagaaaagcttgggtatctatgcgccactcatgacaagaatgcatctcgtcgggtatccggcgcacctcaaattcgtgcaaaagaaaactccagcatgctcatcgttcattacatcttctctccagtcgtagtcgtagtcgcgatgtcggtaaggtcgctttgctgatcgctcagctacctcagacgcccaactcccgtctcgtcttcctggctgacacactgtgtcagcggaggtcaagacgggagactgtttagactctactcgtgtgagtggtacgagtctttcggccgccgccgcgtccgcaggtcaggcaggagatgatgatgccgaacagggagacgatggcgttgatgatggccttcaatccggcggcaatggcgttaacgatggccatgatgcagttgccgatcgtgcggaagatggacttgatgcaggaaacta

SEQ ID NO: 13698 - DNA, 365 bp, Zea mays
  unsure at all n locations
  Clone ID: cC-zmpo148049h07d1
gacnacaaggagacgagcgaaaaggcgctgtatgcggttttcgggaacgccaccagccccagggagcggggcaggccaacaacaaggagacccccaaccgcaccgcgaaggccgagcgcgagaccgcccngaacaacgagcacaagcacgaccgccgaacgacgggcgcgcaccacaacagcggggagctgcacgacaacgccaacgacgaccaccggacgacggacgacaggcacggcggcaccgagaagaccacacacaagagcgccgcggacgaccaccggacgaggcagagcaccgcgctcacgaaccacgagacgtgcctggacgggggcgagaacaccacgacccccgccgagggcaag

SEQ ID NO: 13699 - DNA, 476 bp, Zea mays
  unsure at all n locations
  Clone ID: cC-zmpo148049h08d1
aaaacaaccgagcgaacnccacncccactttttctccgtttttttcaccagcgcaacgaaggggacatgtgtgaccgggcaaagatgttgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacattatgaaggacttcgacgagccagggcacctcgcgccgacaggcctgttcctcggacctaccaagtacatggtcattcaaggcgagcctggtgccgtcatccgtggcaagaagggatcaagaagcatcaccgtgaagaagacagggcaggcactcgtggttggcatttacgacgagccgatgacgcctgggcagtgcaacatggtggtggaaggctgggcgaatacctgcttgaacagggcatg

SEQ ID NO: 13700 - DNA, 457 bp, Zea mays
  unsure at all n locations
  Clone ID: cC-zmpo148049h09d1
gtgcgctcccaccggcccgggcgcccggagaagcaagcttttccgattctatccatcgngcgagcatatcgacggcgagggaggctagagcggccatgagctggnactgccgctcccttctggccgtggccatcgcgctgttcctgtccgtgtccctcggcgtgcgcgccgccggcgccggcgccggcgttgacatcaaggtgtcgtgtgcagcgacgccggacccggacgtgtgcctgcgcgcgctccaggcggacagcgactccaagaccccgcgggacctggcggaggcggcgctccgcgcggtgacgaccgcgggcggcgcggcgggcgactacgcgcggcacgagatggacgtggtgaaggacaacgacatgtggcagtgtctgaacgagtgcgccggggtgatcgaggaggcgctggaccacttggacgacactccaggcggcctttacga

SEQ ID NO: 13701 - DNA, 560 bp, Zea mays
  Clone ID: cC-zmpo148059a07d1
gacaagagtatgtgttcattgcaaactcggataacttgggtgttattgtttttatgaagatactgaaccattggatccacgggcagaatgaatattgcatggacgtcaccccaaaaactttggctgatgtaaaaggtggcacactgatctcctacgaaggaagggttcagcttctggagattgcacaagtgcctgatgcacatgtgaatgagttcaaatcaattgagaaattcaagatattcaacaccaacaatctgtgggtgaacttgaaggccatcaaacgccttgttgaagctgatgcactcaagatggagatcattccgaatcctaaggaagtcgatggtgtgaaagttcttcaacttgaaacagcagctggtgcagcaattaggttctttgaccatgccattggtatcaacgttccaaggtcccgctttctaccagttaaagcgacatcagatttgcagctagtacagtctgatctatataccttggttgatggctttgttacacgtaattcaacccaaacaaattcatcaaatccttcaattgacctagtcctg

SEQ ID NO: 13702 - DNA, 461 bp, Zea mays
  Clone ID: cC-zmpo148059a08d1
cgcccaaacgcacagcgatgcaccagcacgagataccagccactttgcgcttttccctcctcctcgtcatcgggggcgccctgtcggcgcgcgccgcggcgcacctgccgccggcgggcggcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgtccacccagttccaagaagtcggagcacgacgcggagatcaaccactccctccccggggacgccttcgacgccgtggtgcgcgccaagctggccctggagctggagttgccccgggtggtgtcctgcgccgacatccttgcactggcgtcgggcgtgctgatcaccatgac

SEQ ID NO: 13703 - DNA, 504 bp, Zea mays
  unsure at all n locations
  Clone ID: cC-zmpo148059a09d1
cgccccgcgtnccccacgcgtccgcgctggggaaagctatttgcggtttttgcggncgccggngcggcgcgatcagggcctccgccgtcgccgtgtaccccctccatactgtcaagacactcctccagctaggagcgacggtgcagaagcagaagatggggctccggcaggtggtggaccggctcatggccgcttccggccctgcaggtttttacaatggcattggatggtccatattgggtaaacttcctggattgggagcacgttttgggacctatgaacttttaacagccttctataaagatggaagggaggacaactatgtctattattctgaggctatgaaggctggcataactgctggtgctgtataggctgttttctgcacaccatttgaacttttcaaacttcgaaaccaagttagtttctgtgattccttcaaaagctatgggccctgcaaaagttgctcaagaatcattttcactgcttttcaaactgttgcct

SEQ ID NO: 13704 - DNA, 418 bp, Zea mays
  Clone ID: cC-zmpo148059a10d1
gcgaacgcccagacaggcgtccgggcaccatgtctttcaccggcacttttgacatttcacggcgtgcgacaagaccagccacttgatcgacctcctcacggacgaccgcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttttggtacccatgataagtgcgcagcatgccagaaaacaatgtacccgctggagaaatttacttctgaaagcgagttctaccacaagaactgc

SEQ ID NO: 13705 - DNA, 495 bp, Zea mays
  Clone ID: cC-zmpo148059a11d1
caccaggggaggaagcagttcctgcaggaggaggaggtgctcagttttatccgccaccccaacatggggctcctgggcggcgcatgcccggagtaccgctgtctcgcgtacgagtacatggaccacggcagccttgaggaccggctgttccgtcggggcggcacgccgccgctcgcgtgggcccagcggtttcggatcgcggcggacatcgcgacggcgctgctgttcctgcaccaaacgaagccggagccgctggtgcaccgggacctgaagccggccaacatcctgctggaccgcaactacgtgagcaagatcagcgacgtctggctggcacgcctggtgccgccgtccgtggcggacaaccgtgacgcagtaccggctgacggcgacggcgggcaccttctgctacatcgacccggagtaccagcagacgggcaagctgggcgtcaagtcggacatttactccctcggtgtgcctctgcttgcaagtggtca

SEQ ID NO: 13706 - DNA, 585 bp, Zea mays
  Clone ID: cC-zmpo148059a12d1
gcgacgcgggcacgctgggctacatggcgccggaggtgctgcagggtaagccgttttaccacaagtgcgacgtgtacggcttcggcatcctgctctgggagacctactgctgcgccatggcctaccccaactacagcctcgccgacatctcctaccacgtcgtcaagctgggcatccggccggacatcccgaggtgctgcccgcgggcgctggtggagatcatgacgcggtgttgggacggcaacccggacaaccggccggagatgtcggaggtggtggcgctgctggagaagatcgacaccagcagcggcaagggcggcatgacgcccgtcgacgacgtcgcgcaggggtgctcctgcttcggcttcaaccaccgcagcgtcgcctaggctagctcccgtcagctgacaccgcagttattaagttattattaataataattaagctacatacacacgtactacctaagtttggccggccatgcccatgccctctcatctcgtcggtccgccggcgagcatcgatcgatctttttctttgcatgctgtcggtcgtccccatcattgtgcggatgtgtttaaagcg

SEQ ID NO: 13707 - DNA, 576 bp, Zea mays
  unsure at all n locations
  Clone ID: cC-zmpo148059c07d1
agagagagagagacgcangcccgccggcgacgatcgtttttggattttctccagagacccggcggcggggacgagggctccgctcagctcatcggcggcgacctgcctgtgcctcgctctcgccgcggccacgctggcgctggcccacggggcgcaaggaggaggaccatcggcatcggcggcggacctggacaaggtcacggccgagaccttcctcgacatcgacatcgacggcaagcctgcaggccggatcgtgctgggactgtttggggacaccgttcctaaaacagcagagaacttccgagcactttgcacaggggagaaaggaatggccaagtccggcaagcctctatggtacaaggggtcgacgttccacaggatcatcccggggttcatgatccagggaggcgacttcaccaacggcaacggcacggcgggcgagtccatctacggcagcaccatcttctcctacgagaactttcagcacacccacgctaaagccggtacgctggccatggctaactacgggccccactccaatggcttccacgtcttcatcaccaccgtagacgaaaa

SEQ ID NO: 13708 - DNA, 503 bp, Zea mays
  unsure at all n locations
  Clone ID: cC-zmpo148059c08d1
acgccgccgncgcanaatcgcacgtacgcgcgatcgagaagcctttaccagttttacgatggcccggccgcgcgggctcctgaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaacggcaaaggccggacctccatcttccacgagtccgcctcttccgacaacgccgagtccgccgcgttcaccgtgaactcggacaacgtcatcggcttcggcggcagcttcaggaacagcgcccgcg

SEQ ID NO: 13709 - DNA, 533 bp, Zea mays
  unsure at all n locations
  Clone ID: cC-zmpo148059c09d1
cttgttcatggcgaagggcatggggcctggngctgttttaagcttttttggctcctcgagggcgctggccaccgggtcacgtgcgttgacctggccccaggcggcgtccatcctaccgaccccaacaccatccggtccttcaagcagtacgacaagccgctcatagacctcatctccaacttgccagacggagagaaggtgattctgatcggacatggcgctggagggctgagtgtgatccatgcaatgcatgaatttgttgacaggatcggtcaagcatttttcgtggccgccacaatgctgccgtttggatttcaagccgatgaagataagaacgatgggttaccgactttgcccgagaacgagattgagttgacacttggtgcaggagcagatgatcctccaacaaccattgccttgaggccagaattccagcgtgatcgactatcacaacaaagccctgaagaggaatcagtacttgcttcaatgctgatgcgtccgtggcctgcatcagctatcagtacagcaagctt

SEQ ID NO: 13710 - DNA, 461 bp, Zea mays
  Clone ID: cC-zmpo148059c10d1
gcgaccgcgctgcagagaaggagaccgccgccgccgccgccgtctcgttggaggatttggtggagtcgcccaagaaaggagcgggggtgtcgccggtgccggagactatcgtcatcgccaccgccgcaacctctaaggaggaggaggaggaggaggtggagtcgcccaagaaagaagcggctctgtcgccggcgccggagcctatcgccgccgtcgccgccgtaacctcgaaggaggaggaggaggtggtggaatcgcccaagcaagaagcggctctgtcgccggcgccggcgccggaggccatcgttgccgtagcagcagtggaagacgtggtggcggacaagttcgtgacggttgtgaaggatgcgatcaagaagcatgatgcggatgaggacgagaaggaggaggcaatgtcgacgtttcagggcagccgcgtgaggactgccttggatgcgcgagcg

SEQ ID NO: 13711 - DNA, 396 bp, Zea mays
  Clone ID: cC-zmpo148059c11d1
ccctgaaattaccgcgatggctcccaaggccctagtttaccttgttttcctcgccgaggcctcaccggctgctcggtccgccttcaatgtgatagacacgctgcccgacaagcccacgtactccacgttcctgaagctcctgcaggacaccaaggtcgcgggcgaggcgaatcagctccggtcggcgacgctactggtcgttcccgacaaacttgccaagcctctggcgtcgctgcccgccgataaggtgcggtcggcggtggagaaccacatccttctcagttacttctaccccatcaagctggaccagatgaagacactcaccgtcattctccccacgctgctttccgttacccacaagaaactcttcgtcctcaactacaccatggccgacta

SEQ ID NO: 13712 - DNA, 181 bp, Zea mays
  Clone ID: cC-zmpo148059c12d1
cctcagggccgcttccacatgtggcgccgccacaccgtggaggggatggggcaaagtgcctcgcgcacagggcccagaggatcgaccctagacccatacacgacgcagactgggcactggaaaattgcatacactttacacagtcggggtccgagaacaccctctctactgagcccctacc

SEQ ID NO: 13713 - DNA, 281 bp, Zea mays
  unsure at all n locations
  Clone ID: cC-zmpo148059e07d1
cggccaagcgtccaggcgaggctagaccctccccttgcagctttgggagcaccggcaaccgcccgggcgaggcgcgaccggnacaggcacgcgcacaaccccgcccaccaaccgggaagccagagcggaagcgagaaggcagccgcggaagaggcggccaccnccgcggccnccnagccgacggacgcaggggccgacgcaggcacagggaaggaccccgagaaagcccccgcgcgaacgcccacgcaggaggccaccccgggagcggacaccaccagcga

SEQ ID NO: 13714 - DNA, 479 bp, Zea mays
  unsure at all n locations
  Clone ID: cC-zmpo148059e08d1
gtccgaaaggcagagatgagcaacagatttatggccttttactgtgtattcggnaacaaagatgctacggggggaaagtctcattacaggatttggagacatgaatcccgcagagaaatctgtgatgctccaaaagggatcgggctgttgcagccgcgtcgcagactgcctctgctgcatgtgctgcatcaaggcgtgcaacaggatgaacgaccagtgcgccgttctgatggcacacatctgcgcggctctagcgtgcctcggctgctacgagtgttgtgcagaggtgtgctgtggagggtcggagtcgtagtatgaagcgttttgtatatttgtatggaagagtggagaaatggagtgtacataatagagttcgcggaagcccggttctggcccggctcttggttggatccgtccaaacgttctataatttgctcgttacatgcaatgcaaaaaaaggatggctcacttgtagtttc

SEQ ID NO: 13715 - DNA, 455 bp, Zea mays
  Clone ID: cC-zmpo148059e09d1
cgtccgctctgtcttttctctctttaccgctgagtattttatcacgtttttagcactgctcgcgagaccggggaagagggtaaaaatcgctcgttgttttggaaatgaccttgtcgttggagaaagatgaacagtggaggtctcgacatcaagaacaacacgaatgtacgatacctatttttttatcgcattcgttaccactgctttatcttcttcgtgtcgtcgacgacacagtgccaccagggccacagggctgcgcgctcacgcgcctgggcctctgcgctcgcgccggccgcgccggccaggctgtggccacgttgccagggccgcatggctgcgcgctcacgcgcctgtgccactgcgctcgcgtcggccgcgcccgcatgccgtcgcaaaacgtcgcttggaggctggtcgcgccctggccgcccacgcgcttcatgaggccgctcgag

SEQ ID NO: 13716 - DNA, 432 bp, Zea mays
  unsure at all n locations
  Clone ID: cC-zmpo148059g07d1
ggaaaacagccgagcgagctcctctccctctccttttccgtttttttctccagcgcagcgaagggaacatgtgtgaccggtcaaagatgacncggcaggcgtccgtggactagcacctgatgtgcgagatcgagggccaccatctcgcggcggcggtcatcgtcggccacgactgtgccgcctgggcgcagagcacggcgttccccgagttcaagaccgaggacatggccaacatcatgaaggacttcgacgagccagggcaccttgcgccgacaggcctgttccttggacctaccaagtacatggtcattcaaggcgagcctggtgccgtcatccgtggcaagaagggatcatgaggcattaccgtgaagaagacagggcaggcacttctggttggcatctacgacgagccgatgactcctgggcagtgca

SEQ ID NO: 13717 - DNA, 591 bp, Zea mays
  unsure at all n locations
  Clone ID: cC-zmpo148059g09d1
gggaaaaccccgcgtncgcccacgcgtncggttctacagcccccaccacattttgttctatatgcgccggccgccactactaggagagctgctacattcagggcaacatcgacttcatctcctgcagcggccagtccatcttccagtgccccgagatcttcgtgaggcctgaccggcggacggagatccgcggctccatcaccgcgcaggtgcggcaggaggaggacagcagcggcttcgtcttcctcaagggcaaggtgtacggcgtcggggaggtgtacctgggccgcgtcaccgcgccggactcgcgcgtcatcttcgccgacacctacctctccaagaccatccacccggccggctggacaaccataggctacagcggcagcaccgacaaggtgacgctcgcggagttcaactgcactgggccgggcgctgacgtgacgaaccgcgtgccatggtcgcggaggttctctcccgacgacgcggccaagtaccttaccattgactttattcacggcaaggactggcttgccgccttctactactgatccgacgatcgactgttgaatcgatcaagcatccatgcatgca

SEQ ID NO: 13718 - DNA, 498 bp, Zea mays
  unsure at all n locations
  Clone ID: cC-zmpo148059g11d1
gggcggcctgaaatgtggcggnaatgcttatgttattggagttccagcaagacccggacagaaggggcacatgattctactccactgagtacccacagcaacccatggttaaccttgagatgtgcatgactggtctggacaagaagaaagcttctgtcttttttaagactaatgctgatgggaacacagcatgtgccaaggaaatgacaaagctctctggcatctctgaaatcatccccgagatggacatctgctattttgactttgaaccctgtggctacttcatgaatgccatccatggctctgcattctccacaatccatgtgacgcccgaggacggcttcagctatgccagttatgaagttatgggcttggatgccactgctctgtcttatggtgaccttgtcaaaagggtccttcggtgctttggcccctctgtgtttttccgtttgccgtgaccattttttgcggtcgtggtcattcccggacatggggaaa

SEQ ID NO: 13719 - DNA, 352 bp, Zea mays
  unsure at all n locations
  Clone ID: cC-zmpo148061a01a1
cttcccccattatgatgnttttttaacacgcacaccaacngagatctattgaactcctgcaccgtatcncaccccattacccaaagaatgaatatgcatgcatgattcatgttatcatctgcatggctgcttgcgggcatgcagtttgaataataggagggaaagtgtgctacttaaaagttcttggacgcctggtacttgacgccgaacttccagtcatcatggataacgttccatgaggtagtcttgcggtggtctctgttcataacccggaacttcattgacttccattgtatgttctccccggtcttccacactttcccccaattgcacttcatctacgtccacttaa

SEQ ID NO: 13720 - DNA, 444 bp, Zea mays
  unsure at all n locations
  Clone ID: cC-zmpo148061a02a1
cccccccncttttaatgcttttataaaagnaaacataaccccgattacatgtattgttttttaaaccccattccattgatctgagagggcatttcaagattacatcaatagatatatccgtgcgttctcatttggctcacccccacccaacgtcccttctcccttccctaggcttccttcgtctttgttctttttgatgattttatttcgccgagcatcacaggaatggattagttagactggatggtcagaacacgaggtgaaaacggcgccttcttcttttttatcgctcggtggcctatgatggctgcagcggcagccccaccaccttgccgcaactgagggccttgtcggtcatgttgtactcgtcgcgcattgaccgcgccggctaaatgacccttatgtaaaactgcttctccaggtagtaccgctcccaacctttga

SEQ ID NO: 13721 - DNA, 514 bp, Zea mays
  Clone ID: cC-zmpo148061a04a1
atcttcgttaaaaattataggagtacaggtcatagcacattctgtaggtgtcggatacagtaacacagcagcagaacatcaaacccatctcctgccaggctctgagcaaacgccaaagcctccaacgtggcacctacgtaccgtaccccagtcacccaccccacaccctacctcgctcgcagtcgcagcttccgctgtacgcacactactgcgcggtgcacgcaccgacgacacggcggcgcagcttatgtatgagtaagtatagggactcgccatacaggtagtcatcgcagcgtgccaccccgtctagcgatcgaacacagtcgacggggaacgccggccggtccggtcagttggtgagcgcgacggcggcctcctgcacgaggggctgggtggcgtgcgctacgccctcggccttccgctccacctgcttccggaacgcctcccgcgcgcccggtttcgttatgcgcttggagaaacgcggcaaaacggcgcccgttgtcgggctggaaca

SEQ ID NO: 13722 - DNA, 294 bp, Zea mays
  unsure at all n locations
  Clone ID: cC-zmpo148061a06a1
aacgcccaacctaaggcaaaggggggcacattnagccacgaaccaaacagccccgaaanaggacaaacaaacactcccgcaggggcgtgcgtcaaacatgaactcgttccttttttcctgctcccagatccattccattcgtccatctagcctcaaatgggccacatcatgcgacggctactgggctcggggacggcttgtgggtctgctccttggaatctgccaaaacctcgtccttgtaaaccaacgtgaggaatagggaccaccatgggccatcgcgcaatctccttcccc

SEQ ID NO: 13723 - DNA, 295 bp, Zea mays
  unsure at all n locations
  Clone ID: cC-zmpo148061a09a1
tccttagagcggnccccttnnnnncncccatatattatttttttcaaccaccacccaacaggcanattgtgagtttattacgggctaaaccccttaacaaaaaaaaaaaaatgtgttaaaattaaaaaaaatccacaatttaaaatctttccaaacacccaaaaacattctatatatccttttaatttttcaaaaaaaaaattgaaaaacaaggaaaaaagaatttcaattaaataccaaacaattaaaaaaaaatttaggtcgcatgctaaatacatgattaataaaataaatt

SEQ ID NO: 13724 - DNA, 327 bp, Zea mays
  unsure at all n locations
  Clone ID: cC-zmpo148061a10a1
cccccccccccttttttccttttttccaccaacacacccccacagaccaaaagccggcgatttcaaacatgntccccaaaacccccaacccatcaaggtttgacggaacccttttattacaaaattccaccctaccttaacaatctttccctcagggatggggcttttcgtcttatttataataagaagaacccccattccccctactactcctctttttaatccacaacctaattaatatcctccacctcaaattttatatattaaaaccttgcccttctttcatgctttttttttctatggaccccgctctttttttaaaaacca

SEQ ID NO: 13725 - DNA, 386 bp, Zea mays
  unsure at all n locations
  Clone ID: cC-zmpo148061a11a1
tctcctttttaatataaagcttgtgaaaaaaaaannatacaacataccacgatagtacattacacgcatacatacatacatacatattcatgaattatgaaatagaatggattataccataccaaacattttttcactgaacatacaaacccttcctacgaccactagaggggagggggaatattcagtgcaaaaacacactcacacacacacaggacaggtcggatacaaatgaaaacgtaccggaacgtgcaccgttcgttgttcgaacacaagactcggtcactctgaccatctaagctgatgcgagcgttcatgctcatttccaatagtgaaacaatctttcgaacgaactgtcgacctgtcatcctatttaacaatcccta

SEQ ID NO: 13726 - DNA, 380 bp, Zea mays
  unsure at all n locations
  Clone ID: cC-zmpo148061a12a1
gtcttntatttatcaaacatcggaatctgatggtgtgaagtcacttcacaccacactatcatcctatcacccttcgccggttttgacgcggtgacgcctacacgtacacctaatctcgggctgtcaagtatccgaggcgtgcaaggcgggcccgggggcgtcgtgctgcggctggtgcatggcgaacgagcttgaccgctacacgggccgggagtagctggatcggcggaagctggcggcggctatgtcgtcgtcgttggggtcggtgcacttcgccttccgctcccccgggatcctgcacttttctccgaggatgatgcccttctttcacagcgtgtccctccgactccaccttgtgatggtgggggtccttgttctcc

SEQ ID NO: 13727 - DNA, 166 bp, Zea mays
  Clone ID: cC-zmpo148061b01a1
aaaacccccaatttttaaaatttttcagacaaaccaacaaagaagcaaagtgcattgttcaattcagtgcaaccccctgcaccttagcactaacggatcaaccaacattagtatactgaacagcacgatgtggttcattaaaatgctgtcggacttgtgcaggtgc

SEQ ID NO: 13728 - DNA, 328 bp, Zea mays
  unsure at all n locations
  Clone ID: cC-zmpo148061b02a1
atacccccctttattttcctttttttaccanaaaaccccaagagacatccagtaaatatatgacatcaaaacccatactacctatagatgaaaatgtacataaggtcaataaatacggcggaaaaaaactacccccacccacaatcaccttgttttggggtaacaaaatcaaccccttttgtacacaatttaaaaggagcccttaacttaaaatgtaacacaagttaaggcacaaaaaaaagttcaaaaaggaaaagcaggcaaaactttttctttccacacaccatcattaaaaacttgataaatgacttctttactctcccctaaa

SEQ ID NO: 13729 - DNA, 435 bp, Zea mays
  unsure at all n locations
  Clone ID: cC-zmpo148061b05a1
tctccccccctttttgaccatttatgaacaggacacaanatcagggatgncatggagacacaaggcaagcctaccgagacccacaacagctgttgtgcccccgcacataattttccaacatgaaacccatatacaaatttaaacacgaatactttattcaagcatactatataccgcatatttggaatttagactaatccacgagtcaccactgacaaatggcaacatcttaagttttccaggtaggtcgctgcatttatggtggatggatggaatattatgtcccatggtctaaacataacctaatgtccagtaccaacaattgaaagaaggaatgtccgattgtttcctgatgtttcggattggattagccttatctaatggcttcttatacttcttgaaaaactttgccttgatatattgcatatcaatttc

SEQ ID NO: 13730 - DNA, 330 bp, Zea mays
  unsure at all n locations
  Clone ID: cC-zmpo148061b06a1
cttcccctcnttctattaatcttttcgnnncagcaatataacgcgtgacccgataaagttacaagagcaaaccacctgacccaatcaaatcaacacttgcgttattgttccctcccgaccagactagcaattaccgtacagccaactacgtgcccaccctcgactacacggtccctggtgaactcagtataacatcatggtagcgacagcagcgtcgacaccagcgatggcagctccgcttccaagggtatcagcaccggaggcattagcagccgccggtcccttaacaggcccatcagcggcaggggacgccacctcggcggtggatgc

SEQ ID NO: 13731 - DNA, 534 bp, Zea mays
  unsure at all n locations
  Clone ID: cC-zmpo148061b07a1
accacacacaaatatattaatttttttcacaaaaacaacacancaagacaaattgaaaaattttaacaatattaacccacataccaaaaaataaaattaaaattaaaatttattattatataataataaaaatttattattataatttaaaataaattttttaaaaaatatataaaaaaatttttttactataaaaataataaattctatttataattttaataaaaataaaaattttaataataataatttaaaaatatttatttatctattaaataaattaatatttattttaatttaattaaattatatattaatttttttaatttataaaaaatatattctctactttattaaaaaaaaataattaattaaaaatatttaaataaaaattatatttattattttataactcaaatatatatttttttttttttaaaaataaaaaaatattataaaatttattttttattttataatctattttttttaataaaaattattattaaaattatttaaaatttttttattaat

SEQ ID NO: 13732 - DNA, 428 bp, Zea mays
  unsure at all n locations
  Clone ID: cC-zmpo148061b09a1
gatacnccttatataacggatcattgcgcaacacaaacttgaatgcactccgccccacacacttttcaactttaacacttggataatgtaaataatatactacgagagctctccaatcatccaaaattgaaaaggcgaccccgaaagtgaaggagcacctggcatataaacactagctgaggaatctgagtattcattttgtctaacggtcgattgacaaacatatatcctcttatattctaacgtttttttttctgcgtgcgtatgtgtgtacaacaaatgagtacatgtgcaatttcatcacaagtgaaaattgatacagggtgttcctgtatcgcttagtatggatcgactccgatttacaaatgaaaaccgcatactttcatcaaattagcggcactcgctgtggcatcttttgatatatgttt

SEQ ID NO: 13733 - DNA, 388 bp, Zea mays
  unsure at all n locations
  Clone ID: cC-zmpo148061b10a1
ctattggatttatcgagcccgcncgnctccaggtgctgtgttcatactgcatgcaagcacacccttctactctcactgaacaagcacacacagcccacggaaaccgcaacggcttacgtacggcagctgaacgtgcatgccgccacgtcacgcaagctacacagccatgcaccacaagttatgctgacgcgcggcggcggcgtgctatcttgctcgggtgaccgccgccgccgtctacgcccgccgccgccggtacttctctcggctggacgacggctcctccacgtttgccgcgaagcgcaccttcttgttcttcttcgtgcggcgcctgccctggtccgcggctccgtcgccttcgccgagtatcatgaccctgaggtccgcctcc

SEQ ID NO: 13734 - DNA, 562 bp, Zea mays
  unsure at all n locations
  Clone ID: cC-zmpo148061b11a1
ccaccccccccaatttattacttttttttacccaaaccccccccncggggaagtgagggaaacattttaattttttctaattaccttattttttataaacaatgaattttatttttttttttaaactaataattaaacatttaaatatttttttttatgccttttttttgtatacattgtttaaaaaattaacacctttccaatatttattatttttttgtagtgttactttataaattatgttttccttttttattaggcttttttttaagttttgtacacaaaatttttctattttttttttttttccaaaatccttattttttttttgttcactcctttatctaatcacctttttttttatttccattttttatttttttttttgaaactcaaattatttttttactacaaaaatatttttttgtttattaaacacctccttattcttttttttaccatggtatttttttatcgtatctttttgtcttctattttttttttttttaatcattttaaattttgcctatttatattattactttttttttttaaaattttt

SEQ ID NO: 13735 - DNA, 342 bp, Zea mays
  unsure at all n locations
  Clone ID: cC-zmpo148061b12a1
ccccccccccctttcttcctttttttcnaaaaaggaaacaccgggatttgcggcggatttaaaaaagaaattccctaccctcaaattcatggtgttacaccgtctaataaaaaataacttgatgatgtccttccttttactgttgagccttaccaatggattgcatttaatgggcaatgcaaggactaaagaaaaattataactagagagatgggttaatcgacggagggtttaaaaacatgcaagcttcttgaggcaacctttggtgctgcccttggcgttcttgcatataaccatggtcttgttgttggtgccactatactttactttgacatcattcat

SEQ ID NO: 13736 - DNA, 444 bp, Zea mays
  unsure at all n locations
  Clone ID: cC-zmpo148061c04a1
agncaaaacatattcattagtcgcaagttaatgactacgtggcgcattcctatcgcctgaccaattgccacaccaagggtcacaaggagcaccatcgcataaggtccagacggatggcatcaaaatgtggctgatcagattttttctctctccttagaggcacgaaccacacaacagggagtgggtctatctttctctctcttcttcaatcttgggaaaaaaacagagaacggcatggggagaaggagaggggatcggccatagggctttaccggcggagggcaggatcatcttgccgcggagccactggctgtttcactggggctgcttgccaccactccgagcgccattgttgtttgcccagaacagagggaaaaggagtcgatcctgctaagaatgatcagagatggagagtggcattgaccaggacttgtacaccacaca

SEQ ID NO: 13737 - DNA, 362 bp, Zea mays
  Clone ID: cC-zmpo148061c06a1
aaacgctccccatgccctgcgttttattgaaagtatttttgtttctcgtccccatgacacccatcaaatcaaattaatgaagcacccatcaacaattagcaagaccgatgaactagcaaggcttcttgcagaatcacttgcgcgtggccactacctgcttgcactcgccaccgggaaagctctccttcatgcacacatcggcgcatctgtcgctgttgaagcaaaagccctcgaactggaaactcggcgataagcattgactctcttccttctccgtgcttttgtgctccttcttctccgactcctgctgtttcgctttctccattattaaggcatgcatgggcatggtttctcccattttg

SEQ ID NO: 13738 - DNA, 449 bp, Zea mays
  Clone ID: cC-zmpo148061c07a1
aaacgctctacatgccctagattttatgaaaagtttttttgtttctcccccccattacacccatcaaatcaaattaatgaagcacccatcaacaattagcaagaccgatgaactagcatggcttcttgcaaaagcacttgcgcatggccacgtcccgcttgcactcgccaccgggaaagctttccttcatgcacacctcggcgcatctgtcgctgttgaagcaaaagccctcgaactggagactcggcgataagcattgactcttttccttctccgtgcttttctcctcctttttctccgtctcctgctgcttcgctttctccattatcaaggcatgcatgggcatggctactcccattttggcattgatggttcccacctctgctgttactaggaggagaaacaagaataggacagcttcctgaaacactgccatccttctttcgttt

SEQ ID NO: 13739 - DNA, 434 bp, Zea mays
  Clone ID: cC-zmpo148061c09a1
ttcctttttttttgcataatttttatgcatcccattaaaatgaggccattgatgataaatttaggattaccccccagatacatggacaacacaacattcatggatccttttataaaaaatgaaggcctatcaaatatttcattaggcacttattatataacttgtcaatccatttcttaactcttctcttttaaacaacagcgaagtctcactctagctatatatggagatgaagaagatggagaaggaggatgacaccatcattgttggcgccagcatcactgtcgtaatagggtagtggtagcaaatagatatcacggtccaatgcatgcatgtgtaatgcattgcttgggatccaacccaatctattatatctagcataggtcgccttaaagtatttgtcagcactaaagttaattatttggcggtgtaag

SEQ ID NO: 13740 - DNA, 381 bp, Zea mays
  unsure at all n locations
  Clone ID: cC-zmpo148061c11a1
cttcctccccctttttaaatcttttgcaaaacactngcaccgncgcgtgatacatagaaacatgccaaattgccactactgcccgtacttgttctttctccgaaaaaagaatccccaaattaatccgttatactgagacttattggtagtataaatgaacaggtacaaaactcacatagcagccagtatacataccaacgcgaattaaaactggacagtatcgttttccactcttgtatgcagtgctcggtcgccttgcctcctactccgacacccaacaatctttattgccacctatccagcctcctccgatcccccacattgtgaaacaagctaatattcattcttcgttccgatccccgggctctcatgttaacagat

SEQ ID NO: 13741 - DNA, 438 bp, Zea mays
  Clone ID: cC-zmpo148061c12a1
caaaaaaaagcgattcatacgcggtgttgatcgaccaaattgcccagatacacgattacaaagcgattgtaatatactggctttgacagttcgccgcgtccacaaagtgtgacgcacaaatactcccaccacaaagatatacaatacaagcatacgagcagcaatctgcatgcctcactcaacaccaacagcacacaacccaggtagcacagcctgtggcttccccctgcccatggtgaaacccctggtgccatcaggcatgcgggggcctggttggaagcttgttggccccaataggcagttgcggatgcggctcaagcttggttatcaggttattcggtgtacttccaacaaaatgaagtcttgcacggttcccaccaaggtggttgttgccatggttattgtacttcggctggttgttttggtggtgctggttat

SEQ ID NO: 13742 - DNA, 330 bp, Zea mays
  Clone ID: cC-zmpo148061d01a1
atctcacatttttttatacccccctaaaattgagggtcagagggaggtattctgcaataaccccttacacctagtgccatatcgacagaatcaataattcatttgactttggagttgtcttcccttttgtagtttggggagagcgttattctatacgctggggtttggggaaagggtgcatttttatggcagccttgtaaccatccatccatcatttatttgcccatttgctttatctgcaaatagcaaggattcccgaaaaagtttctcggtctattaactcgtctttcactctaaaaattcgtcggcgtggtcctctgtaacttactt

SEQ ID NO: 13743 - DNA, 276 bp, Zea mays
  unsure at all n locations
  Clone ID: cC-zmpo148061d02a1
agagcggncgcggnggtgaccttggccgttgcgctatttctcccctaggagctcccctagcgacacgggagggtggacttcttgggaaccgcgggcccgccctggcatgtgcccgaggcgtcgactccggtcgacttgtcctgctttttgcggttctttcgggtgcccttcttgctcttctccttagtcttctccttaccctcgccgtcggtggcgttcatggatgagttgccggagccccgagagcggtgccgtctcgaccggcgggtggcggag

SEQ ID NO: 13744 - DNA, 386 bp, Zea mays
  unsure at all n locations
  Clone ID: cC-zmpo148061d03a1
nttttctttctttttaaaattttttaacgacacncacacaaggggctcaggatattattgatacatagtcaacaataaacctagtcaagaagaaacggatagcatgaattcaatggaaagaagggatccctcttttacaataaaagggatcgtattttgagaggcaccggtaacccaaacccgcttcattggtcaggctcaagctgacccatcgtcgtcggaatcagaattgtcgccggactatggttctgttgcgctggaggttccattaaaagatgggcctggtgcggtggatgactcatacgactaccatggcgctggtgccctataaggaccgtatgatgcccccgtcgcctgaacattaacagcccatctcgcttgcttcc

SEQ ID NO: 13745 - DNA, 392 bp, Zea mays
  unsure at all n locations
  Clone ID: cC-zmpo148061d04a1
gttgcnngatgnggcacaggagaaacgcataccataccatacaaaaaacccgcccccaatcatgggtaagtacatagtcaggactcagggaaagacctaattcctgcacggtgacatggccagcgaagttgtatcaccacttattagaaggcatacagcaatgcgcagatgagaagcagtaagctcgctgcattctttgagtttgtggagcttgaggctccatttgctgaaggggcatctgcagctgtgtcggcttcttcctccgcttccgctgctggttcgtcgggaggcgtctgtgcatgtgccgcaaggacgcctgtgcactggctgagcggcggcgcctttaccttgcagacgccggggagctccagtgccctggtctggttgatggc

SEQ ID NO: 13746 - DNA, 453 bp, Zea mays
  unsure at all n locations
  Clone ID: cC-zmpo148061d06a1
gatcgaattataaagacaanaaccatcaaggatatgtgttacaacacagcttgctgatctctgtaaataacaacattgttttttttatgaaaaaaataaagggtgtaattgggagtgtcttgacatatgcacaatgcacctgaacctgagtcaattgaccgcccctgatacatttccttgccaaaatgtggcgacctatacacaaaacatggaaaactgggtacacttctcgcgttctctgtcttagtcgactttgcaggcattatacacatcactcaatcaacatcttgttgttctttgacggctgcattatcaagtggaccattgttactaccaatcttcattgactcgtccttgaacatcttgcggctgaaggttttgtacaccgttctcgagtcctgccgtgacttatttcttcaatcccactccacttttattatcagctcaaacttc

SEQ ID NO: 13747 - DNA, 334 bp, Zea mays
  Clone ID: cC-zmpo148061d07a1
tttttaaaaaaaaacacaagccaagcggaattgtaaattaaggacacaacatccccagtacccccaattataacattgtttttttataataaataacttcgaggaggaaaataatggtagacattgaaaaaggttattttgttatatggtgtgaccaatcaaaagtgtttttcccaacctatgcctctatgccaactgtaaaaaatttaagtgttgtattcttgtttgatcacacactgatcattaggtatcattagccaattattatattatttggcacacgcatgtacggaacagttattcaattttgattaatcttctttttatttctagg

SEQ ID NO: 13748 - DNA, 435 bp, Zea mays
  Clone ID: cC-zmpo148061d08a1
ccccccccccccattaatacctttataaaaaaaaaaaacacaaaagagcaaaagaaagcctaaaataagataaaacccccaaaccccacaaaataaaaaaaaaaaaaaaaaaaaaaaaccaaacaacaaaaaaaaaaaaaaacacacaaaacaaatagcaaaaaacaaaaaacaaaaaaaaaacaaaaaaaaacaaaaaaaaaataacaacaaaaaaaaaaaaaaaaaaaaacaaccaaaaataaaaacaaaaaaaaaacaaaaaaaccaaaaaaaaaaaaaaaacaaaaaccaaaaagaccaccaaaaaaaaaaaaaactaaactaaaaaaaaaaaacaaaaaaaaaaaaaaaagaaaatagaatcaaacaaaaataaaaacaaaaacactaaacaacaaatccaaccataaaaaaaaagaaaatcaacacaac

SEQ ID NO: 13749 - DNA, 432 bp, Zea mays
  Clone ID: cC-zmpo148061d09a1
tttttcttttctgcggattttgaggaaaacgattattcgcggactgactccgtctatggccggagcctcaaaccccacaaaacatctttgtcctcccctccctgctttccctcccggcttggtcacaatacaatctcatctacgccggagctgcactgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggcttccgttccgtcccgtcccgtcccggccggtcagctccgcagcgcgacggcggtctcgtgcaccagcgacccggtggcctgcgcgacgccgtgcgcctcccgctccggggtctcccggtacgacccggcgccg

SEQ ID NO: 13750 - DNA, 458 bp, Zea mays
  unsure at all n locations
  Clone ID: cC-zmpo148061d11a1
agagcggncgcgcctcaggcactggcttgtgggccgtttctggcacaccccggctcgtaagagacgtgaacgaccccgtccgcgagtccccggcggccctggagtgggcgctctcccacgccattgtcgagggcgacgacatcctgctccttcacgtcaacatgccgtacccgcacaacggggccgcgggcagatccgggccctcacgctcctcgtctggcgggagcaccggttccccgatcgccgcgctcctaggcggaggtggaggcggtggctcgggcgccggcgcggatccgacggacttcatggaggatatgtgcgcctcgtgcaatgtgcggtacccccgcgcgcggttgaacgcggagcgccgtgagccccctaccgagggccgggaagcccaagtgcataccattcttgtcgagttccagcgacgcggcgttgacctcctcgcataagcc

SEQ ID NO: 13751 - DNA, 385 bp, Zea mays
  unsure at all n locations
  Clone ID: cC-zmpo148061d12a1
ctcggtaatatttcttccccgaaggcaagtgtcttttcatcccaaagcaaaccaacaccaaaaaatgtttcacagtgctgatcatcgngcttctattggtgaaaggaacaggattttcatgcccaacaatttctgctacaagaagaaaactggcaaaagatcatcacaaagagccctacagcctgatgctcagtcgagcaaggtcctagctctttgagaaagggaaaaagaaagagaggatggattgtaattgcatctccgaagaggcttcacttaaataacaatcgactaatagggggagaccatatggataaagtgctggagacggtctaagaggatggcttcaattatgatggctgaaccactgaaggagccatgttctcct

SEQ ID NO: 13752 - DNA, 548 bp, Zea mays
  unsure at all n locations
  Clone ID: cC-zmpo148061e01a1
aacaaaaaaacccaaaaacccaaaaaaacaagaaaaaaaaacacaccccaaagaaacaaaaaaaaaacgccgcacgaaaaaaaacacaaaaaaaaaaaaaaaaaacaaccaaaaaaaaaaaaaaaaaccagaaaaccaacaaaaaaaacaaacacaaaaagaaccacaacaaaccaaaaaaaaaacaaaaaccaaaaaaaaactaaaaaaaacaaaaaaaataaaaaatcaagaaaaaaaaaaaaacaaaaaanacaaacaaaaaaaaaaagagaaaacacgaaccaagataccaaaaaaaaacaaaaaacaaaaacaaacacatatatccaaaatacaccaaacaaaataaaaaaaaaaaacaaacaataaaacaaaaaacacagcgaaaaaacacaaaaaaaacaacacacaaaaaaagaatgcaaaaaaaacaccacataataaaaacaacaaaaaaaaactaaaacaaacaaaaaacccaaaacatcatcaccaagaaaataaataaaaaactcacacaacaaaaaaaaaaaaaatcaacaatc

SEQ ID NO: 13753 - DNA, 291 bp, Zea mays
  unsure at all n locations
  Clone ID: cC-zmpo148061e03a1
ttttaacaaacacaaaggccaccgcgcngtggtgaagaaacacaacacaanactcaaagacacacacgaacgagaancggaagaagacaaaccgagccgaacggaaagctcactacgaccgagcgaaaggggactctgaacacaaataatccaaagcaatagcacacatgttggctgacgcacattttttttacagaaacaatggcacaatggttcgttaagcattcatcgtggccgtggccgtggcatatgtcgggccttctgtcttcggagccaccatctgtgcgatgt

SEQ ID NO: 13754 - DNA, 480 bp, Zea mays
  Clone ID: cC-zmpo148061e04a1
ctaaagaaaaccaacaaatggagggtataaactttgaacagaaacatcattacacaccaaacaaaaaatatatatagtgccggtagaagacatctaacaggttgcaactgcgattctgtcctgagtttccatgatacatccggagctcctagtcagttcgcggttgacattcaaggtaggcctcaagccttgctcgcaatgttgctggacagccagtccaggccttcatacagaccctcgccagttgtggcacaagtgctctggatgtaccattgtcgctggcgcagggagtgtaatccaagcttgtcagtaatcttagcagcattcatggcattgggaacatcttgcttgttggcaaaaacaagcagcacagcatcacgtagcttatcctcgttaacattctgtggagctcatctttggcttcaacaacacggtcacggtcattgcttgccacaacaaataaaagaccctgggtgttct

SEQ ID NO: 13755 - DNA, 430 bp, Zea mays
  Clone ID: cC-zmpo148061e05a1
ctgtgagtaacccgggcatattactatggcggaaaagaagaggagtacatgcatattacgtatttcctgctgggagtaaaaggtgttgtaaaaccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggcggagacgggggcggggcttggagcaagtgacttggacacggtatccttggccaccttacccttacccaccaccactgctttcgacgggcttgcgcggaatcatgttggaatcctcatgggtt

SEQ ID NO: 13756 - DNA, 343 bp, Zea mays
  unsure at all n locations
  Clone ID: cC-zmpo148061e06a1
ggtagaaacaannccttctcagttgcagggttctcttctcggtcatcatgtcacatgtccacacactcgttacattacctatgctgttatacccttacgcacaaacgtacatgcgcttatctgatagcattcaattcaggtcgctagagcattgcatggtgcgatcgacttgtcactgcttctcctggcctccctcatcgcgattactctcatcgtcagtagagcgcgctgtgatcaccgcttagtatccttggaactgaggcggcggtggcgacccatactgctgcgccatgattggtggcaagatgaactcctcacgtgccggcggtggaggtgatgatgg

SEQ ID NO: 13757 - DNA, 352 bp, Zea mays
  unsure at all n locations
  Clone ID: cC-zmpo148061e09a1
tctcccctttttttccttttatcagcaccgaactncnctgtgggatccggtagaattattaattttttttcttgaacacacaagagagtggcgtatcattacattaaaaggaagagaaaaaagattacaaaatacaaaaaacaatcacaacacccacacttacaagcacaacccaaaccacacacaaagatgatctatgacaacaactcaaagatggtcatgatttgtaagcaagggtaaacccttcgctccagccatgttctaactccatagctctggaccaagttactactgaacgaatgcaatcatatatccattgcttgagagctcgatgatgtgccctttttcctcc

SEQ ID NO: 13758 - DNA, 417 bp, Zea mays
  unsure at all n locations
  Clone ID: cC-zmpo148061e10a1
gaaggngattttccatgttgtaccacggnggaggncctgtgccggagagcagagccccagcgaggagacctccccgcccctcccggcgccatgggctggcagcaccctggacccatccggctcacggtaggagagcgcgggcatggatgagaccttgaccatactcgggttgggccgcagcaggtgtttcgtcgccgatcagcatcgactgatccagcagcccgccgttgctggaggtgtcgaattggttcgaatgtagctccgcctgcgttctggcggttggtagtggcggcaggcgagaggagactatgtcgccgaaagccgccgcgctgccgtcctggtggaacgacggctgctgacctgccgcccaggtggtggaacacctgcatttggttcagaagcgggtagttctggttg

SEQ ID NO: 13759 - DNA, 409 bp, Zea mays
  unsure at all n locations
  Clone ID: cC-zmpo148061e11a1
ganaaaaggacacacaacccggcaacacagagagggtcnaacaaaccccatcacagcgcaccgagagggcancncaagacnacatcaagagatatanccgngccgcctcatttggctcacccccacccaacgtcccttctcccttccctaggcttccttcgactttgttctttttgatgattttatttcgccgagcagcacaggaatggattacttagactggatggtcagaacacgaggtgaaaacggcgccttcgtcctctttagcgcgcggtggcgtatgatggcttgagttgtaaccccacaaccttgccgcagcggagggccgttgttgggcatgttgtactcctcgcgcaacgaccgcgccggcaagatgacgcttatttataactgcttcccgaggtagtac

SEQ ID NO: 13760 - DNA, 354 bp, Zea mays
  unsure at all n locations
  Clone ID: cC-zmpo148061e12a1
gcacgcacgangcacggtgtgatctggagggatgcttgtgggcatatccaccttccccaaaaggaggaaaagtgtctacttataacttcttggatgcctgttacgtgacacctaactttcattcagcggtgagaacgtgccatgaggtggccttgcggtggtcgctggtcatcacccggaacgttagcgactcgcaggtgaggtcctccccggtctgacacacttgcccccaaatgcgctttatttacgtacacttgacacgcttgctccccttcaccgacaccgtcgtgatgtccccggcgccgcccacattggtgatcttcaccatgttgaagtacttgttcccggtgatgg

SEQ ID NO: 13761 - DNA, 381 bp, Zea mays
  unsure at all n locations
  Clone ID: cC-zmpo148061f02a1
gcggccgcacacgaaatttgaggtgtgataaaaanacaaaggccngaagaccaaacgagcagctgcagccaanggaacccgccctccccaagcccgcnaagcagcccgcacaaagacaacgacctgaggaacaaccattcnctcaaggacggcagcaaagggcataggaacatcagcttcagcgatcctctcaactggggcatcaaggtactcaaagctttcttctacaacaaacatgcatatctcggcaccaatcccatgttgagggaacccttcttcaacagtcaccaaatcgttggtttatctaacagatgcattaatagcagctctatcaagtggtctgatccaacgaaagtcgatcaccttaccacttattccttc

SEQ ID NO: 13762 - DNA, 497 bp, Zea mays
  unsure at all n locations
  Clone ID: cC-zmpo148061f04a1
ctcnggaacaaaggagctgcttgcattaggcatccttatataggcttaacaaaaccaatcagcatgtggctagaatttaaaataatctgatgaagcgctgcaacgttgggagccttgtgtcatccaaacaatctgatgagagcttatatatgggtctatgtcagcttcgtcaactaaaccactgcgcctaacattctgcttgttacaggtgcccagcgttgcccacctgccgttttccttgatttgccgccatataatccacgtggcaagttttcctgttgtctgcaacgcgcccgtatgatcgaccatgggccttgtcttcaggcaatcaggtctgtgcaattattaacacccaaatatgacgcgtgttggactatcggcctcgtgccatctttcgccttttcctctcctgctcgcgtctctctttttcctaatcaagcgaaattgctcttcgtccttctgcctaactaacctcgcacttcttttttttccctttc

SEQ ID NO: 13763 - DNA, 402 bp, Zea mays
  unsure at all n locations
  Clone ID: cC-zmpo148061f06a1
aaaccgaatcgnngaggtggnccagacaaatgtcaagcaanggnacacccgnccccccctcactcgagggaaagaacaaataacagggcaccaaattaaactggtgcatcagcgataccaattcgttaaatgaaaatcaagtagaaagaggaaggaaaaaaaacaaacaaaaggaagacgaaggtgtgccactgccaccgccgtgcccaatcagagcacgcccacgcatcgggaatgcgcgggagcagcagaacatcgcatcgcatccaagtctctccccccaccttggtctcttcccttcggctccggctcctcgtccggcggttcaatgaatgtagtacgcgaagaatgaggccacggcggcccctaccatgggctgttccaccgcggatgaaccttttg

SEQ ID NO: 13764 - DNA, 387 bp, Zea mays
  unsure at all n locations
  Clone ID: cC-zmpo148061f07a1
gtcaaaacaaacgacgnncaaggcatctgagattttatgggcaacaagtttcctgtgcctaatcactaagttcaaattcacactttgatggtactcaccagaaatttattctgctcagagcaagcgcattgctggcaaatgacacaagaaaccagtccctacccaccgcggcaaaatgtgaaatgacgttagccaggaacagccatccttacgccttcacttgaggaggagcatcgccttgaagagcaggatcagatttgacagcatctagtgccttgaagaactcctcaggaagagcaacaggccggtgctgaggaacatgcttaggaattggggtgtcgtcttcaatcacctcacattcgtagtcatcgggaaccggacgcctgg

SEQ ID NO: 13765 - DNA, 430 bp, Zea mays
  unsure at all n locations
  Clone ID: cC-zmpo148061f08a1
gagcggccgcccccccnttttttnactttttagaagcccccccccgaacncgcaaaaacgagagantaacacacgacaaacccanngcccccaagagaganananaaacccccnnacacccaacccacaaagcacaaaccctacgcacactcgnnaaccccgaaaagaataacaaaaggctggcgcaaaacaggggcaaaaaagccaaggcacgacccaactatccaccgaactgaaaaaaaatcctatatggacatgctacttgcaacatctatataacatctttgattgaagccaaatgaacaacttctcttacggagtatgaaccactgtgcccatagacagcttcagaaaaacccccaaaaagtattcatacttgccatctttgattgaacatcaccaaatttatactcaccacttatcaggacag

SEQ ID NO: 13766 - DNA, 360 bp, Zea mays
  unsure at all n locations
  Clone ID: cC-zmpo148061f09a1
aacacgaaacacacacgcgannccaagggaggttatcatatcaacccaacacaaccccgtgcactaagggacatgtagcataacttatttcttgggtggtgtggtgccataaaataaccatagaaaaaattaaatattatctctctggaacatggatcggatgagctttttcgaaatattattcctcataagaggctgatcaaatgctgagggtggtcttgtaggtggtgccggccttaaaattttcagggatgacgtcattggctatgcggtagccgacagacttgactgtaaaatggattcatagggggtacttgagcggggccttggttgttaagcgttcaagtaccggccggtccc

SEQ ID NO: 13767 - DNA, 403 bp, Zea mays
  Clone ID: cC-zmpo148061f11a1
accccggcatattactatgcggaaaaaaagaggagtacatgcatattacgtatttcctgctgggagtaaaaggtgttgtaaaaccatggaactgaaaagttctagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgactcatggtggccgggggccggcgggcagcggcgcccaacactcaactaaagggcggagacggtggcggggcttggagcaagtgactcggacacggtatccttggccaccttacccttacccaccaccactgctttgacgggcttgcgcgcgatcatgtt

SEQ ID NO: 13768 - DNA, 421 bp, Zea mays
  unsure at all n locations
  Clone ID: cC-zmpo148061f12a1
agcaagaanccaccactcaggtgngtgcagccacgcagntacatttctcttttcctttcctttctcagttacatatttgtaatccaggtgaagaggattcgtggtttagtgccagccagtctgcgacgactgcggtcggtcgtcgacgacgtgctattacatatcgatcgtcgtcgtcgatgtgctattactgatcgtcgtctgcgtccgagtccaactgtttgagcagcgaggcgcagatgggcagcggcacgtccttgaggtagccgagcggtttggcggggcgcaagttgtcgctgatgccgaccttcctggtgagcaggacgccggcgcggtccctgtccgcctgcacctggtcgcaatccttgcgcgggtttttcaccaaaccacctagcaaatgtcctccttctggctgtccttg

SEQ ID NO: 13769 - DNA, 277 bp, Zea mays
  unsure at all n locations
  Clone ID: cC-zmpo148061g02a1
cccccatttttcaatttataaacgcccaanccaaccccgggcaaagagaagagattaaaaccccaagaaccaccgaccccaccaaangaagacaccaaagaaaacaagcccccgccgcccaagcaaagacccggacgcacctaaaaaaaccgaaagccgaccctactacctacatcaacctccggtctcaccgcggtggtgcgttagcggcaccgtcaccggcggcgaggactgcctcgagcgtggtgactaccctggtcatggagggccggacctt

SEQ ID NO: 13770 - DNA, 497 bp, Zea mays
  Clone ID: cC-zmpo148061g03a1
gacgccgcttttcaagcttatgcctgccaggaacccgaggggggacaagaggagctgctggcacagggaggcgaggaacactctcatgtcacgggcgcatggcctggacaggaggagcaagaagacgacagcgaatgcggcgagcaggggggcaagcatcagcacgcgctggcggggggagcgcgctgtcactgcctctgccggagcgcccgctgctccgtccgtatatggataaacaacagcaggcgatgccgggagcagtggagctgctgttgctacgaccaagaccgcatcaagagctcgccttttatgcgctttctttctccgccccatcaaaggagccgtgccggtgacgccatggaacccactttgcgttttgcgacagggaggagaatagaaaaatgcagcgagagaaagttaaacacacacacacacacaataaaattaggtcggattccaacgaaacgaacccggggatcgggggaacaaaggacact

SEQ ID NO: 13771 - DNA, 508 bp, Zea mays
  unsure at all n locations
  Clone ID: cC-zmpo148061g04a1
ccccctttttcccttttttaagggcagccgccgncagcagcatatatgtaaagaagtggctctgcttacccagntacccacttttttccgcgaggctaagacaggtccatgttagattttccattgtcgcgagccttaaacgtaacgaaggcatctggcacacttgattgcagcgtgatgataaaccggcttcacagagagattaagaggaaaaaaaagggaggagggaataaagaagcgttctcttcgtaaagaaatatggcaaacgtgtagacttcattctgcgtgatatatatgcatgggtgggtcgttgaatccctcctatcctaattgacctcttcttttatatcttggcgaggctctcgttctccgatgtttgctcctcttcaaccacctccgtcagaaccttctgggacaggccctttttgttaatgtggttggaacttccctttttcattaacagcttcgccaaatggctttttcataacaaaacaccctttacccccca

SEQ ID NO: 13772 - DNA, 446 bp, Zea mays
  unsure at all n locations
  Clone ID: cC-zmpo148061g05a1
gaaccaccgaanangggagcaacgaggcgggntaatatatacagggaccccactacccgcctgtcctatccgaacagcgctactcgtttacacatcagagcagctcgtctacaggcaattctgcttcccaggttcattcattaataatgtggtgaatggctaccgaatcatgttctgatgatggcaacacaggcgcctctgtaggccagcagtggagggagtttaggccgaggtaccgccaagctgtgtggccatgccaaccatttttatcatccagccacaagggcccgttgaaccgaactaatgaagccactgcatgctggatgttgacatatatacaggtgacggggacaccgctcggtgctttggtgatcatgacgcgcctaccgccatttctggtggtttctctttggcctcaaccttgcccagcaatgccggtgtgactg

SEQ ID NO: 13773 - DNA, 369 bp, Zea mays
  Clone ID: cC-zmpo148061g06a1
cgcgcgcgcttttcttcttttgtcgaagacagacacgaaagcgccgacgacgccttgaccttgctccgacgcttctccagcagcttcgtgcgcgcctcctcgatcacgtcgttgctccgcgccacctctcggcgacgcggctgctccgactccgctcgcgcctccaacgccgtcctcacacggttgccctggaacctccgcattgcctcctccttctcgtcctcctccgcctcctgcttcttgatcgcctccttcacaaccgacacgaacttgtccgccaccacgtcttccactgctgctacggcaacgatggccttcggcgccggcgcccgcgacagaaccgcttcttgcttgggcgattccaccacc

SEQ ID NO: 13774 - DNA, 467 bp, Zea mays
  unsure at all n locations
  Clone ID: cC-zmpo148061g07a1
gaagctggatcctcagagcgttcccccccactttttcnttttttttcccggcaactaaaaacgaagaagagtagccaattgtagctacacacccacatctacacaattctgcaacatctagcaattctataaaaaccttaccttacctaaaatcaaaagattaatcacaaccgaccttacatttctatttgcatagactgtttgaagaatgcatcaccacattttatcaaaaacaaggtcttttttcatctatgtctaaggaggaactttccttatacgtacgatcagtctcatttttgaatcatcacagatcaagtacccattatcctctgccttatcacaacaattgttaaatcattccttgctaaagaaatcttcttataattatgatggaatcatcttaaccccttatcttttacactttaaaacaacatttatattttttaaaatcttctttaaaaatttct

SEQ ID NO: 13775 - DNA, 473 bp, Zea mays
  Clone ID: cC-zmpo148061g08a1
ccccctttttacctttttttccaacaacccccaaaactaagatcaattgtaaacattttaattaatattttccctcttttcccccttttatttattaaaaataaataatatcttttataatttacaatgaaaaaaaaaatttttttttttcataaatataaaaaaaaaaaaaatattttccccaaacttttatctaaaaaaaactacaaaaaacttttttatatttaaaaaatattaaaaaaacccgacataatacctcctttatattaatttaaaaatcccaataataatattcttattaaaataaaataacattatcaatttttattttatcatattataaaaaaaaaaaatctttttctttaaaaaaaaaaataatacactaattatttattacattataatatcataattatcattaaaaaaaaaattcattatcaaaaaaaattaaaaaatattataattttaataaa

SEQ ID NO: 13776 - DNA, 452 bp, Zea mays
  Clone ID: cC-zmpo148061g09a1
accaacaaaacaaaacatgttatattgaattattataatcttttaacccctaaaacccaattatattataaaataaataaaattaaaataaataaaaaatataaatatataaaaaataataataataataaaaaaataaaaatatataaaaaaaaaaaaaaaaaaaattaataaaaaaaaaaaattacaataataattattcaatataaaaatattacaaaaaatattataaaaaaattaaaataataaaaaaaaaaaaaaaaaataaataaataaaaaaatgatataaaaagtataataaaaaaaaaataaaaaaaaaaataaaaaaaaaaaaataaaatataacaataataaaaaaaaatattaaaatattaaattcaaataaaaacaaatataaaaaaaaaaaaaaaaataatataaaaattacattaaataaaaaaaaaaaatatata

SEQ ID NO: 13777 - DNA, 468 bp, Zea mays
  unsure at all n locations
  Clone ID: cC-zmpo148061g10a1
gaagctngancctcagagcggccccctcccctttttcctatgttgcacacaaaagaaaactgcgctccagatgggagtaaaaatatgctaccccaccccctctttaaacaagatttttcaaaatctacaaaagccaataatcgatctatctatagacaactttacaaaatggctgctacgttgatgatcgtacttcaaaatcacttagggctcgcatcatctcaaaaatacttgtgtggaacagagtctaagtcatcgtagtcaaatcttccacgatcccttcccgttttcaacaaatatgaatggtcgcatgacattttcttatcaattgaagccaacttcttggacaatgcccttaacctcttgatagacaagttaatatgcttcaccattttaacacttttatattgctcatgatcttcatgaaagctgacccattcatccttctgtttatggtgcatggactct

SEQ ID NO: 13778 - DNA, 356 bp, Zea mays
  unsure at all n locations
  Clone ID: cC-zmpo148061g11a1
ctacaacgaaaagcacagacaacatccngccgnggcaaaaaaacatctctacatccgtcttgaaaattcagcgcccaaaatacatcttaagccaatccatgcagctagcctcccttctaggaactgtcgctgctagaacctcttcggtcctacccaccaaaatgcatcatggaaccctcctatccttgaattatcccacttctgcttgcggagaactgcacaccacatagctcacatcttcatcttccctgcttcttacgcatccgacttgcaaaggttcttaaaccccatgtacctcatgtcgctcaatcttgtgaaccttgttagagaccccaaccccacctaaagaaacggcg

SEQ ID NO: 13779 - DNA, 393 bp, Zea mays
  Clone ID: cC-zmpo148061g12a1
agaacagcaaccaccagaccggacgggggccgtcccctcttccggggccccacagtgtcacatgcagtacccactacccagcaacaacaataatacaaagtgtacattagaccgttgaagctacacaccatcagcggcgtgagcttaaaaagggagaaaagctcacgtgaacagacagcgcattttgagaacaatgcatgtacaattgccgtacccagtctcatacatacgctgctgtctggactctggtgacagggctagagaagagaagctttaagctttcacctacaaggggaaaaaccctctcttcttgaaggaccagatgaagcactagaacacgacggcgcccgaaaccccagttatggcgagggtccactcgaacccgtgcggaac

SEQ ID NO: 13780 - DNA, 401 bp, Zea mays
  Clone ID: cC-zmpo148061h01a1
agagcggccgccccccacctttttcccttttagaacaacaaaaaacggccgggaaacgtagagagggtacaaaagcaaggcggacagcaccagcacagcacggggccgagaaaaagaagcagcaaggaacagacactctcaatacagggacatgtgcatacaccaaccggggcccaaacacttttgtccaggcgggcactgtttgtacagtgttatccgtgacggattattctgccactatgagcaggcctttcctccgaagagttttacatgtgttggagatgctactttaaaaataacattttccatgtatgggggagaagagaaaaagtattatcttgacttccacaacaagggtttaaaaaataatttaacacgtattttggtccttacgagtaaat

SEQ ID NO: 13781 - DNA, 373 bp, Zea mays
  unsure at all n locations
  Clone ID: cC-zmpo148061h02a1
cccctttttcctctattaccancacaagaccccggggctttggtgcacagnaaaaacaancaatataccaccgcacaancagggagngggcagggccaaacactacacacgctgtcaagttacaacacacaagtttacaacaacggtttgctgaaggccttcagctacagatatatataaatccccatacggggataacaaagtcagaaagaaaaacaatcgtttatgtgaactcctcatgtcatgtgagcgttcctaaaagggcgacagcagaagaatgtgacagttttctccctttctctttatctctttttcctagcttggcccatccacaccattgctcaaactatcattggtgacctttctattgctg

SEQ ID NO: 13782 - DNA, 248 bp, Zea mays
  Clone ID: cC-zmpo148061h05a1
aagaacccagcactcaaaattgcgtacaggcacgcagttacatttttgtttccctttcctttctcagttacatatttgtaatccaggtgaagaggatttgtggtttagtgccagccagtctgcgacgactgcggtcggtcgtcgacgacgtgctattacatatcgatcgtcgtcgtcgatgtgctattactgatcgtcgtcgtcgtccgagtccaactgtttgagcagcgaggcgcatatgggcagcg

SEQ ID NO: 13783 - DNA, 434 bp, Zea mays
  unsure at all n locations
  Clone ID: cC-zmpo148061h06a1
cccccctttttcccttttttncaccnnganacagnacgggggcanagggacagatctgnctataaacncccctgaaacctccatcacgctagggattttgacgtgcagcgtgccctacagcagcaggctagtaacaaaccaaccagccttcttatgtgtggtgtgtgtcgcgtactctaataacaaagaaatttcctaaccatggatcatgctgatgcttggcacaatttcaccaaaaaccatcaaatgcatgtctagctaaaccaaattaaagcccatttgaagcctgcaaccagtgtcatcatatcagctatatatacgggcctcccaggcaggctacaccttggcgttccaaagctgaccgagctccccccttcttgttccaagcaggacgataactcctattgttgaaggaacaaggtanagcatagctg

SEQ ID NO: 13784 - DNA, 429 bp, Zea mays
  unsure at all n locations
  Clone ID: cC-zmpo148061h07a1
cctcttttttnttttttagcatgccctttattcatggggtcaacggaacaaataattaccgcaaatgcttatttccgtgacgttacattaattgggctgctatatatgtgtatgaagcagttgacgaaactatacatcgtcggtcatcaaattggtaggtatacccatgcatgcatgcatcaaatcgtcatcgcatcccatgcatgcatgtatgatgtatcagtgattcagtgtcacgcaagcaggcagaagacgacgaccggcgggcgtgctctgctttcaagaaaggaggaggggtgcaggacctcctgcagttcttgctgaacagaggctgcttctccttggcgcacgtggtgttgcaggcccttggtgaccttaaccgccttgaccacttagttcttgttgcacgcctcttggcacacctttatt

SEQ ID NO: 13785 - DNA, 377 bp, Zea mays
  unsure at all n locations
  Clone ID: cC-zmpo148061h08a1
agagcggccgccccccccctttttccctctgttcaacacncaacccgcacgcgaccggaggacagggtataaaacccaaccaccccgacccccncagcccaaaggcaggaaccggaagggctcaaaaaccccagcacggccgcacagcaccaccacacccgcagcagaccagacacaaacacaaacagcaaggaccccacaacacaagagagaccaggcaagaaaaacacgccgcccccaactggacattaatagggcaacacatgaactaccctgactgaccctgaccccattaatagctggtataagttgttacaatccgacattcacaaagaggttgaaaatgccattgcttcgttaccttcacctgctggctg

SEQ ID NO: 13786 - DNA, 485 bp, Zea mays
  unsure at all n locations
  Clone ID: cC-zmpo148061h09a1
gaagcnggatccttagagcgccgccctcccctttttnatatttacaggancccatactagagttaattgtgatgcatgacctcccaaaccccacaaacccatccggcattatctcccctaccatcgaatcgaagcaacatgaactaccctgaccccgtgcttcatagagttcctgttcctgccagcaggaggcaatggcgacaggaacagcatctaccatcgatcaggtcacctggttgttgcagcagcaggagcaggaccaggagggaagttcacccactgcagttgcagctgtatctccccgctctcgacgttcctgagccggaggatcatgttctgcgccaacttgccgttcctccagcacacgttgttctcgtctgcgaggcagttcctggcgctcggtcgctcagacctgatgatggcgcccttcctcagactcttctcccgcggtttcatgctcaccgcctccatcagtggcgccacct

SEQ ID NO: 13787 - DNA, 517 bp, Zea mays
  unsure at all n locations
  Clone ID: cC-zmpo148061h10a1
cctcttttttnntttttttcaaaccgcacaacacatcgagagcacgaggggtcaacagcgggaaactcctaacatctatatcccagcggggctccagtttgcaattatttggggacacaatttaatttccagagtgaatttctagcaacaagcggcggagcctctctacataagctaacctattcctgatggctttttttgcgacgatttcctccacacgaacaatgagcaagccaaccggaggagggcagggggcgtgacaacaattcaaggtgctatggatgcgcatcaccttggcgaactcaggtggaacatctgacaacctggtttgtatttgttcttggaatgaacctcttcgaaatttttcaacggcccttcgttctctgtcaagccggtctggaaaaagtaccgtgtccaccaagaagaactccgcaactttgccggccttacaaattttggtagttctgaaaccctaacttttttggttgacccgggttggcagaaaaaattacaaggc

SEQ ID NO: 13788 - DNA, 496 bp, Zea mays
  Clone ID: cC-zmpo148062a01d1
gccggagcacaaagcttgtgtgtctggctgtctccgtttggcctttcttgacgaacgtcctccaatgggttgacggtcaggccctctagcttttgctcggcgttctggagacagagcgagagcgagagagagagagagagagagaggtagacggagatggagtgcctgctggggctgctcaaggtgcgggtggtgcgaggagtgcacctggccatctgcgacccgctcacccacagtagcgacccctacgtcgtcctccgccacggaaagcagaaagtgaaatcaagtataaaataccgcacgatcaacccataatggaacgaggagctcaccctgtccatcacgaacatgatgaacccggtcaagattggactctttgaccacgacacgttcaccaaggacgacagcatgggcaacgccgagttctgcatcctcaacttcgtggagatcgcgaagcaggacctgagcgacgtccccgacggcacggtgattaaga

SEQ ID NO: 13789 - DNA, 351 bp, Zea mays
  Clone ID: cC-zmpo148062a02d1
cgacgagcaaccgccggaaccggcgccaccgcaagattttgaatgttaggacaactaggaggaagggggggccagggatatatatcacacacacacacacacactcacacattctcacactcaagtctgcgtttgccatttttcttttctttttctctacgacttcgatattccctcctttcatctatctctccgtgaactcggtttgtcgtccagctggctgtaagtgtaccagatgccttctttacgtctgatgaggctcatgacaatggcgattttggcatggagttgtgttagcctcgcggaaaaactgtaactgtgtaagcagaactgctatatattgttcctaac

SEQ ID NO: 13790 - DNA, 529 bp, Zea mays
  unsure at all n locations
  Clone ID: cC-zmpo148062a03d1
ggccgatgtcgccaacgccggccacgccaagcccctgacgctttgcngggttttgtggtacacgacaaccacggggagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgcccaaggacaagtggtgcaagccgccgcaggagcacttcgacctcagcatgcccgcgttcctccagatcgcgcaggagaaggccggcatcgtgcccatcttctatcgcagggtggcgtgcgcgaagcaaggcggcatccggtacaccatcaccgggaacaagtacttcaacatggtgacgatcaccaacgtgg

SEQ ID NO: 13791 - DNA, 561 bp, Zea mays
  Clone ID: cC-zmpo148062a04d1
cgcccacgcgtccgcccacgcgtccgaagagatctgtgaaccctttttggcactaggagctaactctgaccgtcgcagatcccggcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcaggacatgatcctccggctcaggaacgtggagagcggggagattcagctgcagctgcagtggctcagcatccctcctgctgcagccagcaggtgaaggaaacgaagcaatcgcattttcaacctctttgtgaatgtcggattgtaacaacttaaaccagcaattaatggggtcagggtcagtcagggtagttcatgtgttgccctattaatgtacagttggggacaacatgaaatttaagccacgtcactcaaagtgt

SEQ ID NO: 13792 - DNA, 494 bp, Zea mays
  Clone ID: cC-zmpo148062a05d1
agaggcccttcaatggccatgagagctccttcagtagcttttagattttcttcaatatctctgagaggtccgtcaatggcttcaagagcatcttctgtgtctgtaaaggaagaccaaatttccccaaagaaaatccgacgaggaaacggaatcagtgttggtgaagctgagcgcccgtcacatcacacttttgctatcatccatttgggctcaagcaacatcccctgaaaatactcctgtgaactatgaagccattgctcatacttacagtttgcttctactgttctctggatccaaggcatcaacttttgaggctcttacccacagttttcaggttgcattttctttgaggagctatgcgctcactgaagcagattcattacaaccgtctcggcgtccgtcattgtttactctgtcgacagccatgattattttctcgtcaagagcttacaatgtgttgccactcattccaatctgtaaacaaatgatcaatg

SEQ ID NO: 13793 - DNA, 536 bp, Zea mays
  unsure at all n locations
  Clone ID: cC-zmpo148062a06d1
cggtggcgcctgcctctcgccgccgatacggtgcctctttttgtctttctccccctcgcaggtcttttggctgttttgggtcctccctttgcttcttggaggtgtttgttgccgtctcacccgcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacngagcaccgtctgtcaaatgtgctgtttgcaacttcattacaaatgttggcggggtgacttccatgatacctttgccaccaccagcactaactgcatcaagtggaacttatatat

SEQ ID NO: 13794 - DNA, 216 bp, Zea mays
  unsure at all n locations
  Clone ID: cC-zmpo148062a08a1
ccctcccacccccccattacaaaataaagacaccaccacaacagccagggactgagaacccatggaaacaaccanccccccaaacccccgaagagcacgacccaaccaagggacaacccccgaaaaaaaaaagacaaaaagcggccccaaaaacaacaaggcccacagaaccggcacaagaacaccggggaacaaaaaaaagaccggacccgaggg

SEQ ID NO: 13795 - DNA, 184 bp, Zea mays
  Clone ID: cC-zmpo148062a08d1
cttatttttgttccacgatgttcttgtcccagttcagaatttcatgttgtttaaggggccacttctattcggtaatttatacagcaactgccacttggtaggctcgtgctcatcaactataatctcagaagattgttaccatgggttatcagtgagtggctatcataataatgtcttttttttg

SEQ ID NO: 13796 - DNA, 346 bp, Zea mays
  unsure at all n locations
  Clone ID: cC-zmpo148062a09a1
ataggacctttgggacacncagcgcaaanagggcgagcgtggaacgatatgagggacttacacccgcncgaaaagngaccaagaacatacaaggtgacatgaccacaattgtttgcagtgttgacacgagtgggctcacacaatacatatgtcgcacgttcatcccgttctttaacaaccagagcacaggaccgcatttaccatgggggtataccgtgttcgaacaagaggcttagtgtcggattgcatgctcctgagcatgttcaagatggaaaggaacaggttcaggatgtcgaggtacaggccaaccgacgcccagatgtactcgtcgtaagtgtggcgcttg

SEQ ID NO: 13797 - DNA, 615 bp, Zea mays
  Clone ID: cC-zmpo148062a09d1
gggctaaccacccgtccgcacagctacgcgcaaaccgcgtctcgcgcgaagaatccgcatttccccttccccgcaccgcaccgcaccgcgggcaaccgccgtcggagagagagatggcatcggtggcggagatgcagcccctcgcgccggcggggtaccgccgcgcgccggagatgaaggagaaggtggaggcgtcggtggtggacctggaggccgggaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgtaccattatcagcacaagcacccacacaatttcgttttcctgggtctgttcacgttgtgcttgagcttcagcatcggcgtggcttgtgctaacacccaaagaaaaatcgttctggaggctttagtgctgacggctggcgtggtggtttctctgactgcgtatgctttctgggcgtcaa

SEQ ID NO: 13798 - DNA, 269 bp, Zea mays
  Clone ID: cC-zmpo148062a10a1
tcctaagagcgaccccctttcaaccccccttatttccttttttccccaccaccccaacaaggaaccttggggacaaaaaatttgtcatttccccaaaacccttcaccaaaaaaaaccccctaattaatcaaaaataaaataaaactttgtaaaagtacaaaccttttcccccctttccttcaacacctcaagtacaaacatattatttccacccccctatcgtgtgcttaataaaaaaagccatgccggcgtcctttaaaacttaaacc

SEQ ID NO: 13799 - DNA, 283 bp, Zea mays
  Clone ID: cC-zmpo148062a10d1
gcaaccgggggcagacgagcgcttagactcacagcggacgcctgcccagccacaggaggtctattctgaaggcgccttcacagacgtctggccccaggcaggtacatttatgtcgcacgcccagcaagcctgaccggcgagacttgtgcgataccaccataaaccgccattctcgcaggctcggttattgcagacatgcttcacacacgcgggcgaaggaccagcgtggctcgcgtagggactggggtttaactgcgtcacgcgtcagacactgacggcaccc

SEQ ID NO: 13800 - DNA, 454 bp, Zea mays
  Clone ID: cC-zmpo148062a11a1
gttgcacatttttatgaaacaactagcagcggggtaagagttatcacaaagccaggcataatcccgcaggagcgtgactaattcactcctctgccttgcacacgagatgacgagaaggaaccgaaagacacgcactgtagagagcaacaagtagcaatatatagtactagcagaagtgtagtagctcagtctgggccgtgaccgtgaaccccagccttcgagctccgacggccaatgctattaggtcatcacttcttgtgcgggctgtacctggggcacgccgggctgaagtggctggacaccaccctggactataacagctcgatgatgggtccgaacgacacgcacctcggcgccttgtactggttgatagaggcgccccgcgagatggcgtaatccatcaccttcttgaacgtgccgccgtgcaccaccccgatcttcagcggcccgatgg

SEQ ID NO: 13801 - DNA, 542 bp, Zea mays
  Clone ID: cC-zmpo148062a11d1
gcggagctgcaggccgccgtggagcgcgcggcgcgcctgctttttccctattacgcggccatcgccgagtacgggagccaggcggacgccaccaccatcccgggccactacgtcgtgtactgggagctcatggtgagggagggcggggcgtcgcccgacgccgccgtcttcgagcgctgctgcctggagatggaggaggccctgaacgcggtgtacaggcagggccgcaacggggacgccatcgggccgctggagatccgggtggtgcgcggcggcacgttcgaggaggtgatggactacgccatctcgcgcggcgcctctatcaaccagtacaaggcgccgaggtgcgtgtcgttcggacccatcatcgagctgctcaactccagggtggtgtccagccacttcagcccggcgtgccccacgtacagcccgcacaagaagtgatgacctaatagcattggccgtcggagctcggaggctggggttcacggtcacggtccaaaatgagctactacacttctgctagtactatatattgctac

SEQ ID NO: 13802 - DNA, 366 bp, Zea mays
  unsure at all n locations
  Clone ID: cC-zmpo148062a12a1
cacctccccnnttttttaattttacaggagcaacagaaacgaggtcaggtggacaagcaaaacacgctacacccaaaagaccaaaccaacccccaaaaaaaaagaaactgatctaaagcggaacagtcaacctgaatattcccaacgcaacaattgaaatattgtggcgcggacaataaccgctcaagcaaatacggttattaggaaggactacacttcggtgctattattactgaacacgaagatgaaacctttaacattttcaacatgcatcaaaaagaaaggggccgtccttacatcccctaccagagcagggggtgttccaaccattccaccaccaaaaaacactgaccgggacttatcact

SEQ ID NO: 13803 - DNA, 534 bp, Zea mays
  Clone ID: cC-zmpo148062a12d1
cagaaaacagtgggatcgagttgtttcactgcacgagcattttctctttcgaccaccggcctccctctccgggctctggggaccgaccaacgcgttgagcgaagatgtcgtggcagacgtacgtggacgagcacctgatgtgcgagatcgagggccaccacctcacgtcggcggccatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaagggatccgggggcatcactgtgaagaaaacagggcagtcactcatcattggcatctacgacgagccgatgactcccgggcagtgcaacctggtggtggaaaggctgggcgactacctgctcgaacaggggatgtaatgacaaccccttcccctggatgcatgttgatgat

SEQ ID NO: 13804 - DNA, 469 bp, Zea mays
  Clone ID: cC-zmpo148062b01d1
gccgacgcgtggggtggaggcaaatgcacggccggctcagattatcaacttttcgcgttgttcgctactacaaagcagcaggagccacagaagcgccggcgccggcgccggcgccagaagcaacctgatcgaggagaacgtgagccttgaagacgttagaacagtagctcaccctcccgagagtatgggttgaaaatctttggcgaattgatgtctcgatgcaaattaaacaggcatgccatctttgtgttaaataaatattaaacaaaaaaaaaaaaaaaatttattaaaaaaataactaaaataatattaatataaattatacaaaaatttttgctgggtggggggggggacctaaaacaaaaaaatattaatttttataccctgggggggccgttttatgggtataaaatttttcctcctgggctaggggagttattttcttttttatggggtcacaaaaaataat

SEQ ID NO: 13805 - DNA, 550 bp, Zea mays
  Clone ID: cC-zmpo148062b02d1
cgccttgggacgctagatgtcggggattttctcgctattggagtcatcttttttgcaacggattctgtgtgcgggctgcagggcctccatcaggatgagacgccctttctgtacagtctcgtgttcggtgagggagtcgtgaacgatgccacgtctgttgtgctcttcaacgcactccagaacttccatcttaaccacatcgatgtagccgttgtgctgaatttcttgggaaacttctgttacttattcgtgtcaagcaccttacttggagtgtttactggattgctcagtgcctacataattaagaagctatatataggaaggcattccactgaccgtgaggttgcgcttatgatgctcatggcttacctctcctacatgctggccgagctgctagatctgagtggcattcttaccgtattcttctgcggcatcgagaagtcgcatttacacctggcacaatgtgacagagagcttaagagtcacaaccaagcatgcctttgctacttttgtccttaatggctgagacttttctcttcctgtatgttgg

SEQ ID NO: 13806 - DNA, 503 bp, Zea mays
  Clone ID: cC-zmpo148062b03d1
aatccgtacgtcgaggtgcaggtcgtaggtaggatggtttcggacttttagggcgtggttgcggcgggggggaagcgggcgctggccaaggggacgccgtcggcgtcgttccggctccgcaacgggagcctgaacgcggtgcgcctccgccgcgtgttcgacctgttcgaccgcaacggggacggcgagatcaccgtggacgagctggcgcaggcgctggatgcgctgggcctggacgccgaccgcgccgggctgtccgccaccgtcggcgcctacgtgcccgacggcgccgcgggcctccgcttcgaggacttcgacaagctccaccgcgcgctcggggacgccttcttcggcgcactgggaggccaggacgacgccaccgccgcggcggacggcgccggcgccggcgccgaggaggactagcaggagatgcgggaggcgttcaaggtctttgacgtcgatggcgacggcttcattttcgccgctgagctgcaggagggtgc

SEQ ID NO: 13807 - DNA, 290 bp, Zea mays
  unsure at all n locations
  Clone ID: cC-zmpo148062b04d1
acccaaacggcgggcgnaaggtgaggctggagtgcaagcacttcggcacttgtaagctttagcgctccatcgacggggtgagcgacgggaacggtacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgttg

SEQ ID NO: 13808 - DNA, 579 bp, Zea mays
  Clone ID: cC-zmpo148062b05d1
cggccactgcaaaggggtcctctcgatgtgcagctactcctccatttacggtttgctgtactgcaagacccactgggagcaggtcttcaaggagaccgggagcttctccaagaacttcacgccaggtggcaagtcataagacaagggtgaactgacaagggccccaagcaagctgtcgtctgcattttctggtacccaggataagtgcgcagcatgccagaaaacagtgtacccgctggagaagttaactctggaaggcgagtcctaccacaagagctgcttcaagtgctcgcacggcggctgcatcctgaccacctcctcttatgccgcgctcaacggcgtcttgtactgcaagatccacttcgcgcagctgttcatggagaaggggagctacaaccacatgaacaagaagagcccgtcccaggaggttctgccggacgtggctgacgaggagcaaccgccggaaccagcgccaccgcaggatgagaaagaagaggacaactacgatcggagcgaccaacaaccacccatgcatatatatcacgcagactgaagtctacacgtttgccatatttctta

SEQ ID NO: 13809 - DNA, 453 bp, Zea mays
  Clone ID: cC-zmpo148062b06d1
gagtttgagctgatgatgaaagctggagtggactggatttatacgtttcggcagtactcgagagcggcgggcaacaggctcagccgcaagatgttcaaggacgcgtcactgaagcttggtagtaacaatggtccacttgctgctgcagccgtcaaagaacaacaagatgttgattgagtgatgtgtctactgcctgcaaactcgactaaaacagagaacacgagaactgtacccagttttccatgttttgtgtataggtcgccacattttggcaaggaaatgtatcaggggcggtcaattgactcacgttcacgtgcattgtgcatatgtcaagacactcccaattacaccctttatttttctcataaaaaaaaacaatgtcgttatctaccaacatcagcaagctgtgtttgtaaacatatctttaatcggtaatatccttttctttccaac

SEQ ID NO: 13810 - DNA, 59 bp, Zea mays
  unsure at all n locations
  Clone ID: cC-zmpo148062b08a1
cccaacaananagggggcatggccacataaagaagaaaanacgcccccacccccacaaa

SEQ ID NO: 13811 - DNA, 554 bp, Zea mays
  Clone ID: cC-zmpo148062b08d1
cttgcgcgagcgcagaaggcacacacgtacagccatggcgttttcgtttttcggcctggcggtgagcgacgggtgcagggggaatttccgggatctgaaggcgcggcggagcttccggttcatcgtgttcaggatcgacgacaaggacatggagatcaaggtggaccgtctcggcgagccgaaccagggctacggcgacttcaccgacagcctccccgccgacgagtgccgctacgccatctacgacctcgacttcaccaccgtcgagaactgcccgaagagcaagatcttcttcttctcctggtcccctgatactgcacgcacccggagcaagatgctgtacgccagcttcaaggacacgttcaagaaggagctggacggcatccagtgcgagatccaggccaccgaccccagcgagatgagcctcgacattgtaagagccggaccaactgatcgtcatcgtcctactatcatcacatcaagcaacacgtcgattatatatgcatcattatagtatcgtttattaaatttgaacccacccactgttaaccaca

SEQ ID NO: 13812 - DNA, 558 bp, Zea mays
  Clone ID: cC-zmpo148062b09d1
cgtccgcttcggcagaggcctcgtgcagaggatgccaaggtgccgcttttgctttttccacgtggtcaacaacgactgcgcgcacgggctcatgtacgccatcggcggcagcaaggcccccaccatcatcagccagggcaaccgctacatcgcgccgcccaaccttgccgcgaagcaggtcaccaagcagcatgacacgccggagtcggtgtggaagaactgggtgtggcactccgagaacgacctcttcatggaaggcgcctacttcaccgtcaccggcggccacatcaacaggcagttcaacaagaaggacctcatcaagcccaggaacgggtcctacgtcaccaggctcacgcgctacgccggctccctcgcctgcacgcccggcaagccctgctagatcaagccaccagcgaggacggccgacgaccagaagcagaccatgcattcgccggctcgccatgtaagaaacaagggagttgaaagtgcgacacaccagagaacgtgtctgtgtatactgtgtaaaggtcctaaaggaaagagaagatgcacatattc

SEQ ID NO: 13813 - DNA, 212 bp, Zea mays
  unsure at all n locations
  Clone ID: cC-zmpo148062b10a1
gcacacgaagcaaccaagaaagaaaaaaaacggaaaaaggggagaccgggagacagcaacaaangaaacaagcaccccggaacaaccacnaacaaccacaacaacaccgaccaacaaaggaaacagccaaccaagccaagcgcgccgacgcacagaaacaacggaacacaccagagcagcccgaccgaaacaccgccgaggaacaaaaaaca

SEQ ID NO: 13814 - DNA, 291 bp, Zea mays
  Clone ID: cC-zmpo148062b10d1
cgtccgcgacgacgaccagtaaactgtaccacggcggcgtcgcggactttctgctttaaaactataacgatgatacagagggaacgcgcgcatggcatggatagcagtatccactgaaagaaaaggaagaaaaggaaataaaaaaatgtaacagagtgcttgattcatttgctgctgtcacccggtcaccccattccccgttcttaacatacaagttgcagcggtgcaagacggctaaaacatgacaataatactacaagctctgcgaaattaattaaaactcgccggcag

SEQ ID NO: 13815 - DNA, 569 bp, Zea mays
  Clone ID: cC-zmpo148062b11d1
acccgtacgcattcaagcacctcctcctcccccgccggccaacaactcattttccgcatctcgccacatcagccatgggcgcgggcgcaggcaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtctaggaggagaagccagcggcagccgccaatgcagaggaaaaggtcgccaccgccgccgagaccacgacgacggtggaggcgaagaagaaggacgtcgaggaggccaggaaggagaagcaggcgcagcaaagctgaccgactgttcgtgcatgcgcgtgccaactaatataattattggctgatgatacctgatgatcagtgtgtgatcgagcaaggagacgacacttg

SEQ ID NO: 13816 - DNA, 319 bp, Zea mays
  unsure at all n locations
  Clone ID: cC-zmpo148062b12a1
aaaaaaaaaaaangccaagaaccccaggcaagcaagcaagaagcaagggagccaacaaaaaccaaccacggccacgggacgncggaaggaaagccagaacccccagagcgcggacacgccggaggcggcaccacactcacgagccgcacgaggagcagaagcaagcgctgcaagggccacgagaccatccaggtgaaaggcaatccgctggcgaccacggacctaaaccagaacaaggaacaagggaaggggagggggaaaccacgccaggacaaccccgtcaacaccggcaagggaaagcccgacgggcaagggccag

SEQ ID NO: 13817 - DNA, 514 bp, Zea mays
  Clone ID: cC-zmpo148062b12d1
ccaacgcttttttttttttaaaccaaacaagggctatggtcatcctttttaatttttatcaaagcaaataaataagagggctcgggggaccatcacaaacctacacaggctaggcgcagcttgcatctgagctgagaaccaatctctcagcatccaacaaccaaacacattgtataactagagagatgggtcgatggtggttctagaagcatgcgagctccttgaggcaacccttggcgctgcccttagcgttcttgcatacggccatggtcttgttgttggtgccactgtacttgatgttgacgtcgtccatggtgacgccggtgcatggcatcttggcagagcagagcaggttgacggcctccggggtggaagaggtgccggtgatgttcttgaacgtgacgtccttgaccgtgaccttggaggcaccattggcggtgcataacttgttggggccgtacttcatgtcgatgatgatggggtagcccgagtcctccatcttgatattctcata

SEQ ID NO: 13818 - DNA, 554 bp, Zea mays
  unsure at all n locations
  Clone ID: cC-zmpo148062c01d1
ccggtggaagccagctgcctagcggaaggtcggcggctgtctgcctttctgatcgcganggagcggcggggcagcaggggcgcggggagctgcctggggctgctggccgtcgccgtggtgtcgacgagcgtcatcctcgtctcctaccgcctccaccgccgcctggaggcggacctcagggtcatgatactcggcgaaggcgacggagccgcggaccagggccggcgccgcacgaagaagaacaagaaggtgcgcttcgcggccgacgtggcggagccgtcgtccagccgagaggagtaccggcggcggcgggcgtcgacagcggcggcggtcacccgagcaagatagcacgccgccgccgcgcgttagcctgacttgtggtgcatggctgtgtagcttgcgtgacgtggcggcatgcacgttcagctgccgtacgtaagccgttgcggcttccgtgggctgtgtgtgcttgttcagtgcgaatcgacgcgtgtgctttgcatgccgtatgagacatacaaccggaacaaacaaactcgatcttttcaggctcc

SEQ ID NO: 13819 - DNA, 470 bp, Zea mays
  unsure at all n locations
  Clone ID: cC-zmpo148062c02d1
ggccaccactactgcaaagggcaagccgttccgcccactttatctggttttcgtcgncgacgctgtcgtcggggtcgagggccccgccgcggaggacggccacgctggccagcccgaggagcggcccgctccacgcgacgagcggcctccagcacagcaagagcctgcagccagaccaccgccgcccgcggagcagccaggaactctcggcaaacagcccgcgccgcgccgccgtgccggcgagtcccaggtgcgccagcgggagcagcagcccgctccacccttccagtggcgccggcgcgcagcacgcgacgacgacggcgaccatacggctcgagcgccgcccgcggagcagccaggaccgcgggatgagcagcccacgcctgctgggcgccaaggacgccccgctgcggcgcaccgcgagcctacggtctgagctcccgataaggctgagcctaggaagcgccgtc

SEQ ID NO: 13820 - DNA, 431 bp, Zea mays
  Clone ID: cC-zmpo148062c04d1
cgccaagagcaagctgccaccaccgcaaacacaggggcggccatgttgacattcacacacgaaaaagccacaggagggacggggggcacgcaaaaccagcgacgcccctgacaacacggagcacactaaagacgatggacgaggacaggcagaaccaggaaaccagtgcacgcgacctagcacaggggaaggaacacaaccaggaccacggtgcacacctggcggcacaagagaacgcgcacaaggggcacggagacaaaaccgtgaccataagcaccaagaagtgaagcgacagcgcacccaggcggggaggccacgaggtgcggggcatggacagccccagccggcgcaagcacgacacgcccagccactcggtgacggcgaccgagcaaaccccaaccaaggacatgtgaagcaagcacccaaaggag

SEQ ID NO: 13821 - DNA, 563 bp, Zea mays
  Clone ID: cC-zmpo148062c05d1
cgcccacgcgtccgggagcacagagctagctagccagccagcctttagccatttttgctcgccgcgcccgtccttgttcctcgcgtccgttccgttccgttccgtcccgcccgccgccgccgtcgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattctacacaccttttgtcctctttttctttggtccctctttctccttaaattaacgaattgatgcatgccgctgatgtttttccccccgagagagggattaacacttgaatcatcgcttgccatttggttgaatccattcaacaattcgcttttg

SEQ ID NO: 13822 - DNA, 454 bp, Zea mays
  Clone ID: cC-zmpo148062c06d1
ctcgacacttacgctccacaggatcctctgcgccactttttacctttcgaccgaccgagctgccggcgagcccggggggcctacccgtcccgtcccaccacaccctaccgccgctcgcagctatgtcgccgtccgagccgacgcgcgaggagagcgtgtacatggccaacctggcagagcacgcggagcggtacgaggagatggtcgagttcatggagcgcgtcacgcgctccgccggcggcgccggcggaggggaggagctatccgtggaggagcgcaacctgctgtccgtcgcctacaagaacgtcatcggcgcccgcaaggcctcgtggcggatcatctcctccatcgagcagaacgaggagggccgcgggaacgaggcgcacgccgccttcattcgcgcctaccgctccaagatcgagaccgagctcgcccgcatctgcgatggcatcct

SEQ ID NO: 13823 - DNA, 367 bp, Zea mays
  unsure at all n locations
  Clone ID: cC-zmpo148062c07a1
accaccaccccttttttcactttttaccacccccccaaaaaaagagagccgggganaaagcctttatattataaccccctcaacaccaaaaaaaaacacatttgcctgacaatacatttggagttccatccacggtatatttggaaaaaaacaattactttaaaaaaagccccattaatatgaaaacaatatattcttccccccaaaataaaaggttatcgcattgctggccaacccgagacaacatacctataaacatttttaacgcctgagataaaacccactttaccccggtgcaatcaaacaagcatggaggcatgggttaattcatttcaaagggctttctttaaaaaaagaagaggggatc

SEQ ID NO: 13824 - DNA, 524 bp, Zea mays
  Clone ID: cC-zmpo148062c07d1
cgccgcagtccaacctggtgctgtacggcacgatccagtgcatttttcaagttctccgagcagaagggcatcacggggccggggatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttttccaaatataccgtcgatggaactccaaatgtaatgtcacgcaaatgtgtgtctttcatcgattgaatgggtaataataaaaaggcatgctg

SEQ ID NO: 13825 - DNA, 423 bp, Zea mays
  unsure at all n locations
  Clone ID: cC-zmpo148062c08a1
acccccccccccatttttacattttagcgacgaaacacccgaaggganacanagagcaattaattggacaaaaacccttcttccctcaaaactggaataagctagcttgaaatcatgagttcacttggtggtgctcttcctcctcttctctgtcctctccttgaggaccgtggcatactaattgcatgtgactaagacccctcccttgaagcactctgctcgtgcgcatcccaccttggtgctcctcttgccgaccatgaacgcgaagtggccgcactccttgtacgccctgccgtctgagcactgctccgtggggctggcgtacatagactcctccttgccccaccagaagacggcctccttggcggtggcgttccagtccatcgtggctccttgacaggcttttgccgtacttgtggccgc

SEQ ID NO: 13826 - DNA, 628 bp, Zea mays
  Clone ID: cC-zmpo148062c08d1
ccgcgacgacgttggcaagagaggagggccggcgtcggcgtgcttttctcgttcttgaaccatagctagccagcgggggcgccgggcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtgtcaccgaccaacggcacggggtggtacaagggcatcgcccgggagttcgtggacgcccacaacgagctccgcgcgcgctacggcgtgccgcccatgaagtgggacaggaagctggcgccgcaagcgcggcgctggtccaaccgcatgcgcaaggactgcgagctcgttcacagcggccacaagtacggcgagagcctgttcaagagccacgacgactggaacgccaccgtcaagaggcccgcttctggtggggcaa

SEQ ID NO: 13827 - DNA, 439 bp, Zea mays
  unsure at all n locations
  Clone ID: cC-zmpo148062c09a1
ctcccccccccancgtttacaatttttaaagacgccacccgagcnggcacanggggggacattaatnaaacaccggccccaaacccgagagcaagagcgaaagaangaacangcacgcangaagcacgccaacacccgcatggcagctcgtgggcatatgcaggatgaaaaaaaggagggaaagtggctacttagaagctcttggatgcctggtacgtgacgccgaactttcaatcagcggggagaacgtgccatgaggtggccttgcggtggtcgctggtcatcacccagaacgtcagcgactctcaggtgagggcctccccggtctgccacacttgcccccagatgcgctttatttacgtccacttgacgcgcttgcttccctttaccgacaccgccgtgatgtcaacagcgcctcccacaattggtgaccatcacc

SEQ ID NO: 13828 - DNA, 241 bp, Zea mays
  Clone ID: cC-zmpo148062c09d1
atggtgccacacctttggcctttggctctgctacgggcgcgggcgcggccgccccagctgacccgcgcggggacacaacacgagtacgcgccggaaacgcaccacttacgggcggacgccggcacgggccggcggtcagacacccaccaggtcgctgcaacggccggacacgggcgtcgggacggacgctgcggggctacaggcggcgggacgctacgtgcaaccaccgggcctgtgggac

SEQ ID NO: 13829 - DNA, 505 bp, Zea mays
  Clone ID: cC-zmpo148062c11d1
cgccgacgcgtgggaagaaacaagcgcccacgaacaactacctttttaccattatatggcctccaggtcctccatgggactcgggacggtgatgttggctgcgctgttcgcggttggtttctgcaccaccccgctcacctttcaggtcggcaagggatccaagcctggccacctgatcctcacccccaacgttgccaccatatccgatgtggagaacaaagagcacggtggtgatgactttctctttacgctcaaagagggcccgactggcacgtggacccttcacaccaaggccccactcaagtaccccctttgcattcgctttgctgtcaagtctggcggctaccgcatcgcctaccacgtcattccccgtcgatttcaaggctggcaccacctataagaccacactcagcatctaaataacctctcatgatgaattatatttcaaaagaactcacctagcgcatgtgttacaagacaatattattctttcatggcctttttt

SEQ ID NO: 13830 - DNA, 437 bp, Zea mays
  Clone ID: cC-zmpo148062c12d1
atctggtcctgcggcgtcatcctcttcgtgctcctcgttttctactttccgttccacgacgccaacctgggggagaggggccgtaagatcagcagatccgacgtcaagtacccgcagtggttcttccctgaactccggcggttgatgcccaagctccttgaaccgaacccaaacaacaggatcacgatcgagaagctggtcgagcacccctggttcaagaaggggtacaggccggccgtcatgctggcacagtcgcacggctccagcagccttaaggatgttcaggtcgccttcagtaactccgaccacaaggacagcagcaccaatgtggaacagccggcggacagctcctttaagccggcgagcctgaacgcgttcgacattatctcccactccagagggttcgacctgtcaagcctgttcgaggtggaccatga

SEQ ID NO: 13831 - DNA, 408 bp, Zea mays
  Clone ID: cC-zmpo148062d02d1
acgccccaccaccaagctcaacaacagccagctcgcgaaaataattttagagctttagcatggcatcatcggccggggtcttggggctagccctcgcgctagtggcggccaccgccccacaggtagcggaggcaaagaagaagagagcggcggagagcggcgaggcggcggaggcgaagaacatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaagaggagtgcgacaaggcgtacgtggtgaaagcggcccgagtcacca

SEQ ID NO: 13832 - DNA, 489 bp, Zea mays
  Clone ID: cC-zmpo148062d03d1
ggagcaaaaaggactgtccggtgcgcccttcgccagcattcttcactttcggctagattttggttggtgggtataaagaccaccccaaccggccacttcaagtagtgggagcccaagcaacattccaagtcatctagttgacatactcaagccctcccaaccacatatattcattgatccatcctatacacaagatttagaccactacaacaaacacaagtgccacaaaagagagagcaagcaatagagagctactcatttgagtttagcactagtgccttgtgagattcattgagagatagtgtgtgctacatctttgtgttcatttgcgcgtggagttttgactcccattgaacttcctccaaagttttggaggcttgtaaaagctagcaagagacaccaaagagtgtggtggtccttgcggcatcgagagtgatccttgagaagaagaagagctcgccgatccttgtgtgatcggtggagagaggg

SEQ ID NO: 13833 - DNA, 592 bp, Zea mays
  Clone ID: cC-zmpo148062d04d1
gtccgccttcgaagagctagtaattttctggagcgttgccttcccattttggctttagctactgattcagaagtgcaggggcctgcgacggtttgagttgcagtgtggcctgtcattgctcaggagctgcctcgacggtggcaagaactggcatctcgtgcagcacatccccgaggtgcgcatcataagctgcgatggcaagagatactttcggtataacaagagccgccgcatctacgaaactaatgcacagtcagaagaatgaagccatttctgaaaaccttggcacgacactggtttgttttgggtcagccacacgtttcagttgtcgctgtccctactttgttccgggagtattgagagcttgtgttctgttcacgattgattcaggtgttttcctttgttttgcgtgctttttttcttcttctttttatcgctgagccgatatatatgcactggttcttctctgaatatgggtgtccttcaccaggactcaatatgtgtaattcttttctgtttcctggtcatgattgtctgtaaattgtaaacattgcgtttgatggatatcgacactggagtgataagtgttggc

SEQ ID NO: 13834 - DNA, 469 bp, Zea mays
  Clone ID: cC-zmpo148062d05d1
caccaccatccccactatcggattcaatgttgaaactgttttatatttttaacattagctacactgtatggggggttgggggccattacaacatcaggcccctgtggaggcactactttcagaacacacatggacttattattgttgtagacagcaacgacagggaacgtgttgttgaggctagagatgatctccacaggatgctgaatgaggatgagctgcgtgacgctgcgctgcttgtatttgcaaacaaacaagatctttccaatgctatgaatgctgctgaaattactgacaagcttggtctgaattccctgcaacagcggcactggtacatccagagcacttgtgctacatctggtgaaaggttgtttgaggggcttgactggcttttcagcaacatctttcgcacgtcttgaaagcttttcggcagggctcctatcgagaggatgttctgaacaacttatgg

SEQ ID NO: 13835 - DNA, 381 bp, Zea mays
  unsure at all n locations
  Clone ID: cC-zmpo148062d07a1
ccccccccccctttttttctttttttaggccccaaaggnccgagggtgtattgagagattttacggaaggcaaacaccctggacctttggacaacggttgcagaatgcaaagcaagaactggagccctccatctcaagaaactaagcagggagatctaccggttgcattgtagcaaccaacccatacaaaacgacgtgtgcgtggcggcagatcatctgatcagctgatcaattaaaagcgctagctatcattcccttgccgttcctgcagtgtgccgcccccgcacggccgctcgcgggccttcgggtgcatgaggagcttgaacctgccgccctccttgcagggctgcaacagctcctgcgacggcaggcgcatctgcc

SEQ ID NO: 13836 - DNA, 611 bp, Zea mays
  Clone ID: cC-zmpo148062d07d1
gggcgtaccacccgtccgacccctccccttcccctgctcctcgaccacctcaacgagcttttgctcctacgacgacgacgtgccgccacaggcacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcgcggccgtgcgggggcggcacactgcaagaacggcaagggaatgatagctagcgctcttaattgatcagctgatcagatgatctgccgccacgcacacgtcgtcttgtatgggctggctgctacaatgcaaccggtagatctccctgttagtttcttgagatc

SEQ ID NO: 13837 - DNA, 502 bp, Zea mays
  Clone ID: cC-zmpo148062d08d1
cgcccacgcgtccgctgtcctctcctctgtccctctacggtgtttctgctttccggcccaaaatcgcctcatggggcacgcgcccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctgcttcctagctgggggtgctctctaccgtttcgagtacgcagtcaacccggcgctcttcctcgccaaagcgcgaggagggacgtgcacgctcgctccctctgaccctgac

SEQ ID NO: 13838 - DNA, 506 bp, Zea mays
  unsure at all n locations
  Clone ID: cC-zmpo148062d09d1
gcccacgcgtccggcgaaccaagagagcagggtgtgggcgattattaccctttccagtcgatcgttcaagaaaaggaccagcggaccaacaacagcagcagcaagcccacccgttcgacgacatggcccgccttcgcgccggcgccgggttggcgctcctagtggcggtcgcggcggtggccgcgtttcctcgcgtggccggcctcggcgaagtccggggagctgaccgcgatggggttgttggcggcgaagggcggcagcggcgcgggcccgcaaaattgctcggccccggtggccgagtgcgacgtggacgaggcggaggagctcgggctgagcggnggtggcctcggttccgacaactcggtgcggcggacgctggcgcaccggaagccgaccaaccggttcatcagctacgcggcgctgcgcgcggaccaggtgccgtgcaacaagcccggccggtcctactacagcaactgcgaggcgcagaaggccgtcaacccctaccg

SEQ ID NO: 13839 - DNA, 229 bp, Zea mays
  unsure at all n locations
  Clone ID: cC-zmpo148062d10a1
cccccccccnattaacaaattttaccacnaaanaacggggggggccaggaggaacaaaagcaaacgaagcccccaaaccaaagcaacacttgcgnnannggnccctcccgaccagacgagcacaaaccgcacagccaactacgngcccaccctcaacgacacgggcccgggngaacccaaaaaaagaccatgggagcgacagcagcggcgacaccagcgaaggcagcac

SEQ ID NO: 13840 - DNA, 216 bp, Zea mays
  Clone ID: cC-zmpo148062d10d1
ctgccatcgctggtgtcgccgctgctgtcgctaccatgtttttcttttgagttcaccagggaccgtgtcggcgagggggggcacgtagttggctgtgcggtaattgctcgtctggtcgggagggaccaataacgcaagtgttgctttgctttgctcacttcgtttgctcttgtaactttatggggtcaaccgttatataactgaaacgatttgatt

SEQ ID NO: 13841 - DNA, 521 bp, Zea mays
  Clone ID: cC-zmpo148062d11d1
acccaacgcctcccctcgtggcgttgttgtctgccggcctcttcccgcattttttatttaacggcaagggcaaggagcatgggggaggggccgacaacccgctggttgccggcatctgctctcgcgccccattcccagaggtttgcacggacacagccggtcgccatgcattcaagtacccggtcatcgacaatttggccgtgctgaacatgcatgtggccgcgttcgccaagcgcacagtgcatgcgcggaagcacgtcgcggtggcggtccgcactattccaccgtcgtaggcacaggccctcatgacctgcgacacgatgtacatgaacactcaggacgccatcggcgcggcgcatctagccatcgcgttcaaagacacgggcaccgcgaaaatcaatgctgcaactcgccgtccaggactatgactcgtgtgaccgttccttcacccatgccggcggtgttcccaaccccatgggtcaattcgataaggagctcaatcagatgggcaacaactgcat

SEQ ID NO: 13842 - DNA, 268 bp, Zea mays
  unsure at all n locations
  Clone ID: cC-zmpo148062d12a1
ttttctttttttttgngacatcagcaagngaaacaagcacccggagacaaggaggaaanaccnaagcaaccccccccaaccgcagaaacagcnaaccaagccaagcgcacgcccngaaaccgcgaacgcncgagcagcaaggccgcgacgccgccgaggaaaaaaaaacagggcgancgcgacgaccgagaccagcngcaagagcagcgcggcgcaaacggggagcggcacgacccagaaaaaacccaacgggaaggcggggcgcaag

SEQ ID NO: 13843 - DNA, 378 bp, Zea mays
  unsure at all n locations
  Clone ID: cC-zmpo148062d12d1
gaacggcaaaacacgtacattcacccggcggcaataatggcctcggtttcggctttttgcgacgacgaccgccgccgncggcctaggggctatgcgtcgtcctctcctgtgccgcggctgacgacccgaaccttcccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtgggcaccccgcgcaaggact

SEQ ID NO: 13844 - DNA, 597 bp, Zea mays
  Clone ID: cC-zmpo148062e01d1
gtccgcaagtttggtcctacatgcaaatttcaccatcctttggaatttgccggaattgcagggagggtgcggctaaagacattatgatatccacttctcccgaatgaaaaggagtgtgcgtattatttaaaaacaggacaatgtaaatatgcaaatacttgtaaattccaccacccagaacttttcaatgtggtgccttcgtcacgtggttcacctatttatacttctgtacattcctctgcaagcgctggtccacagtcatatactggaactatgtcaagctggacttttccacgagcttcttttataccaagccctaggtggcaaagtccttcaaattatgcaccaatggttgtacctcatggccttgtccaagtgccgagctggaattcatatcctggtcagctgcagtcacctggggctcaacaaacttatggaagttcacaacaaggcgaagctagtgcaggaaatcagggaatgctatcaccctatagatccagttcatttcctgtgcctcatatgcgttgcagagagataatgtatttcctgagagacccgatgaaccagaattgccatattacatgaagacaggagatt

SEQ ID NO: 13845 - DNA, 565 bp, Zea mays
  Clone ID: cC-zmpo148062e02d1
gtccgctgaaaacagccgagcgatctcctctccctctttttctccgtttcattctccagcgcagcgaagggaacatgtgtgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgactttcattatagtaacaacaaagca

SEQ ID NO: 13846 - DNA, 275 bp, Zea mays
  Clone ID: cC-zmpo148062e03d1
gtccgcggacgcgtggggccgccgccgccgaccgcgattttcccgttttcgccaacaaccaccaccggggggactgaggcgcttgcgcttccgagcgtgcatggcctgtgtggacttgcgtgtgtcgtgttcgcgtatatactactagtgccattcaagcaagaatattaaacaccatctgatccctctggttcagatggatcgatatgccagtgcaagcggcttgatctctggggaacctgggaatggacctgaataaatgggatttgtctttt

SEQ ID NO: 13847 - DNA, 549 bp, Zea mays
  unsure at all n locations
  Clone ID: cC-zmpo148062e04d1
ccggcacgcgtccgcccacgcgtccgcggnccccgaccgttccgattttttccaggccaggaccgtgaagggcgccagggacggtatgggcgtgcgccgcttcgccgtcggtcggcgtcagctacggcggcttcgttgcgtaccggctggcggccatgtacccggaggccgtggagcgggtggtcctcgtgtcgtcgggcgtgtgcctggaggagggggacctcgccgcgggcctgttccccgtggccgacgtcggggaggcggccgagctgctcgttccccgccggccggcggaggtgcgccggctcgtcaagctcaccttcgtccggccgccgcccatcatgccctcctgcttcctcaaggattacatcaatgtgatgggctcagaccaccttgaggagaaggccgagcttttacacgctctcattaacgattggaaactgtcacatctttcaaagataaaccagccaacgctcgatcacttggggggagcaggatcaggtctttccaatggagctggcgcatacgttggagaggcatcttggggag

SEQ ID NO: 13848 - DNA, 377 bp, Zea mays
  Clone ID: cC-zmpo148062e05d1
ccacccggccgcacagatcaatctgtgggagttgccaaccaactttttcaccttttgtctattattcaggttcttgagcggaaggtacatgaccacctagaaactcttggtggaggtgactacctttttgcgttccgtatgttcatggtgctttttaggcgtgaagtatcatttggagactccttatacctctgggagatgatgtgggctctggaatacgaccctgacattttcttcgcagcgtgtgaagaacaaggtgcagtaaataaaaacaaagtttctaaatccaaactgaaaggactgcgcccttttgggcaagtgggataattaagataaggacagggataaggaaaaagctaaaaatggggctgaggatg

SEQ ID NO: 13849 - DNA, 322 bp, Zea mays
  unsure at all n locations
  Clone ID: cC-zmpo148062e06d1
ccacccgtgcggagcgatctcctctccctctccctctccgatccattttccagtgctgcgaagnaaacatgtctggcggggcaggcatgtcctggcaggcgtacgtggaccagcacctgatgtgcgacatcgagggccaccaccttgcggcggcggccatcgtcggccacgacggtgccgcctgggcgcagagcacggcgttccccgagttcaagaccgaggacatggccaacatcatgaaggacttcgacgagccagggcacctcccgccgacaggcctgttcctcggacctaccaagtacatggtcattcaaggcgagcc

SEQ ID NO: 13850 - DNA, 452 bp, Zea mays
  Clone ID: cC-zmpo148062e07d1
gtccgcggacacgtggacggacgcatgggcggacacgttttcggattcgtgggaaaaaaaaaaaaaaaagaggaaaaaggaaaaaaaaaaaaaaaaaaaaaaaaaaaaacaaaaaaaaaaaaaaaaaaaaaaaaaacaaaaaaaaaaaaaaaaaaaaaaaaaaaaaaaggggcgccccactaaaagaaacaaacctaacaaccccggccatgcaacggaaaactcctttaaaagggccaccaaaaaaaaactaaaggcccccccttaaacaacccggaaacgggaaaaaccagggcgtaaccaaaaaaaaacccctagaaaaaaaaaccccttcccccaagggggggaaaaaaaaaaagcccccaacaaaagcccctccaaaaaaaaggccaaccccaaagggaaaaaggaacccccccagaaacgcccaaaaaaacgcggggggggggggg

SEQ ID NO: 13851 - DNA, 186 bp, Zea mays
  unsure at all n locations
  Clone ID: cC-zmpo148062e08a1
ccccctttttaattttttagcagacacaaccccggggaaagggaaactaaaaaaacacccaccccacaccccaaaagnaaaacacaaccaccacaacaaaacccgcgcaggacacaacaggcaagcggcacccaaccaacgaaagaaggaaaaaaaccaccgccaaggaaaccacacaccaacgag

SEQ ID NO: 13852 - DNA, 425 bp, Zea mays
  unsure at all n locations
  Clone ID: cC-zmpo148062e08d1
ggcggngcaggcccgtcgtgcacaaacccgnacaagtacttcgattttaagacgctgctccctctctggggcctggggggctacaaggctgtccagggccgccctcctgaccagcgaaccgacgctgcccaggggagtggaggtggccaggaaagcgctgggaagcaagcatgatgaatctagctacctgacgcgattgaaccgtgaccgtcagttggctggagaagtgtatgttaacatgtccagctcgctggtgtgtggtttcctttggcggtagtctaacaaccaacctgacaaaagatggggtgaccgcctgcccgtcatgaaccaagccgggtcttgataatggtggttcnagtttaaacctatggtgtggtcgcatcggcgtatgagactagttgagaaatatgaagggggaaaatgta

SEQ ID NO: 13853 - DNA, 167 bp, Zea mays
  unsure at all n locations
  Clone ID: cC-zmpo148062e09a1
gcggccgcccccccccctttttcnctttttgaacagagagcaccccaangggaggaaggaacanacccacagaaaccggacccccgncccaacacaacacaacancagaaaacaccaacacacacgacggcagagacacacacaagcgaaaaaaagcaggaaggcaa

SEQ ID NO: 13854 - DNA, 529 bp, Zea mays
  Clone ID: cC-zmpo148062e09d1
gtccgcttcatttggtgacctgaaccatctgatctcggctatgatgtttggcgagacatgctgcctgcgcgggccggggcagctgaactcggacctccgcaagctggcggtgaacctgatcccgttcccgcggctgcacttcttcatggtggggttcgccccgctgacgtcccgcggctcgcagaaataccgcgcgctgacggtgccagagctgacgcagcaaatgtgggatgccaaaaacatgatgtgcgcggcggacccgcgccacgggcggtacctgacagctgtcgccatgttccggggcaagatgagcaccaaggaagtggactagcagatgatcaacgtgcagaacaagaacttcctctacttcgtggaggggatccccaacaacgtcaagtccaccgtgtgcgacatccccccccgtgggctgaccatggcctccaccttcgtgggcaactgcaccttcatccaggaaatgttccgccgcgtgagcgagcactttactgacatgtttcggcgcaaggctttt

SEQ ID NO: 13855 - DNA, 390 bp, Zea mays
  unsure at all n locations
  Clone ID: cC-zmpo148062e10a1
tcggncgccttcatggctggtgaccccaccccgacgggaggagggcccgcctttctggacgacgaccctcgctgcgaccccccggccatctggtcggggtctgatggagctgatccgtatcaccgacgtgctgccgctgctgttctgcgggttgtagaactcggagcacgtcttcctgatctcgccttccttccccgtgagcaccttgagcacgctgagcttctccatggccttggcgaagatcgggacgaagtcggtggtctcgtccgacatggccttcactatgggctccggcttcttgtccatccgcagggggcggtcgatggtgagcggcatcttctttttcagcaccaagccgaagaatctcccgtccacagtcgttgggccgag

SEQ ID NO: 13856 - DNA, 351 bp, Zea mays
  unsure at all n locations
  Clone ID: cC-zmpo148062e10d1
gaacgcggacncnnggactcccctctccatcactgcgatttttacttttgcctcgaaaacctaactacagcggaacgcgggggcgtacacgccgatggcctccgcgcaactctcgacggatttatacaagacatcatgccccgacgccgagaagatcatcttcgacgtcgtacagaaacggatcaaagctgaccccgacaccaccgccggccttctacgactagtcttacacgactgctttgaaaatggctgcgacgcgtacatactgaacgacccgatgtcgaaccaggccttcgagaaggaagacggtcccaacgtctacatgaagggctacgacgtgacgaggagatc

SEQ ID NO: 13857 - DNA, 333 bp, Zea mays
  unsure at all n locations
  Clone ID: cC-zmpo148062e11a1
cccccctttttccctttttccccccccccaccccccangggccccgggggaaaacaaaacacacaacccccccaaccccaaaaaaaaaaaaaaagccccaaaaaaaaaaaaaaaaaaacgcaaccccaccacaacccccccgcaaaaaaaaaaacaaaaaaggaacaaaaactccacaacgggaccaaaacaaaaaaaaaaaaacccacacctcccagaaaaccccgaaaaaaaaaaggggggagaaaaaaaaaaaaaccaccccccaacaaaaacaaaacccccacgcggaacccccaaggagggcaggggggggccccaaccccaaacccc

SEQ ID NO: 13858 - DNA, 461 bp, Zea mays
  Clone ID: cC-zmpo148062e11d1
cgaaccacgcgtccgcgaacgtcgtacgagaacctttctccctcctccatttttctttttttcttgccacggcaaaacaccggcgccggggagagcatggcgatggcgtaccgtgtcctgtaggtcaccctggtgtcggcaaatgaccttaagaaagtgtcgctcttctcccggactcgcatctacgccgtggcttacatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtttatacctgggccatcgcgacatcggcgaggtgtttgtgcccatcgacgacctcctggccggcgccgacaagggtggcgatcccaggcccgtgagctaccaggtgcg

SEQ ID NO: 13859 - DNA, 415 bp, Zea mays
  unsure at all n locations
  Clone ID: cC-zmpo148062e12a1
ccccccttttttnagatttcagaacaancaaacccaggggggacatggggggtgaccccataacgncacccgagcacacgaagggagcaaagcaaagaaacacgcgggccctccctccccaccagacgagagcgattacagcacagccaattacgtgtccaccctaatgtctcaccgcgacacgaccatcgttggtgagtttagtagaagaagatcatggtagcaacagcagcggcaacgccggcgatggcagctccacttccaagggcagcaacaccggcggagtcatcaacatcccgtcccttaggcggaggggacgccgcggcggtggatgctggcggggaagggctcaacttctccgtcgtggaagaagggggtgtagaggccgtggctggcgccgtatctggaccatact

SEQ ID NO: 13860 - DNA, 552 bp, Zea mays
  Clone ID: cC-zmpo148062e12d1
gggccgaacacccgtccgacccggccctctcctttcgtcaccatcacatccattcagcctttaaaaatgtcgcgcgtcacagcggcggtgcggttttacatcctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgaaggaccggctgctgatgactccgccggtgctgctgcccttggaagtggagctgccatcgccggcgttgccgctgctgttgctaccatgatcttcttctactaaactcaccgacgatggtcgtgtcgcggtgagacattatggtggacacgtaattggctgtgctgtaatcgc

SEQ ID NO: 13861 - DNA, 490 bp, Zea mays
  unsure at all n locations
  Clone ID: cC-zmpo148062f02d1
ctaggatgggtgacttcctgggaagacctttttttgctttccggcgcgaccagcgacggggggacggggtgcacaaaggcagnccaggacgcctggacctcagcgtgcgaagcgaccggaagcgccacggtggtgatccccaagggcgactacctggtcggccctctcaacttcactgggccatgcaaggggagcaacatcgccatccagctggatggcaacctgctgggatcaaacgacctgtacaagtacacggcgagctggatcgaattgtctcacgttaacaacattgggatcaccggctcgggcacgctgtactgccaggggaccgccgtttatatcaagagcaagaccgacaacgtgaaggcgatgcccaacacactgttgcttgttcacgtgatcaacgccactgtcgccggaatcaaactactcaacttcaagttcttccacattaacattgacaactcatagagcattaccgtgaatgtcg

SEQ ID NO: 13862 - DNA, 545 bp, Zea mays
  Clone ID: cC-zmpo148062f03d1
ggctagctagccagccagccagcagccagcttgtttgccgcttttcgtccttcttcctcgcctccgggccgtgcgagtccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaagaagagacgaagcgggagagagagtgacatggctgcgcgcattccgatgcgtgggcatgctcttgattcgacacacctttcgtcctctttttctttgatccctctttctccttaatttaaccaattgatgcatgccgctgatgttcttccccctgagagagggattaacaccttgtatcattcgcttgccctttgtttgaatccattcaacacttccgatttaatc

SEQ ID NO: 13863 - DNA, 470 bp, Zea mays
  unsure at all n locations
  Clone ID: cC-zmpo148062f04d1
gggcgcggagatccgntccggggcggcgaagggggccgtttacaatgttgccttctaccactgcgcgttcggcaaccggcgaccacaccctgttcgacagcgccggccgccactactacgagagctgctacatccagggcaacatcgacttcatcttcggcagcggccagtccatcttccagtgccccgagatcttcgtgaggcctgaccggcggacggagatccgcggctccatcaccgcgcaggtgcggcaggaggaggacagcagcggcttcgtcttcctcaagggcaaggtgtacggcgtcggggaggtgtacctgggccgcgttaccgcgccggactcgcgcgtcattcttgccgacacctacctcttcaagaccatccacccggccggctggacaaccataggctacagcggcagcaccgacaaggtgacgctcgccgagttcaactgcactgggccgggcgct

SEQ ID NO: 13864 - DNA, 515 bp, Zea mays
  Clone ID: cC-zmpo148062f05d1
gggcgaaccacccgtccgcccacgcgtccgaaagactttagagcttaaggattttatcttttccattgacggcacacatgttcgggcctcgggtcctaaggaaatggaggctgcattccgtggtagaaagagtcaccctactcaaaatgtaatggcagcagtagattttgatctaaggttcacttttgtaatggccggatgggagggtacaacccatgatgccctcattttaagagatgctttagaatgagaaaatggtcttcgtgtccctgaaggcaaattctacctagttgatgcgggatatggagccaaaccaggttttttaccccctttttgtggtgtgaggtaccacttgaatgagtgggggcaataatccagttcaaaatgagaaggaattgttcaaccataggcactcatccctcagagttacagtagagcgtgcctttggatctttgaagaggcgattcaaaattttagatgatgctataccattttttcccttcccaacacaagta

SEQ ID NO: 13865 - DNA, 480 bp, Zea mays
  unsure at all n locations
  Clone ID: cC-zmpo148062f06d1
ccacacgnncgctnactccctccaccaccaaacttttaattttgccacggcaaaacaccttcgcgggcgagggcatggttatggcgaaccgcgtcctgaaggccaccctggtgtcggcaaatgacctcaaaaaagtgtcgctcttttcccggactcgcatttacgccgtggcttccatttccggattcaaccttcccatcccttcccacagcacccaagcagaccacagcaacggctgcaacccctgctggaacgccgtggtacacttccccatcccggttgccgttgacacccgcggcctcgcactccacgtgaggctccgcgcccagcgtctatacctgggcgatcgcgacatcggcgaggtgtttgtgcccattgacgacctcctggccggcgccgacaagggtggcgatccgaggcccgtgagctaccaggtgcgcaggccgcactctggccgcgcccacggcgtcctctacttct

SEQ ID NO: 13866 - DNA, 482 bp, Zea mays
  Clone ID: cC-zmpo148062f07d1
gtccgcccacgcgtccgcccacgcgtccgaccacttctgttaagagttttgatagcaatttctctagcacggcaagggaggatgtctttgaagatacaagagaatttgttggagagttgaatatcacactggtcaaaggcaccaacttggccgttagagacatgctaacaagtgatccatatgttgttttaacgctcggagggcagaaagttcaatcaacggttaaaaaaagtcgatctgaatccggtatggaatgaagtgcttaagatatctgttcctcgaaattatggacctctaaaacttgaagtgtatgaccatgatatgttctcagctgatgatatcatgggtgaagcataaatacgatctccagccaatgatcacagtcgccatggcctttggagatacttcacgtcttggtgacatgcaaatttgggaggtggttcatgaccaaagacaacgccctgatgaaagatagcacggtg

SEQ ID NO: 13867 - DNA, 513 bp, Zea mays
  Clone ID: cC-zmpo148062f08d1
gggcgaaccacgcggccgctcctccgctcccaaaatcctagggttttgctcgttgcggttttatggagcccacctcatcggcgtcgatcgggcggcatacgtgggagctggagaacaatatccccgcggcggcctccgacccggacgcgatggacgcgatctaccgctacgacgacgcgtctcaggcgcgggcgcagcaggagaagccttgggccaacgacccgcaccacttccgccgcaccaagatctccgcgctcgcgctgctcaagatggttgtccacgcccgcgccgggggcaccatcgaggtcatggggctcatgcagggcaagtgcgagggcgaccccatcatccgtatggacgcattcgcgctccccgttgagggcaccgagaccagggtcaatgcccaggccgatgcctacgagtacatggttgactactcaaccatcaacaagcaggctggaaggttggagaatgtggttggctggtatcactcgcaccctggctatggatgct

SEQ ID NO: 13868 - DNA, 196 bp, Zea mays
  unsure at all n locations
  Clone ID: cC-zmpo148062f09a1
aaacaaaaagnngaacccccccaccccccccnacanaangaaaacaacagaaaggggagaaacggcaaaccacaaaaaaagaacggaccaaaccacacgaccagacccaaaacaaaggacgcaaaaaaaaacacaaacggaacccaaccgaaaacaggcaacggcagccaacaacaacaccccccgacccccccaa

SEQ ID NO: 13869 - DNA, 600 bp, Zea mays
  unsure at all n locations
  Clone ID: cC-zmpo148062f09d1
gtccgaagtgtcgatcatccgtcgatccatcttgctaatttttcctgcttttcccttcgntctcgtctccatcgcgacgagggtcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcgggtggattccgcctatatatatatttaagtactttaatttgggtctgaacatgtccattgatccattcattctatctgccttgccattttttccctttctgctaatttcgatatgtaaagaggggagaatgggaaacactattcccttggacatgaccattggaaattaatcaatacccacttgttaaaaaaaaaaacaagggcggacgttttaaagatccagcttacgtcccgtgcatgcacgtataactttt

SEQ ID NO: 13870 - DNA, 407 bp, Zea mays
  unsure at all n locations
  Clone ID: cC-zmpo148062f10a1
aaacaagacacccaaaaanagggggaacggagcgaaacccacgggaggagcaccacaacccacgcaacaagcaaaggnccaaacaacaaaacaacacncgacacgcgaagaccaacaacaacgggagcacaaaacccacaaagagacaccaacgcggccacccaggggagcaccacaccacacacaaaaaaaaccaacgcgcccccaaaacacgaaaacggaanggaaacgcaaacacccacacaaacaggcaacncaaaagagccccacacggccagaaaccgcaggaccaaggacggcacccaacacggcaggagctcctccttggagcgggcttggacacacatttccttgttcaccaaagaacaatcttccagcgctggttgtttcccttgtaccactcccac

SEQ ID NO: 13871 - DNA, 467 bp, Zea mays
  Clone ID: cC-zmpo148062f10d1
aaaattagggccgaaccacgcgtccgcccacccgtccaacgggacggcccttgtgctgttttagtggtttaagggaaacaaccagcgctgggggatgggtccctggtgaacaaggaaatgggtgaccgaccccgcaccaaggaggagctcctgccgtaataagtgaagtgattggtactgaagtttctggaaataaaaggctcttttgagatgcctgtttgtgtgagtatttgcgtttccattccgttttcatgataataaaacgcatggattattaatatatgtaatgggaggctccactgaggggcagcgttggtatatatttgtaagaattaaaaacccattgttgttggactaagcgtgacgagggatgtactgatgtatgaacctttgctggatgcatatgctcttctgctcctaccgtgggcttcgatgagtcgataatttatatgagtatcatgtttatt

SEQ ID NO: 13872 - DNA, 432 bp, Zea mays
  Clone ID: cC-zmpo148062f11d1
gggcgaaccacgcgtccgcgacgatggcgtcgaataagacggtcctcatcgtttcggcttttcttctcatcacgctcgtgctggaggccggcgcctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccactcgatcgagagatcgatcgatgcttgttattatatttgtattccacattatatataag

SEQ ID NO: 13873 - DNA, 440 bp, Zea mays
  Clone ID: cC-zmpo148062g01d1
gtccgcattcaagcacctcctcttcccccgccgggcaatttctcatttttccgcaaccgccacatcagccatgggcgcgtgcgcaaccaagcccaagacgcttgaggggcaggccccagctgaggccgccgtcttcacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaaaaacgccgaggaggccg

SEQ ID NO: 13874 - DNA, 502 bp, Zea mays
  Clone ID: cC-zmpo148062g02d1
gtccgcccacgcgtccgccgtcctgattcagctcgccgtttacacttttacctggccttgttcgagcgcgggaactggagcccggtgctgaggcggtggcaccccgcgccggtcgcggtggccgcggtcaccctgcacggctgcttcggcgtcgtgctgaggcagtacctggccaaggtgaccatcctcaccgaggagctcgtccgcgtgctccactcggcaagcaggctggagaaggcactggcgcagatgacggccgaggacgcggcggactgcgccgacggccgggccaagggtatcgtgggcgacatggagcccttcgaggtggagtccgtcgtgatgggactgctcaaggcctggatggacgacaagcttgggcttggcagggactgcctcctccgagccagagacactgagagctggatacccaagtccaaggaggaaccgttcgccgggtcggccatggagctgatgaagctggctaagttgaccatcgatgagt

SEQ ID NO: 13875 - DNA, 509 bp, Zea mays
  Clone ID: cC-zmpo148062g04d1
gtccgcccacgcgtccggtcggccatgtcgacgctgcttttgctggttctccgcaacgccagcgttggcggcccggggccagaggtggtcatctgcggcggggcgcccaagaagtcgttcaggaagggcgagaacaacacgttcctgccggcgctccgcgactgcgcccgcatcaacctgggcaggcccgacgcgcggtgggagaaagaggacatgcccgtgggccgcgtcatgggcgacatgctgatcctccccaccggcgacctgctgctgctgagcggcgccgccaagggctgctccggctggggcttcgggcggcagccggtgctgaccccggtcctgtactcgccgcggaaggcgcagggcccgcggttccgggcgctggcgtcgtcgaccatcgcgcgcatgtaccactccaccagcgccgtgctggccgacgccacggtgctggtggtcggcggcaacacgaacgcggcgtacaacttcagcggcgtggacttccccaccga

SEQ ID NO: 13876 - DNA, 467 bp, Zea mays
  Clone ID: cC-zmpo148062g05d1
gggcgaaccacgcgtccggcgctggcgtgcgggctgctccagctgcggccgttctacttttttgcgccagcccagccggatggggtggggcaacgatggtgtcgtcgggcgccgcgaagcccaagtgcgtgcccggcgccaagaacgacaaggcgtgccgcgttggtgccgtgcacgacccggagaaccaggaggaggagggctccagcgtcaccctcaaggcgcccgccgccgcgcccgacgacagcgacggtagcgactacaacgaccccgacgagcccaacgacaaccagcttatcgtcgtcggccactgaagctgtcgcgcgccgacccatggatcatgcatggagattcgactgggtggatggagtggaccggccggttaacggatctctcggtgctaattcgtgatcttgaccggtggaagcagatggggtttgcatgtttgtttcattcttgcattgatt

SEQ ID NO: 13877 - DNA, 334 bp, Zea mays
  Clone ID: cC-zmpo148062g07a1
ataaaaaaacgaaccccacatggatatatggtataaacaaacaaatacaatacgcatccccatatgtatggcgctccgcggattaatcaacgaattaataatcaattaatgaatcttggcgcgggcggcgggcgccggcgccggcgcgtcaccggcgccaccggtggcccgcttgatgagcgcgtgggcgacgcgcatgagcgcctcgaagtccttgttcttggcgagcagcgtggttttgacgggcgtggatggggcgtgcttgcagcagacgttccaggaccacgtgtcctcctccgccctgtccagtaacatcttcacgtctaggagcttg

SEQ ID NO: 13878 - DNA, 600 bp, Zea mays
  Clone ID: cC-zmpo148062g07d1
gggcgaccacgcgtccgatttcttctcgcctctcccaccggcccggtcgcctggagaagttagcgtctccgatccgatccatggtgcgagggtatccacggcgatggaggcgagagcggccatgagctggtactgcggctcccttctggccgtggccatcgcgctgttcctgtccgtgtccctcggcgtgcgcgccgccggcgccggcgccggcgttgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgctggaccacctggacgacaccgagggcggcctcgacgacggcaagctccacgacgtgaagctgttcctggacacggcggaggaggacacgtggtcctgcgacgtctgctgcaagcacgccccatcacgcccgtaaaacacgctgttcgcagaaca

SEQ ID NO: 13879 - DNA, 430 bp, Zea mays
  unsure at all n locations
  Clone ID: cC-zmpo148062g08d1
gtccgcggacgcgngggaaaaaaaaaaaaaaaaaaaaaataaaaaattaaaaaaaaaaaaaaaaaaaaaaggggaaggggaaaaaaaaaaaaaaaaaaaaaaaaaaaaaaaaaaaaaaaaaaaaaaaaaaaaaaagggggcggccccctaaaaaaaccaaaccaaacaaccccggccaggcaaaaaaaaaacccctcaaaagggcaaacaaaaaaaaaaaaacggccccccctaaaaaaactccaaaacgggaaaaacccgggccgaaccaaacaaaaacccctggaaaaaaaacccccttccccaaaaggggaaaaaaaaaaaaaggcccaaaccaaagggccgggcaaaaaataaaaaacacaaaaaggaaaaagaaaccccccccaaaaacgcccaaaaaacacggggggggggggggaaaccccca

SEQ ID NO: 13880 - DNA, 360 bp, Zea mays
  Clone ID: cC-zmpo148062g09a1
tatattaaacaactgaatatattatgggtaccggtgggatcttgagacattaatatatcaacacctgaattaaatggagacatgcatgcatgaaccaacagatcggagacatgaatcaaaccccgacgggctggctggctggtcgacggatgatcagcgccccatcccctgcgaggccggcgggcacatgtcgacaccggcggcggccctctgggcgttgaaatcccaaccgaggacgggctcttagccgcgcgccttgagctccctgtactcctggcaaaacgcgcagtggaggcagcagacgtggactaagaaatctgcgcaaggcgcctttgggagcccgtgctgctcgcgcaatct

SEQ ID NO: 13881 - DNA, 479 bp, Zea mays
  Clone ID: cC-zmpo148062g09d1
gtccgcggagatcgtggaccacggcatgacgtcgtgctttacgagttttgcgctgttcgcgctgatccaggggctgggggggtcgcagtgcacgtgggccttctcctgcacgtaccgcaccaggctgcgcgcgcagcacgggctccccgaggcgccctgcgccgacttcctcgtccacctctgctgcctccactgcgcgctctgccaggagtacagggagctcaaggcgcgcggctacgagcccgtcctcggctgggacttcaacgcccagagggccgccgccggcgtcgccatgtgcccgccggcctcgcaggggatggggcgctgatcatccgtcgaccagccagccagcccgtcggggtttgattcatgtcttcgatctgttggttcatgcatgcatgtctccatttaattcatctgttcatatattcatgtctccagatccagacggtacggataatatattcaagtgtttacgt

SEQ ID NO: 13882 - DNA, 432 bp, Zea mays
  Clone ID: cC-zmpo148062g11d1
gccttgttcctcctggtcctcttctgcatcgtgcattttgagttttaagagacaaagggcatcgaggggaaagggggcgggcctggtgggtccttcgacatcaccaagttgggcgccttcggcaatggcaagacagacagcacgaatgctgtgcaggaggcatgggcatcggcgtgcggcggcactgggaagcatacaatccttatacccaagggcgacttccttgtcggacaactcaacttcacaggcccttgcaagggcgacgtgaccatccaggtggatggcaatctgctggcgaccacggacctaagccagtacaaggaccatggtaattggatcgagatactacccgtggataacctggtcatcaccggcaagggaaaccttgacgggcaaggtccacccgtgtggaacaagaacttctgcaccaaa

SEQ ID NO: 13883 - DNA, 219 bp, Zea mays
  unsure at all n locations
  Clone ID: cC-zmpo148062g12a1
ccccccctttttcnttgcttcacaacagcacnatagcagggacaccgggaagggacaaaaagcgnngcaaaccaaacaccganganangaacaaccacggccaaaagggggcgacgaacaaancactacaaaggacaaaagggaaacacacacagcagccggacccaagggaggggaaccacagagnacaaactcaaaaaaacccaacccttcaccacc

SEQ ID NO: 13884 - DNA, 616 bp, Zea mays
  unsure at all n locations
  Clone ID: cC-zmpo148062g12d1
aaaattgggccaaccaccgtccgcgctgagttgcaaccatcaagaccaagagaactgttcagtttttggactggtgccccactggatggaagtggggcatcaactatcagccaccctctgttgtccctggaggtgacctggcaaaggtccagcgtgccgtgtgcatgatcagcaacaacaccgccgttgccgaggtgttctcacgcatcgaccacaagtttgaccttatgtacgccaagcgcgcattcgttcactggtatgtcggtgagggtatggaagagggtgagttctcagaagcccgtgaggacttggctgctcttgagaaggactatgaggaagtcggtgcatagggtgccgatgacgagggtgactagggagacgactattgagtagctggctaataagtagttctctggtggttaatggntgggttattttgagtatatactctatggttccactccattggatactgctgctgtgtgtgttttcattttgaactatgtagtaaattgttcgtagccccctattggccaatgatggtcatatcatccttctttggtttgcaacgctattcgttcaatttcggtgatatgctataatgctattacgttgc

SEQ ID NO: 13885 - DNA, 586 bp, Zea mays
  Clone ID: cC-zmpo148062h01d1
gtccggcgatctcctctccctctccctctccgatccattttccagttttatcgaagtaaacatgtctgacggggcaaaggggtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgtgcagtgcaacatggtgggggaaaggctgggcgactacctgcttgaacagggcatgtaactactacgtaccagctggaatgcatgtcgacgacgatggttttcgagtttcgacttccaataatagttacaacatagcaaaggcctttcttccggcgtaattgctttggct

SEQ ID NO: 13886 - DNA, 531 bp, Zea mays
  Clone ID: cC-zmpo148062h02d1
gtccgatcgatcacaacaagatggcatgtatagacaattttttgattttcttgttccttctagcgctctggggcaccgggcatggtgagaaggcaaagtcaaaggacaacgattcaaaagcgtccgggcccggtgggtccttcgacatcaccaagttgggcgcctctggcaatggcaagacggatagcacgaaggctgtgcaggaggcgtgggcatcggcgtgcggcggcaccgggaagcagacgatcctcatccccaagggcgacttcctcgtcggaccactcaacttcacaggcccatgcaagggcgacgtgaccatccacgtgaatggcaatctgctggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaagatcctttccaactcgctggtgatggacttcctgaaca

SEQ ID NO: 13887 - DNA, 535 bp, Zea mays
  unsure at all n locations
  Clone ID: cC-zmpo148062h03d1
gagcaaaaaggactgtccggtgcgcccttcgccagcatttttcatttacggctagattctgcgcggagggtgtaggggctcttttacatgctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgttccctgcggctgagggaccggctgctgatgactccgccggtgctgctgcccttggaagtggagctgccatcgccggcgatgccgctgctgttgctaccatgatcttcttttactaaactcaccgacgatggtccgtgtcgcggtgagacattanggtggacacgtaattggctgtgctgt

SEQ ID NO: 13888 - DNA, 508 bp, Zea mays
  Clone ID: cC-zmpo148062h04d1
gggcgaaccacgcgtccgcccacgcgtccgcgcgtgtctaggtttcctctcttaccatatttcccgctctgtcgcccttcgttgacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgttcgccaccccaacgtcgtgcagctgcacgaggtgatggccagcaagagcaagatatacttcgccatggagtacgtccggggccgcgagc

SEQ ID NO: 13889 - DNA, 604 bp, Zea mays
  Clone ID: cC-zmpo148062h05d1
gggcgaaccacccgtccggtcagcttgggattgctccgcatggattcgcgcctatggatttttcctggaggaacggctcgagtgcctcagggttctcagatacgacatcgaaaccgagcgtctcgtcagatatccccagacttccagcaaggtacatagtaaaaccaggaccctgcctagcccggaactcttggagcagttgcctgcactgcagcagctgcttttcagggttgtcggcgtccagcctgaaggcgctgcctgctcaaattaccttattcagtacgcactagccctggttctgaaggagagcttcaagatctactgctcaattaacgatggcatcatcaatctcgtcgatatgttcttcgaaatgccgaagtacgacgcaatcaacgctctggcgatttacaaacgagctggcctgcaggcagagaaccttgccgagttctatgacttctgcaaacagcttgagcttgccaggacgttccagtttcctactctcaggcagccacccgcatcgcttcttgcaacgatggaagagtacatcagagaagcaccccgaccctcgatcaagagtgaggagagcgaggagccgaagctactg

SEQ ID NO: 13890 - DNA, 570 bp, Zea mays
  Clone ID: cC-zmpo148062h06d1
gggcgaaccacgcgtccgcccacgcgtccgcccacgcgtccgcccacgcgttttcccattttttcgggaaaaggagcgaagagggagaggggggcatgcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagaaaggaatggccaagtccggcaagcctctatggtacaaggggtcgacgtttcacaggatcatcccggggttcatgatccagggaggcgacttcaccaacggcaacggcacggggggcgagttcatctacggcagcaccatctttttcgacgagaactttaagccaccca

SEQ ID NO: 13891 - DNA, 362 bp, Zea mays
  unsure at all n locations
  Clone ID: cC-zmpo148062h07a1
cccccctttttccttttaaaaaagccgncggaagcggggcaccgggagggcngtgcgaaaccaatggaccccacccacgggcaaagcaaggacgagagaaaaaatataaccagagagatgggtcagccgacggagggtctaaaaacaagcaagctccttgaggcaacccttggagctgccctaggcgtacgagcatatagccatggaccagccgatggtgccgctaaactcgacgatgacgtcaaccatggtgacgccggtgcaagggaccatggcagtgcaaagcaagctaacggcctccggggaggaggaggagcccgagacgcccatgaaggagaccgccctagaccgcgacctaggag

SEQ ID NO: 13892 - DNA, 533 bp, Zea mays
  Clone ID: cC-zmpo148062h07d1
gtccggatcacgacaagatggcatgcacaaacaatgcgtttagagttttgttcctcctggtcctcttctgggtcgtgcgtggtgagaaggaagagtcaaagggcatccatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccacgtggatggcaatctgctggcgaccacggacctaagccagtacaaggaccatggtaattggatcgagattctacccgtggataacctggtcatcaccggcaagggaaaccttgacgggcagggcccagtcgtgtggagcaagaactcctgcaccaagaagtacgactgcaagatccttcccaactcgctggtgatggacttcgtgaacaacggg

SEQ ID NO: 13893 - DNA, 285 bp, Zea mays
  Clone ID: cC-zmpo148062h08a1
cccccccccccccccaagggggccgggggcccttttactttccaaaatgctcgcacacccacaccaaatttacgatgaatttacaggaccctcctccgcatcatgtatgtacagaacaaacacccttgaccctttggttacaaaataataatctaccgaggaccaaagcgcaaaaaaagctagcccgaactcacagtaagaactccctacaaaactcggacaaagaccaatcccactccgacttgggaagcggcggcttgtgaaagtccttgaaaaggcccctta

SEQ ID NO: 13894 - DNA, 582 bp, Zea mays
  unsure at all n locations
  Clone ID: cC-zmpo148062h08d1
ggccgaaccacgcgtccgcgctattcttagccccagagctcgcgccacaccataacacgttcctcccgcgcgcggggcgtgcaagcacacgggtgccccggcccgcgcgcccgtgctggccggccagcagacatggacatcgacctcgaccgggcgcgcgcgctgcgtatcctcggccgcggcgccatgggcaccgtgttcctcgtcgcggaggggccctcggccttgcgccccagccgctacgccctcaaggtcttcgacaagcgctccgccgcccgcagcaggaagcctgacgccgaccgccgcgcgcggtgggagatcagcgtgctctcccgccttgcgcacccgcacctcccctcgctcctcggcttcaccgagacggacgaccttctcgcgtgggccgtcccctactgctccggcggcgacctcaacgagctccgctactcgctccccgaccgcatcttctcccccgcggccatccgcttctacattgccgagatcgtctncgcggtcgccgagctccacgccgcgggcgtcgtgtaccgcgacctcaagcccgagaacgtgctccttcgcgccgac

SEQ ID NO: 13895 - DNA, 275 bp, Zea mays
  unsure at all n locations
  Clone ID: cC-zmpo148062h09a1
caaaagaannacacanagagggaaacaggagccaagcacaccgngncaagccaacanccgcacncgcaggccacaangaagcaagccccgcnncaacaacacaancnacaccccccggnacgaaggaaacacacgcgggagcggacaggcanaagaaccacccnnaccnccanacaacgngacagggccacagggagaacaaancnaccagacggggcagaccacaccaaccccaaggggggaaacacggggcacgcaagccgcgcaggcgggac

SEQ ID NO: 13896 - DNA, 574 bp, Zea mays
  Clone ID: cC-zmpo148062h09d1
gtccgcttaatgatactgtgcttggctgttactataggcttcagaatttcgaaacagatggcaaatgcacgagggtgggcggttataacagttatgattgtcacaacttgctttatgtcactcgtcattgtcctttgttggaacaagaatgttgtatttgctcttgccttccttcttttcttcggtgcaatcgaagctgtctacttctcagcttccctgatgaagttccatgaaggagcttgggtgcctataattgtttccttcattttcttgactgtgatgtgcgtttggcactatggaacagcaaagaagtacgaattcgatgtggaaaacaaggtctcaataagttggcttttgaatttaggctcttcgttgggtattgttcgggtcaaaggcattggcctgatacatacagagcttgtgtctgggattcctgccattttctcccactttgtcaccaacctccctgcatttcatcaggttctggtctttctatgcatcacatccgtttctgtaccacatgtccaacctgaggagcgactttttggtcggacgcattggcctgaaacaatac

SEQ ID NO: 13897 - DNA, 321 bp, Zea mays
  unsure at all n locations
  Clone ID: cC-zmpo148062h10a1
ccccccttttcccctttttcccccccccccccccncgggggcccngggggccttccccccgggnaaaccgcccgnancccccccnacaaaccgaaggaaaaaaaagccccgccccccacaagccccccccccggggccgcaaaaaaccaggggcaacccccccaaacaaaagaaaacaacccggggccctccaaaaaaaaaaacaaccccgcgggggacacccccccaacccaacaccccccgggggccccaccaaccctcccttcagggggccaaaaagagccccaggaaaagttccccccccccccggggggacccccc

SEQ ID NO: 13898 - DNA, 203 bp, Zea mays
  Clone ID: cC-zmpo148062h10d1
ccgtccgagtggccttgcccctgagaacaacatgatgcttgttcacaatttaagagtttcacgtcccttaatggagctaccggcaggatatgatgaatggaaaaaggagggatcaagcgaaggtgtgggaataatcagtgactcctctgagccccaacgaagaaatgtcaggaggctacaggaaggagacgtgtaaggagaga

SEQ ID NO: 13899 - DNA, 276 bp, Zea mays
  unsure at all n locations
  Clone ID: cC-zmpo148062h11a1
cccccccttttcccttttttccccaccccccaaaaaggaggaaaganagggaangttaaaaacaaaaaaccccccnccccccaacacaaaaacagcccgaccccgaggacaacacaaccccangccaaaaacgccacagacaggagccccaaaaaacgcaaccaaagcacccgggacacaaacagccagcgggaccacaaaccgcagccacggagagacagaagaaaggagggaacaaccaagccccaaagaaaaagaaaagaaaaagggccaacc

SEQ ID NO: 13900 - DNA, 347 bp, Zea mays
  Clone ID: cC-zmpo148062h11d1
cacccgtccggccacgcgtccgggcgagagtgcgtgcgtgcagtttcaggcattcgtcggcaccatgtcttctttggcgcggcgcgcaggacaagtgcgcggagtgcgacaagaccgtccacttcatcgacctcctcacggccgacggcgtaacctaccataagacatgcttcaagtgcagccactgcaaagggatcctcttgatgtgcagctactctttcatggaccgtgtgctgtactgcaagacccactttgagcagcttttcaaggagaccgggagcttctccaagaacttcacgccaggtggcaagtcttcagacaaaggtgaactgaccagggcccccagc

SEQ ID NO: 13901 - DNA, 619 bp, Zea mays
  unsure at all n locations
  Clone ID: cC-zmpo148062h12d1
gaacggcaaaacantacattcacccggcggcaataatggcctcggtttcggcttttgcgacgacgaccgccgccgggggcctagggctatgcgtcgtcctctcctgtgccgcggctgacgacccgaaccttcccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgccccatacacggcgtcacccacggtgacgctggactgcaggcacttcggcaccggcaagctcgagcgcgccatcgacggggtcaccgacgcgaccggcacctacacgatcgagctcaaggacagccacgaggaggacatctgccaggtggtgctggtggccaacccgcgcaaggactgcgacgaggtccaggcgctcagggaccgcgccggcgtcctgctcaccaggaacgtcggcatcttcgacagcctgcgccccgccaacccgttcggctacttcaaggacgtgccgctccccgtctgcgccgcgctgttcaaagcagtggactcggacgacgacgacgaccagtaaactg

SEQ ID NO: 13902 - DNA, 230 bp, Zea mays
  unsure at all n locations
  Clone ID: cC-zmpo148063a07d1
ggcagacggcccggccgatgccacggccacggccacgctggctgctatactgaccattgtgccattgntgctgtgagagnagggtgcgttggccaacatgtgtgctattgcttccccttatttgtgttcagaatccacttaaactcggtcgaagtgagctttccgttcggcaacgtctgtactcttacgaatctcgatcgtgtatgtctttaagtattgtgttgtgtttc

SEQ ID NO: 13903 - DNA, 585 bp, Zea mays
  Clone ID: cC-zmpo148063a08d1
accatcggtttcaatgttgaaactgttgagtacaagaactatatcttctttttctgggatgtcgggggtcaggagaagatcagacctctttggaggcattacttccacaacacccagggtcttatctttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctgtatgaaggcctggactggctgtccagcaacattgcgagcaaggcttgaggcctaccttgaatgtcaaccgcgaactgactaggagctccggatgtatcatggaaactcaggacagaatcgcagttgcaacctgttagatgtcttctaccggcactatatataatttttgttggatgtggaatgatggtactgttcaacggttattaccctactatactggtggatgtt

SEQ ID NO: 13904 - DNA, 513 bp, Zea mays
  Clone ID: cC-zmpo148063a09d1
tgtcatcgggtggacgtccgggaaggacgtgcccgtgtactatgactattctcacgttcatgcccgccggcacaggcgacaagaggctatggatcgcgctgcacccttccgtgtcgatgaagccggagttctacgacgcggtcctcaacggtctcgagatattcaagatgagcgacagctccggcaacctcgctggtccgaaccccgacccgtccaggatgctggaggaggcagagatgggcgtgacgcaggggcagttcaaagccaagcaaagcaacctccaggccatggtgatcggcggcgcggcgggtggcgcggcggcctttgggatagtagcggccatatgcgtcgtggcttaccactcgaagaagaggcgggcgctgggtaacagcgtgtcgcattcatcgggatggctgcccgtctacggtggcaactcgcacacaaacgccagcaagtcgtccggcggcaagagcgcggcgctcaaccccgacatcacggccatgtgccggcact

SEQ ID NO: 13905 - DNA, 479 bp, Zea mays
  Clone ID: cC-zmpo148063a10d1
catacgcgtgcgctgccagggcgctcgtcgccatcgtctttgaccagctgtttaccgcgtcgatggcatcgcctgggatccggggcctgcccctggaagcatctgggggcacgacacccgcagtcgttggcgtcgtgcgcctcctcacatggaccgcgcgctggactgtaagaaatgcatgagcaaggacttgaggagggccccgtggccgagctgtgtaggccaatagacggctcaacgcaaaagcggtggttgtggaggctgcgacagcgcacaaggccatcactgggttgtggcggggcaagagagatgagtgggggagactgggagagtgatgagccttttctgtaattgagacggactccacccatatttgggtccagagtttgtcttcacaatcaaacggtaccctcatgtatgtgcatcaggaggaggatccctagaactcgattctttcctatgcgaccactaatggcatc

SEQ ID NO: 13906 - DNA, 593 bp, Zea mays
  Clone ID: cC-zmpo148063a11d1
ggaacctcctcgcctcctccattgaccaacaattaagcctccccgactgccacatttattaggtgcagccatgggtgccggtgcaacgaggcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaggagatatagatggagaaggagaagccatcgctaagctaattgactgcatgtcaattggctgatgcctgatgatcaatgtgcaagaaagagatcgaccactaatttgcatacatgttta

SEQ ID NO: 13907 - DNA, 538 bp, Zea mays
  Clone ID: cC-zmpo148063a12d1
atatattatatatacaaataatcccctagtttctagtatatatatattttctgtacttagtatttaacagggggaggtaacgtcagcccaaagatttttactgtgacaaggtcctacaactacagccacctccactaggtttaccaaatgtgaggttaatccacagttctggtaccagccacagcgacagccacaggtcacatgtaataccagtacagctacagcctgacgcggacatttgtatgctagggcggcccagtgacaggaaaaagagcacatggccatggcagttgtctgtaagctatttttactgctactgctgcaagatcccaagccgggtcctatggatagagagagagagagagacgtgtgtgcgtgtgttttgcctgtggccttgtatggctttgacacctactgcaaaatactactgttatatgattatatattattgttctgcctttgttcccatctgtttgagtggatcctagtgtagttgacacccctacagaaagaatggaagcaaagtgagtgccttgcc

SEQ ID NO: 13908 - DNA, 396 bp, Zea mays
  Clone ID: cC-zmpo148063b07d1
acccgacataagctcccatgggcccggcaggtttcggattttcggtcgcttaacggcggggcacgtgggccctatacccccgtcaagctcgccgagtacttcaacaccaccgacggggtgttccagtacacatcatcgggacgtgccgcctcaagtccgcgcccccaagatggcccccaacgtcatccgcgccgagttccgcaccttcatcgaggtggtcttcgagaaccccgagaagagcatcgacaccatccacatcgacggctacgccttcttcgccgtcggcatgggcccgggcaaatggacgccagcgttcccgagcacgtacaacctcctggacacggtgagccggcacacgatccaggtgtaccctatgtcgtggaccggggtgatgat

SEQ ID NO: 13909 - DNA, 536 bp, Zea mays
  Clone ID: cC-zmpo148063b08d1
cctgttccagcccgacaactggcgccgcttcgccgcgttctataagcgttttacggagccgggcgcgcgggaggcgtgccgggggcaggttgagcgggaggccgagggcgtctcgcacgccacccagcccctcgtgcacgaggccgtcgtcgcgctcaccaactgaccggaccggccggcgttccccgtcgactgtgttcgatcgctagacggggtggcacgctgcgatgactacctgtatggcgagtccctatacttactcatacataagctgcgccgccgtgtcgtcggtgcgtgcaccgcgcagtagtgtgcgtacagcggaagctgcgactgcgagcgaggtaaggtgtggggtgggtgactggggtacggtacgtacgtgccacctttgaggctttggcgtttgctcagagcctggcaggagatgggtttgatgttctgctgctgtgttcctgaatcctacacctacagaatgtgctatgatttggactgctattacttttaacgaagatacaaacttctacaaaacgtgc

SEQ ID NO: 13910 - DNA, 535 bp, Zea mays
  Clone ID: cC-zmpo148063b09d1
tcctctctcggccttcttcgcgtgtttccctctttttctttttccgccttttacacttctcgacataaccatggggagggcgggcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggagaaggccagggaggccaagagccgggtggacgagttcgcggcgaggaaccacgagggccggccgatggagtccatcctcggagcctgcagcaacgggtacgacaacgttgtgcagacgctcgaggaggcgcggaagatcgtcgccacgcggtccggcggcgggcaccccaggcccaggcccgacgacatgaa

SEQ ID NO: 13911 - DNA, 534 bp, Zea mays
  Clone ID: cC-zmpo148063b10d1
ccgtaccggccgcagctgacggtggcagcgctgatccccttttccagcatttgacgggcatcaacgtgatcatgggctacgcgggggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggtacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcggaggtgttcgcgctggaggtccggtcggcggggcagagcatcgccgcgtgcgtcaacatgctgctcaccttcatcatcggccaggccttcctcagcattgctgtgctcgctcaagatcgggctcttttac

SEQ ID NO: 13912 - DNA, 433 bp, Zea mays
  Clone ID: cC-zmpo148063b11d1
accccgatgtcactcctctccttctcgctactacactccctttttattctttttccagggacgcacgcaagcgcgggggctgccgggaaagcggacagcgccatgacgccgacccctatcttctacgtccacgaggcggacgtcgcccatatccaccactttctcgaggagtgcttcctctgctccaaatatgtctcacgcgacatcttcatgatcaggcgtgacacaaccaatctggaccgacgagttctaggagcacacacatacaggcgcacagggccaaccacctacgtaagaaacacgcggaggtacacgcacttgactgacccaccatgtagcaccggcaccatgagaaaatgctgcagcaccaccaccaacagcactaaccgcacacgcggcatgccggcatggacaccacacacccgagggtcga

SEQ ID NO: 13913 - DNA, 584 bp, Zea mays
  Clone ID: cC-zmpo148063b12d1
tcctctgtccctctacggtgcttctgctcgccggcccatatacgcctcttttaccacgcccccttccaggctggcgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaggtgctacaacctgttcaagagcaactgcgaggacttcgcgaatactgcaagactggc

SEQ ID NO: 13914 - DNA, 566 bp, Zea mays
  Clone ID: cC-zmpo148063c07d1
cgcgtgcgctagcgatggctggagcctgggcactgctcatcgtcctcgcttttgccgtcgcggtcctggccgcgcgggcggcgtgtgcaggcgggggagccgcggccccggcggacatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgtcgacaacctctgcgcctgcaagcgcgccatcggcttccgcgacgccgtcaccatccgcgccacgatgagcatggtggcgcaggacacgcagaactgcgacgaggagttcaggaaggccggcttcaagaaccccatggaggaccacaacaggtcgctcatcgagatgtccgagatctgtcgcacgctctccaacatgatcccttacgaacatgtccattgattt

SEQ ID NO: 13915 - DNA, 551 bp, Zea mays
  Clone ID: cC-zmpo148063c08d1
ggaaaccatccttgcacccctcccctgcgtcaccccaccatatccggctctgcccatttaaaatgtcgcgcgccacagctgggggcctcgggtacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaggagttgagcccttcgccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttttactgagttcac

SEQ ID NO: 13916 - DNA, 610 bp, Zea mays
  Clone ID: cC-zmpo148063c09d1
gaccacgcgtccgcccacgcgtccgcccacgcgtccgcgccaagctctgcaagctttaccacgagaacctcgtcgacatgatgggctagggcgccgacggagaccagcggctgctggtgtacgagtccgtgcccgccggcaccttagaagaccacctgttcgatctgccggcggacaagaaaccgatggactggtgcacgaggatgaaggtggcgcacggcgcggcacaggggctggagtacctgcacgagacagcgaacccgccggtggtgtacggggagttcaaggcctcccacatacttctcgacgagaggtccacgcccaagctctccgacttcgggctcgcgcagctcggccaggcggggggcagcatgccggtggcgtcgcccatgatgggctccttcggctgctgcgcgccggagtacgacaggaccgggcaggccaccatgaagtccgacgtctacagcttcggggtggtgctggtgcagctcatctccgggaggagggccgtcgacaccagcaagcccgtggacgagcagaacgttgtcacctgggccatgccgatgttcaaggaccagaagagataccatgagctggttgatccactcat

SEQ ID NO: 13917 - DNA, 636 bp, Zea mays
  unsure at all n locations
  Clone ID: cC-zmpo148063c10d1
ccacccgtccgggaaattacaaaaaacttcagcagtgatgccctctttggcgatttctcgtatgccagagtctatttgggtgtgctgagggatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctncactctactcgcgttcttggcacctttggctaccatgcaccagaatatgccctgactggacagcttatcacgaagagtgatgtctacagcctttgagttgtgctgctggagcttttaacc

SEQ ID NO: 13918 - DNA, 412 bp, Zea mays
  Clone ID: cC-zmpo148063c11d1
ccggacacctcgagggtcaggagcaagatgctgtacgcgattttccaaggtttcggttcaagagggagctggaggggatccagtgggagctgcaggccaccgaccccagcgagatgagcatggacattgtcagggcgcgagctctctgaagaggaagacgcgcatccgctcgcgcgatcgccatgcatgccccggaacgacagaagctgtttgtcttgcatcgaccggcggcctctgcatgtacccgtgtgccgttttttgcaccgccggtgccagtgttctcttactccatgtaaactactctagacagtgctcggtgagtacagctgctcggtgagtacggtgtcacagtcactccgtgtaggcagtgccattttgaagacaatattgcaaaatttaactaacttggttt

SEQ ID NO: 13919 - DNA, 410 bp, Zea mays
  Clone ID: cC-zmpo148063c12d1
gcgccacctgtctgtcacattgttcattctgacggcctatgtcgcttacgactttttttccgaccgactgtgcggacaagtgttcggggagcacaactaccacaaggaaacaccaatcacccaaagaagagacggatgctcctgccaaggcaccatctgctgcagccaccgaggggcctgctgcgggagcgcccatgacatggccggatggcgggcctgagttcgtcaagatggtcatcaagaaccccttctttaaaagcgcacctccatctggtagcgaagacggcctacccattgaccccactccagaaggcagcatgaactaaattaaataccaattactagaccgaccatatatgcatggagcatgcaagaatgttgtccaactaatatatgctatgaatggttac

SEQ ID NO: 13920 - DNA, 588 bp, Zea mays
  Clone ID: cC-zmpo148063d07d1
gacgcgtgggcggacgcgtgggtggcgccagagatggtgcgcgtctagggcctctgcttcgccgtcgactggtgggccgtcggcgtgctcgcctacgagatggcgttcgggcggacgccgttcaagggccagaaccgcaaggagacgttccggaacgtgctgcagcaggagctcgagttcccgggggacacccggtggcggacgccggagctcgcggatctcatctcgggcctgctggagcgggacccgaggaggaggctcgggtacgccggcggcgccgacgaggtccgggcccacccgttcttcgccggcgtcgcgtgggacatgctcacggaggtgtccaggccgccttacatcccgccgccggccgacgaggacctcgcggacgtcgaagggttcgacgtgaggggccacttcaaggaccttcaccagccgccgcctcccaagtccgcgtcggagtcgtcctcgtccgagttctcgacggagttctgactgtgagctcgggctagcttcttttgcgctttggtcctcggtagattactatattgtaaccagagggtcgagggtgtctgtactgtacatacatgg

SEQ ID NO: 13921 - DNA, 534 bp, Zea mays
  Clone ID: cC-zmpo148063d08d1
tctcctctctccttccgtcgcgcgctcgtccggaccaatgtattctccttttgcggcggacacagtaagttcgggcttgccggggcgccgtcccactctccctggatgctatccatgagtgccggatcttgctccggcgcaaccgaagccgtgcttgagcaatcttcgtccgatttattgccccgccgagcagttcgggcggatccaaggcagcggcgatttggaagcaagcgacgacaaggcgcgtgcaccggcgacccaggaacggcggcgtcgccagcaggcctcggcggggaaggagattcgtctcgccgagctggaggatccgcctccatcttggttggctgacaatcggagaagggacggtcccaagcgtcgccgccttcgttgtcgaccgtacctcatcttcgttgtcccaagacggtcctaaaccttcttaccccaagcggcgtaggcagcaccaagatccattcgcattgcacacctcattacgccgttcctcatcttttggatctgcagcatattggaaaaatc

SEQ ID NO: 13922 - DNA, 513 bp, Zea mays
  Clone ID: cC-zmpo148063d09d1
gtcggcgacgactgcatctccatcggccccgggacctccatggtgaactttaccggcgtgacctgcggccctgggcacggggggagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggacgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaag

SEQ ID NO: 13923 - DNA, 503 bp, Zea mays
  Clone ID: cC-zmpo148063d11d1
cgccgccgagccatgacgatgacaatagccgccgtgctctgcctgctcctcttttctggccgtctcgccgcggcggggaggactttgggcggaggcggaggcggaggctacggcggcttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaggcggcggcgggctggaccccgacggcgacccagaggttgggctgaacgggaaggcgatcgaggagatcgtgaacgagcacaacgtgttccgcgccaaggagcacgtgcctccgctggtgtggaacgcgacgctggccaagttcttgcagcagtacgcggagacgct

SEQ ID NO: 13924 - DNA, 561 bp, Zea mays
  unsure at all n locations
  Clone ID: cC-zmpo148063d12d1
ccacccgtccggatctacctgggccgcgcctggggggactcctctgggtcgtttactcgtacacgaagatgggggagggggtggtgggcgtggtctgggacggctggcacatcgccaagccggagagcagcggcatctactacggcgagttcaagtgctttggccccggcgctgacgccaagaagaagaagagggtggggtgggcgctggacctcaccgaggcgcaggccaagccattcgtcggcacacactacgtcctcggcgacacgtggatccagccaccgcccaagtagcgacgcatgccacacgatatatctatttgagtacgaagcaaaagcgagagacacgaatctctaatctctttactgatgagatgttntgcttatatatatatatagacgagctaatgaaagctcagggttttcattagtaccgggacatcccagccaggtatacctccatacaggtaggcgtgcatccgatcgtgtacggttctgattcagacatattttagcgtaaaacgtgaaccaaactatcgtaaatgatattaaattttagtgt

SEQ ID NO: 13925 - DNA, 518 bp, Zea mays
  Clone ID: cC-zmpo148063e07d1
agatcgactgcatccagatcatctgcaatcatctgccatgatgcaagctcgagctcttcccaaggaggaggagtagaaggccatggcaccggccgccgatgctgcagccaagaagaacccacggcttcagcggatgacgcaggagcagatcgactccttgatccggtaccagaccgtgcacatgcccgaggaagccttccgcaggttgagccgaaggaccaaggagctgctgaccccggaggagctggcgtaccagggcgacttccccgtccccatgggccacatcgacgactacctcgccaacatctgcagagagatcaaccagaccgaggcgcggttcctgcgggagagggaccgcatcctcaacgactactacaacaaaggctacgcctacgccgatcaacaaccttcgtcgtcatcgtcgggtaaccggaggaggttcccacctgtgctcaccaagaaaaagcaaaccaaaccagtgggttaattagctagcgagagataccacttggtggaca

SEQ ID NO: 13926 - DNA, 531 bp, Zea mays
  unsure at all n locations
  Clone ID: cC-zmpo148063e08d1
cggcgaacgcgtgcatgcgcagacgttgaggacgaggttttcggnaatattgagctccatcggagagcgacgggccaccnggaggctttttcgcaagccgataagcgtgcccccccgggagaccggacgattattgatccgtagcagattctctaatggcggatacggcggacatggagcggatcttcaagcggttcgacaccaacggcgacggtaacatctcgctgtcggagctgacggaggcgctacggacgctgtggtccacctctgccgacgaggtgcatcgcatgatggccgacatcgacaccgacggcgacggctgcatcgacttcaacgagttcatcatcttctgcaacgccaacccggggctcatgaaggacgtctcaaaggtcttctgatccattacatcttcgtccatacgatacaattcgatgaatgaacctgcttatatacacacacatgtaccattcagcttcaacatatgaatttccatcagcttgcctgcctcgcctggccttaatgctgtccttt

SEQ ID NO: 13927 - DNA, 438 bp, Zea mays
  Clone ID: cC-zmpo148063e09d1
cgggagtacgtgaccatcaccaagactatgaagaacgtgtccctcttttgtgacggctccaagaagtccatggggaccggggggaagagcttcgccgacgggatcacgactttccagacagcaaccttcactgcgcaaggcgacgggttcatggcgatcgggatggggttccagaacacggccggcgcggagaagcaccaggcggttgcgctgctggtgcagtcggacaagtccatcttcctcaactgcaagatggacgggttccaggacactctgtacgcgcactccaaggcgcagttctaccgcaactgcatcatctccggcacggtggacttcatcttctgcgacacggcggcggtgttccagaactgcatcctggtgctgcggcggcccatggacaaccagcagaacatcttgaccgcgcatggccgcgccgac

SEQ ID NO: 13928 - DNA, 230 bp, Zea mays
  Clone ID: cC-zmpo148063e10d1
aataagagccaaccacagaaaccatataatctctttccgccgccaaccgagagaacaagggaacccatggagtcctttatgcaatccttctcccacctaccacctccaccgtaggagctagatggagatgaagaggatcctttttgccgttcctcttcgtcatcgccgcctcggccaccgcagtgctggcctctaccgaagcctccgcctatggctccccaactgtcttc

SEQ ID NO: 13929 - DNA, 463 bp, Zea mays
  unsure at all n locations
  Clone ID: cC-zmpo148063e11d1
cgaaaaaaaaaaaaaaaaaaaaaaaaaaaaaaaaaaaattttttaaattatttaaaaccaaaaaaaaaaaacaagaaccccaagaaaaaatttacaaccggnataacccccccaccctccccaacccggccaggcccaccataaccacttttataacttcccttaatttccactttctggccttacttcacatcctcctaactcgaaaaacccaatattttcccaacttaatacctttggccctcatccccctttcgccacctttgatcattactaataggccccttatgttcccccttccaaccctttgctccttctttattgcccattttaaccccccctttattgccccttttaccacacccgtttctttgggtttaatctcttttctctttcttctttcacccctttacccccctatcctttaattccttcccttctttacttccacattacccctttt

SEQ ID NO: 13930 - DNA, 343 bp, Zea mays
  unsure at all n locations
  Clone ID: cC-zmpo148063f07d1
cgcgtgcggccaggagaagcagngacaagncttttgcaccattttatgctctagcgacctgaatggaggcctatgtgataagctcatgtacgtttgtgccccagggtataacatcatatgtaatgtaacgagtgtgtgcacatgtaacatgatgaccgagaagagaaacatgcaaatggagaaggaatcgtttctgcctttctaggattcttcttagcacaatgtgcaaaactttttcataatgtaagagagttctggcgtcatacttcatcattgcatgaagaataaccaatacacaattattacaaaagttttaaattattgaacaatctaaacaaacata

SEQ ID NO: 13931 - DNA, 465 bp, Zea mays
  Clone ID: cC-zmpo148063f08d1
ggaggaaagcacagataccagccaccatgcgccttcccttttttgtcgacgaggccgccctctggggcgcactgcggcgcatctgccgctggcgggccgctgctcccgcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgttcacccagttccagaagtcggagcacgacgcggagatcaaccactcccttcccggggacgccttctacgccctggtgcgcgccaagctggccctggagctggagtgccccggtgtggcgtcctgcgccgacatccctccactggcgtcgggcgtgctgattaccatgaccggcgggccccggtaccc

SEQ ID NO: 13932 - DNA, 422 bp, Zea mays
  Clone ID: cC-zmpo148063f09d1
cgatgcgatccatcttgggcgggcgccgcgcgtcgagtttctccatttcttgccatggcggccgtccggtgggacaggggggaccaccaccaccgccgctccgaggcgtcctgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccattaccaccagctgcggcggtcggcggcgttcccaccccgcccgccggggccggggcgccgccctcctcagcgctgcgaaagcgacctcaacatcagggagcaccgctcctgcagcgaggtggccggcggcaccgctgcgggctgcgcccctgtgtgctgctgcttcccctgcgtcat

SEQ ID NO: 13933 - DNA, 532 bp, Zea mays
  Clone ID: cC-zmpo148063f10d1
cacctcatcctgcgcctctcgctctcgctggtgttgctcctttttcccacctgctcccggggcggggggcctcgggttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaacttacaacctcacagattcagaatttctgaaagctgatagcctgtcaaactcgagatgctggctcaactgcctcaacagctattattgtaggtgaccgtttgcttgttgcaaatgttggag

SEQ ID NO: 13934 - DNA, 249 bp, Zea mays
  unsure at all n locations
  Clone ID: cC-zmpo148063f12d1
gggagaaccagcagcctccaataagagccagccagatatactaataatactctcgccgccgccatccgagggggcaagnggaacgacctccaacccaaggcaacccgccgaccccataccaccaccaccgtaggagcgagatggagatgaagaggatcctcttcgccgcccacgacgacatcgccgccacagacaccgcaaagcaggcctccaccgaggccgacgccgcaggcgccccaacagcctccg

SEQ ID NO: 13935 - DNA, 494 bp, Zea mays
  Clone ID: cC-zmpo148063g07d1
aaaccaaacaagggctatggtctttctggttatattcaatcaaagcaaataaataggggctcttagtggaccatcacaaacctacacaggctaggcgcatcttgcatctgagctgagaaccaatctctcagcatccaacaaccaaacacattgtataactagagagatgggtcgatggtggttctagaagcatgcgagctccttgaggcaacccttggcgctgcccttagcgttcttgcatacggccatggtcttgttgttggtgccactgtacttgatgttgacgtcgtccatggtgacgcccgtgcatgggatcttggcagagcaaaacaagttgacggcctccggggtggaggaggtgccggtgatgttcttgaaggtgacgtccttgaccgtgaccttggaggcaccattggcggtgcataacttgttggggcagtacttcatgtcgatgatgatggggtagcccgaatcctccatcttgatattctcat

SEQ ID NO: 13936 - DNA, 344 bp, Zea mays
  Clone ID: cC-zmpo148063g08d1
gcgtgcggcgccacgacctctcctgctgacttttctggttttcgtgctagcggcggccgccgatggggccaacgggggccactccaagcccctgacgcctggcggccccctggaacacgacaaccacggcaaggtcactgccggtccgttgaaacccgcccacgcgaccttctacggcgggcgggacgggtccggcaccacggctggcgcgtgcgggtacaaagacacgcgcactcaggggtacggcgtgcagacggtggccgtgagcaccgtgctgttctgtgactgcacggcctgcagctggtgctacgatgtgcggtgcgtggacagccctatctggtgca

SEQ ID NO: 13937 - DNA, 457 bp, Zea mays
  Clone ID: cC-zmpo148063g09d1
cgcccccgcgcggacgcacccgccggcacctccgagggccctgctttcgccagttttccatcagctggagacgcgccggggtatggggccagcgccagcggcccgactgctgatgctcccgcgacggcggcggcggcggcgtcgtccgggccctctagcgcacccgcgccatcgtcgtctgagtcctccggcgcaccagggccgtcgtcgtctgatgggtcctccggcgccccggcgccatcgtcgtctgatgggtcctccagcgccccggcgccatcgtccggcgacgacggatcagcttgagcgtgagcgatgacgcggagtttgggtcatttcgtgcctactcagagacgacgatctcttcttccaattacaaattggccgtccgtttactcctcacaatgtgtaatgataataacggatgctactacgtaccgtacggataatgggtacgtag

SEQ ID NO: 13938 - DNA, 582 bp, Zea mays
  Clone ID: cC-zmpo148063g10d1
cgcctccggcgcaggtaccggccgcagctgacggtggcagcgcttatcccctttattcagcagctgacgggcatcaaggggatcatggtgtacgcgccggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggtacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcggaggcgttcgcgctggaggtccggtcggcggagcagagcatcgccgtgtgcgtcaacatgctgctcaccttcatcatcggccaggccttcctcagcatgctgtgctcgctcaagttcgggctcttttacttctttcgccggtggatgtttatcatgaccaccttc

SEQ ID NO: 13939 - DNA, 466 bp, Zea mays
  Clone ID: cC-zmpo148063g11d1
cggaaagaagtcgcctaattctttcgatcgaattaggtttttttcttcttctcacgctccgtctttatttgtggggtgaagcggacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagacatctgtgaaccccatctggcacgaggagctaactctgaccgtcacagatcccagcctagctctgaagctggaggtgttcgacaaggacacgttcagcagggactacccgatgggggacgcggagatcgacgtggcgcctctggtggaggcggcgaacgctagcccggaggcgagcctgaggaacggcgccatcatcctgtcggtgcggtcgagcgccacgaact

SEQ ID NO: 13940 - DNA, 488 bp, Zea mays
  unsure at all n locations
  Clone ID: cC-zmpo148063g12d1
cgcccccggtcctcgttcaaggacancgccggagaacggtagctgcttcttccccggctgntccaccgatccgcgcgctcgacgtgggtgcggcgatgcatgaccgggacagcgacgtctccaacgcacgcctgtcccagtgcgcgcgcatgctcgaagcgaggggcattctcgtgaacagcttcgactggctggaggcacgggccctggaagcgctcagccgtggcctctgcacgccggggcgctcagctccgccagtccactgcatcgggccgctggtcctcgctggaaacaagggaggggccagcgagaggcacgctcgtctggaatggctggacgcccagccggaccggagcgttgttttcctcagctttggcagcctgtggaggttctcgatgccgcagctgagagagatagcacgtggactggagaactcccggcagaggttcctgtgggtcgtccggagcccgcctgacaccggagcaact

SEQ ID NO: 13941 - DNA, 503 bp, Zea mays
  Clone ID: cC-zmpo148063h07d1
cgccgacgcgaacgcggacgcgagggctggcgccccgttttcgccgttttaggctcccggggccctctcggggggacactagggcgggccgtgacgacgacgacacacgcgactgcagggcgcgtttcgccatcgaatctcccttcttcgccgctgccagagggttttcagcagagactcttgctccaagaaaccaggatgtgggcttatctgagctcccagcaactgtggcagctgtgaagaatccaagtggaaaaatcgtgtatgatgagtataaccatgagcgctacccacctggagaccccagcaagcgtgcatttgcctactttgtgctgagtggtgggaggttcatttacgcatctttgctgcgacttatcgtcttaaacatttgcctaagcatgtcagcaagtaaggatgttctcgcgcttgcctcacttgaggttgaccttctaagcattgagcctggaaccacggtgaccgtgaagtggcgtggcaagccggtc

SEQ ID NO: 13942 - DNA, 624 bp, Zea mays
  unsure at all n locations
  Clone ID: cC-zmpo148063h08d1
cgccnccgaccccgagaagagcatagactccctccacctcgactgttacgcctttttcggcgtcgggatggggcctggggcgtgggcgcgggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccgctttcacctcgtgttctgaccatccagtctaactaatccattcctgtgctgctcggcgaaataaaatcatcaaaaagaacatagacgaaggatgcctagggaaggggagaagggacgttgggtgggggtgagccaaatgaaaacgcacggatatatctattgatgtaatcttgagatgccctctcacatcactgtaatgggggttaaaaaacaatcattgtatgggaggtatat

SEQ ID NO: 13943 - DNA, 516 bp, Zea mays
  Clone ID: cC-zmpo148063h09d1
cgcctccggctagctagccagccagccagcagccagcttgctcgttgcgccctttcttcttcctcgcctccgttccgggccgttcgagcccgcccgccgccgccgccgcattcagggatggagatgaagaacatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattcgacacaccttttgtcctctttttctttgttccctctttctccttaatttaacgaattgatgcatgccgctgatgttcttccccctgagagagggattaacacttgtatcatcgcttgccatt

SEQ ID NO: 13944 - DNA, 500 bp, Zea mays
  Clone ID: cC-zmpo148063h10d1
cgccaagcgtcaaacttgtcaagcagctagcaaccaacttaagaaagtctccatacccatggctcgcgctagggtcgtcttgggcgttgctgctctcctcttcgtcgccatggtcgtggcaccgatggccgaggcaaagtccgctgatgccccctccgccgatgcccccgcccccgctgctgacgcacctgccgatggacctagcggaccggcaggtgcacctggtccccagggcgtcgagggactatcgggcaatgaggacgacgacgatgactccaccaactaaggccaagcacgtcggtccgattgcatttggaacaagatatgaaagaaaagtgagagcaatgttgtttaaaaccaaaaatccataataatgtgtggtcatccgtgatatgttcttgctctccctctttttctttctgtttgatttcgatgtgttatcatgttcttagcctctaattgtatcaattcttgatatcaaggactccaaaattatcgtt

SEQ ID NO: 13945 - DNA, 436 bp, Zea mays
  Clone ID: cC-zmpo148063h11d1
gggacaggtatcaccatcggcgccagcgcttccttgtcccatttcctcttccagccatccttcatggggatggagggtgccggcatccacgagaccacctacaactccatcatgaagtgcgacgtggatattaggaaggacctgtacggcaacatcgtcctctccggtggcaccaccatgttccctggcatcgctgacaggatgagcaaggagatcactgccttggctcccagcagcatgaagatcaaggtggtcgctcctccagagaggaagtacagtgtctggatcggaggatccatcctggcatccctcagcaccttccagcagatgtggatcgccaaggccgagtacgacgagtccggcccatccatcgtccacaggaaatgcttctaattctttgggcccgagaaatgcaagccgtgggggagccgttacc

SEQ ID NO: 13946 - DNA, 302 bp, Zea mays
  Clone ID: cC-zmpo148064a01a1
attacacaatttaatgaacttgatacatacttcaatagattttcaattatttggtcagctggtcttccataaatttgtcaactggcctctacatcagcttttcatcggtgctctcttgatgcaaagattttgctttggtttctcttgatgcagaaccttctcatctacatgtcatctggcttgtcatgttgcataggcttctccaagccataagaatgaagtatagacgctattgtttggtgcaatgtcaacctttgctttgctggaactaagtcctatgaaacctacatctgcttttattt

SEQ ID NO: 13947 - DNA, 394 bp, Zea mays
  Clone ID: cC-zmpo148064a01d1
tgccggagaagaccgtcgtggaggaggagaagccagcggcagccgtttatgctttggaaaaggtcgccaccgccgggggtaccgggacgactgtggaggcgaagaagaacgacgtcgaggaggccatgaaggagaagcaggcgcagcaaatctgaccgactgtgcgtgcatgcgcgtgccaactaatataattattggctgatgatacctgatgatcagtgtgtgatcgagcaaggagacgacacttgaattctctacagttggcatagcggcataggtcgggagagacactctcgactggccacaccatgtaacaaactaaccttcttcgatgtctcccattattttgctgcacggagttcttctgatgaaacaacatgttctaattgggctt

SEQ ID NO: 13948 - DNA, 253 bp, Zea mays
  Clone ID: cC-zmpo148064a02a1
aagacgaagactagcacccagggggggggggagcgcgaaaagttcatacatttgcccatttctgttcttttttacagccatgatacatatcaaagaccattaacatgagccaaactgaaaaaaggctccagatttttacatggcaccaacccggcatgctcctgctccttcctatgtacattgggaccaaccaacgggccaagctttcaagcggcagcaaccatggcaatattgcttatttcggacacgtgag

SEQ ID NO: 13949 - DNA, 259 bp, Zea mays
  Clone ID: cC-zmpo148064a02d1
ccacgcgtgcgaactgagcaatattgccatggttgctgcctgctagaattcttggcccgttggttggtcccagggtcatgggaaggagcaggagcatgccggcttggtgccatgtaaaaatctggagccttttttcagtttggctcatgttaatggtctctgatatgtatcatggctgtaaaaaagaacagaaatgggcaaatgtatgaacttgccgcgctcttgcgtgaactgggtgctaatcatcgtcttactactc

SEQ ID NO: 13950 - DNA, 424 bp, Zea mays
  unsure at all n locations
  Clone ID: cC-zmpo148064a03a1
aaacttaataacccantancaagggggggggataaagtcttacaacgtaagttgtcaaccacacaacgacagatagataagaaccgacagaaacataacacgataggagccactcagggcacatcacaggatagcagtggcacacaagcccgacgacgccgcgccagtagagcgtctaatactcgtcaccctcgtcgccgtccttaccctcgtgaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagataatgcacacgggacgctgcacctt

SEQ ID NO: 13951 - DNA, 569 bp, Zea mays
  unsure at all n locations
  Clone ID: cC-zmpo148064a03d1
gatggcctgatgcccggtgacaagaccattgggggaggtgatgatgctttcaacaccttcttcagtgagactggggctgggaagcacgtcccccgtgctgtttttgttgaccttgagcccactgtcatcgatgaggtgaggactggcacctaccgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgactatggcaagaagtccaagctcggtttcaccgtgtacccatgcncccaggtgtccacatccgtggttgagccatacaacagtgttctgtgcacccactctgtgctggagcacactgatgttgctgtcctgctcgacaatgaggccatctatgacatctgccgccgctcccttgacattgagcgccc

SEQ ID NO: 13952 - DNA, 399 bp, Zea mays
  Clone ID: cC-zmpo148064a04a1
atctatatattgcaattctttacgccggggcaaaatatgaaaatattcgcaagtattctgcgtccacaatagtagcatgccatctccgaatagaaaaaaataggtggccgatactccagcacaactcaaaagcagaatttctgccgacaaaatttggctgtccgttgttggtcaatatatgcaagcagctcatcctgccgaaccaatgtctcatacaagaccttcttcatagaaattagttcagcttccaacacacccacgcggttaacgaaagtatgcaacaattcctgcttttcaaatggcacttggggtggctttgcttcaattgcctgtaccttctcctccaattcaccaagccgtgccaatacagatgtaagggtgccatttcctgtatatcct

SEQ ID NO: 13953 - DNA, 598 bp, Zea mays
  Clone ID: cC-zmpo148064a04d1
aacacccgtcccgaaggaatttggtgctgacgatatagaggaattcgactacacttgtattattatgaagttgtgaagtactatccagggctttgccatggtgtggacaaaggagtttgagagatgtctccagatgaggtttccagcttgttctattgctgcaaaaaggcacatagactcatctactgcgatattggatgtgaaaggcgtgggcctaaagaacttcacaaaagttgcaagagagctaattatgcggttgcagaatatcaacaataacaactatccagagaccttacagcaactgtgcatcataaatgctggccaaggcttcaagatgttatggggtacaataaaatcatttcttgatccagaaactgcttcaaaaattcatgtccttggaaacaagtaccaaactaaattacttgaaataattgatgacagtgaactaccagaatttcttggtggcaagtgcagatgtgaagagatggacgttgtctgaaatcaaataaaggcccttggaaggaccctgacattgttaaggttatcaatggtgaggcagactatgttaggcacgttattgctgtatcaaacataaatc

SEQ ID NO: 13954 - DNA, 400 bp, Zea mays
  unsure at all n locations
  Clone ID: cC-zmpo148064a05a1
cccnggcacggggtacaaataaaaaacagtggcacacctttctttgcaaataacacaacattttactttcaagtaccaacaaaacatacattggtttgggccttaacaagaaagcccaaacctcaaaaatgttttgctctgttcctttaaacccccggtataacccaggggagttcccatcaggggtggcctcaaaaaaaaaaatgaccacccccctaggaaaagaatgggtgggtttttaacaaaaaccctatataatgtttttttaaaaaatctggcctgggtaaatttcccattatattacacattggccttcaaccttataaaaaacaacttaatcctttaaagtttcccccaatatgttacttggccccttcccataaaccaccttttttttttt

SEQ ID NO: 13955 - DNA, 533 bp, Zea mays
  Clone ID: cC-zmpo148064a05d1
gacactcgatcggggaggttcattgggaagcaatcccgttcttatttagacatggactattgctggtttggggaccggaaaaatgttgctggagaacccagagctggcttctattctgacctgtgatgaggaccttgagctgctcgaaggctgtgcttgctgcctgtccaagaagaggacaaggtgctcacggcgagcggccaagtcacatgctgcgtgaaactgtgaagcttatgtcgttttttatactgttgatgcacaatgtgtactaccaacggagaattaaccaagacagactcttcagagatacattactataggtttatgttagatacccatccattcatttgctaggtggttgctcattcttttttgctgagctaccactgatgggaactaccctgggtgataccggtgggtgaaagaacagagcaaaacatatttgaagtttgtgctctcttgttgaaaccctaaccatggtatgtcttgttggtacttgaaagtaatatgttgcgtcatttgcaaaccaaact

SEQ ID NO: 13956 - DNA, 453 bp, Zea mays
  Clone ID: cC-zmpo148064a06a1
tcggtctccaccatggcggtttattttttctcgacgggaggagggcccaccggtcggggcgacgaccctggctgcgacagccccgccatctggtcggggtcgatggagctgatccgtatcaccgacgtgctgccgctgctgttctgcgggttgttgaactcggagcacgtcttcctgatctcgccttccttccccgtgagcaccttgagcacgctgagcttctccatggccttggcgaagatcgggacgaagtcggtggtcttgtccgacatggccttcactatgggctccgtcttcttgtccatccccatcaagcggtcgatggtgagcggcatcttcttctccagcaccaggccgaagtagcttccgtccaggtcgttgggcgaggtggagtccatggggacggagcccgagtccttgccgtcgcacgcgtcgctgatcgtctttcttgta

SEQ ID NO: 13957 - DNA, 394 bp, Zea mays
  Clone ID: cC-zmpo148064a06d1
acctacatcctgaccaactaggtttccaaccaggcctccgaccccaagggcggcgggaacgtctacgacatgatctacgacatcatcacggagatcaagacgaagctcccgaacaagtgcccgagcgcggacattatctcggacatcatccgcgacagcgcccaccactcgggcaagcccacgggcgcgccccccttcgcgctgcccctgtcgctggtctactacctcgagtacaaccacaaggacgccgaccacctcacgggcccgcacatgctgatgcccaagctcatcaaccagtgctacaaccattactacaacgtcgcgatgctggtcgttatgctcagcatcggccactgcatgtgcttctgcatgtgcacctacatcgagaccaacg

SEQ ID NO: 13958 - DNA, 533 bp, Zea mays
  Clone ID: cC-zmpo148064a09d1
gtccgcggacgcgtgggcggacgcgtgggcttttgttcgggttcatgttcgaattccaaagagtggaaaacaagcagaggggggaatatacatgccatttttggaggcactttttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaaaaaaaaaattttactaccccggcatggaaaaaaaaaattttttttatggggaaaaaaaaaaaaaaaaaagggcccccttttaaaaaacgtggaaatggaaaaaacctgggggaaccaaaaaaaaaagccttgaaaaaaaatcccctttttcaaaatggggaaaaaaaaaaaaagcccccaccaaatcccctttcaaaaaattgcccaacccaaaagggaaaaggggacccccctttattggtaaaaaaaccgggggggtggggg

SEQ ID NO: 13959 - DNA, 291 bp, Zea mays
  Clone ID: cC-zmpo148064a10a1
aaaattggatcagtgcactttggtgttggaacaggcaatacacggtgaataaactaccatcatatgctcatttaatcactctggcctcaatttaacaagagaaattcggacgcaaatgtgaccgccatcgtgtcgtccagtagatcggctgaggacgaccaaccaaccaaccatttacactcatcagtggccatggccgaggatcatgaggtggggctggaacttgcggagctcgtcctcgtcaccgtcgccgtcgaggtcgaatgccgcgcccggtagtaccacccccac

SEQ ID NO: 13960 - DNA, 544 bp, Zea mays
  Clone ID: cC-zmpo148064a10d1
cacccgtccgcgatctcttgcgaaaaagcttaccctgtgtctgtctgtccgttcgtcagtccgtctaacaatcgatttccatggcgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcagttccagccccacctcatgatcctcggccatggccactgatgagtgtaaatggttggttggttggtcgtcctcagccgatctactggacgacacgatggcggtcacatttgcgtccgaatttctcttgttaaattgaggccagagtgattaaatgagcatatgatggtaatttattcaccgtgtattgcctgttcaaacatgaaagtgcactgatacaattttaaaaaataaaa

SEQ ID NO: 13961 - DNA, 452 bp, Zea mays
  Clone ID: cC-zmpo148064a11a1
aatattctgaatccataaacaaatgttggggggagggtcttcacacaatggatggatccctgcgtggtgatggcacgattcaggcaaacagaattttgctcaaaccgatacatgtacccagggggcatgcagcaacactcatctacttacataagcgcagagggcttgttacatcgacatcttctcatcttttctggggcaagggggggtgataacctcgaacaaaaaataatcacacatattgcctatcttataccacaccacatttggcaatgtccatctccggcagtttctaacagacagtaacttggtgctcagctaattatcgagccgtcattcttttatccagagatcaccaccctaccaaggcacattgttttcgtgcatgctgagggaccattttacccatgaaatcccgcggcccctttttaaatttatggggcttaaaaatt

SEQ ID NO: 13962 - DNA, 590 bp, Zea mays
  Clone ID: cC-zmpo148064a11d1
ccgggcatttccaccacggccccccgccccctctctctctctctttttctttttcttcaatcctccctccccgcgggggagggggaggagggagaggggacaagctttccggcgccgacgccgacgcggaccccgcgccgacacgatccggtggatcaagtgcatcacacctttagggaggccccttggacagcagtttgtgctgcaaattctatatagctctgtcgcagcatggcctcggtgggcgtggcacgctcttctttgggatttcagaatggcacaagttctagcagtgacccacatcgtcttcccaacgagttgggcagtatgagcataagggacgacaaggacgttgaagatattgtagtcaatggcaatggggcggagcctggtcatatcatagtgaccagcattgatgggagaaatgggcaggcaaagcagaccattagttacatggctgagcgggtggtaggtcatgggtccttcggaaccgctttccaggccaagtgtcttgaaactggtgagaccgtagctataaaaaaggtttcttcaggacaagagatacaggaatcgtgagctgcaaaccatgc

SEQ ID NO: 13963 - DNA, 397 bp, Zea mays
  Clone ID: cC-zmpo148064a12a1
tctcttttttttagtacaatttatcatgttatagaatcatatatgtgggcgggcctacacacgtgcctctcaagtctcaacgagccgtttcatcccacggtctcaagacatgtgccacgccgcaagaggcaacaccgaaaagaaggacactcgctaggtccgcatgaagtctgcatgcctccagtctatctactgacagacacacgcgaccagcatcaaattacatatgttttaggccggacgacgacgaccacgacgacgttaccgaacgtagtatggggtcgggaaaaagaaacaaacaaatcaatggacatgttcgtaagggatcatgtttgagaacgtgcggcacatctcggacatttcgatgagcgacccgttgttgtcctccatggggttc

SEQ ID NO: 13964 - DNA, 558 bp, Zea mays
  Clone ID: cC-zmpo148064a12d1
gtccgcagctagctagcgagggctggagcctgggcactgctcatcgttctctttgctgccgtcgcggtcctggccgggcggggggcgtctgcaggcgggggagccgcggcggtggcggacatctgcatgaagactccgtcccccgacctgtgcaccaggacggcggggaagcacgccaacaagtacaaggtggtggacgcggtgacggtgctagagatgcacgtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccacatgatcccttacgaacatg

SEQ ID NO: 13965 - DNA, 364 bp, Zea mays
  Clone ID: cC-zmpo148064b01a1
gtatgtctctcttggggtagggggaaccgtatctgtgacactaatcaactatgcaagcaaactaatacttgtggaagggtgtcaaggacgagttcatagaggcttggatctcctccagggttcttcctttggtttccggcactagccgatgcacaaacacgaccgtgagtccgcaaatggccgcgaagatgaagaaggtgccgtaagaacttcaaatcaacaggaagttgaaggcgtacgatacaatccacgacccgagccaacttactaaggtcacaaggctccctgccgaccctttatgtttatagggaaaatctctgacattataacccatggtatcccgcccatacccagtgaaaaggat

SEQ ID NO: 13966 - DNA, 550 bp, Zea mays
  Clone ID: cC-zmpo148064b01d1
acacccgtccgaaccgaatctctgaagaggcctcagaaataaaagttttactgaaattcttcagcgccttccgaagtcgaaggggttggacctgtttcagaaggagtacatccgtgctgtcatagctggagttgggctcatggccctccagcagcttgggggtgtcaatggcgttctcttctacgccagtgaagtgttcgtctcggccggtttctcgtcgggaaacacgggaacagtggccatggcggtagtgcaggttccgatggtcggactaggggtgcttctgatggacaaggctggaaggaggccactgttgatgatctctgcagctgggacatgcgtgggttgcctgctagttggtctgtcattcttgtccaaggagcagcactgggaaagggacctgaacgtgttggctttggccggacttctggttttcatcggatccttttcactgtgtatgggcgggataccatgggttataatgtcagagattttccctataaacatgaaagggtcggcagggagccttgtgaccttagtaagtaggctc

SEQ ID NO: 13967 - DNA, 418 bp, Zea mays
  Clone ID: cC-zmpo148064b02a1
aatgtaaactttgagctttcattagctcgtctatggataggggtaagcaaaacatctcatcagtaaagagattagagattcgtgtctctcgcttttgcttcgtactcaaatagatatatcgtgtggcatgcgtcgctacttgggcggtggctggatccacttgtcgccgaggacgtagtgtgtgccgacgaatggcttggcctgcgcctcggtgaggtccagcgcccaccccaccctcttcttcttcttggcgtcagcgccggggccaaagcacttgaactcgccgtatgacatgccgctgctctccggcttggcgatctgccagccctcccagcccacggggaccacctcctaccccatcttcgtggaccagtagacgacccgggaggagtccccccaggcgcggcccaagtagatc

SEQ ID NO: 13968 - DNA, 478 bp, Zea mays
  Clone ID: cC-zmpo148064b02d1
acccagtgcccccacgcgtgcgcccacgcgtgcggcggcgctggaggatatctttgtgttcaacaccaagcgcgtgatcctgggggtcaggcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgctggccaagcccggcgccaagggcggccaggcggtggcggtgcggctgttcgggaccaagacgcagatctacaactgcaccatcgacggcggacaggacacgctgtacgaccacaagggcctgcactacttcaagggctgcctcatgccgggcagcgtcgacttcatc

SEQ ID NO: 13969 - DNA, 246 bp, Zea mays
  unsure at all n locations
  Clone ID: cC-zmpo148064b03a1
aaccggggagggtatataggggccggcctttttttttttctatgcaaatcgtgtctaggacgggacacccccttgnnngggggggggtaatactataatactgaagacccctccctccctgcatgtataatgaaaccaaccataccttctttggcttaaaggtgcatgcaatgcaacgcggaataactgctattaactctggatccatgacaacctatttttttaaatccatcttacttggggaaa

SEQ ID NO: 13970 - DNA, 302 bp, Zea mays
  unsure at all n locations
  Clone ID: cC-zmpo148064b03d1
atcacaggtaagagctctacctcaccacccatctttattttatcctacccctangaccaataagagggccgggttaacatcataactcctaatcactccccacaccatatatgtcctgcatgtatcccatcaactaccactatcaaccacactcttaatacacccaaacccataatcaaccttcccacccatccatctactgcgaccattacctttaccacatcacagccttcatcatctacaacaacaacacccccacctacattattcattatacacaccatctgcacaccatcctgcat

SEQ ID NO: 13971 - DNA, 497 bp, Zea mays
  Clone ID: cC-zmpo148064b04a1
cagcatgcctttttattattatgcgttcagttgatgaaaaacacacatttgcgtgacattacatttggagttccatcgacggtatatatatttgaacaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatgcatggttcattcatttcaaggggcttcgcttcaagaaggaggaggggtgcaagacctcttgcagttctcgctgaggcgcgggttcttctccttggcgcacgtgacgctgcaggcctctggtgacctcggccgccttcaacacgtacgccttgtcgcacttctcctggcagaccttcatggccggcgccgtgatgcccttctgctcggtgcacttgcccttgcactg

SEQ ID NO: 13972 - DNA, 539 bp, Zea mays
  Clone ID: cC-zmpo148064b04d1
acaccaagctaacaacagccagctcgcgaaaataatgaatagccgtatgcatggcatcatcggccgcgcggggggtgctagccctcgcgctagtggcggccaccgccccacaggtagcggaggcaaagaagaagagagcggcggagagcggcgaggcggcggaggcgaagaacatccaggacgacttctgctcgacgctgtgcgagggcaagaaggggacggacctggtcgtgtgcaaggagtcctgcgcgctctcccagcagtgcaacctggtgctgtacggcaggatccagtgcaagggcaagtgcaccgagcagaagggcatcacggcgccggccatgaaggtctgccaggaggagtgcgacaaggcgtacgtggtgaaggcggccgacgtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatg

SEQ ID NO: 13973 - DNA, 381 bp, Zea mays
  Clone ID: cC-zmpo148064b05a1
ctcattctctttattcaatattaaataaaaaaggcaagggtttattttataataatttattacccccaccaaaaataaaaattaaataaaaattaaaataaaaataaaaaaataaaaaaatcaatataacaaaaaacaaaaaacattaaaaaaaaaataataaaaaaaaaaaacaacatactcaaatcaaataaaaacaccaaaaaaaaaataacaaaaacataatataaaaaaaaaatactacaacaatattctcaataaaaaaaaaaaaaaaacccctcctaaaacactacaaacaccttaataaaaaagacccgacaaactaactcctccctcataaaaaaaaaaaaaaaaaaaaccccctcacctatcaaattaatt

SEQ ID NO: 13974 - DNA, 366 bp, Zea mays
  Clone ID: cC-zmpo148064b05d1
gaagaacgtctcgaatttcctcgtccaggccggcattgtgaattatgatctatcatcaagattcatggtttctgagggaccggcgggtccatagcaaaccaaccctgcatgcagggccagcttattatatataatatctgaggtggagcatatctatctggctgtgtactgcaagcaggcctagtacgccgcctgcgcgttcctgctattacacatataggcccctccctgcgtgtatgcttgttaccgtcgtgtcgaaccttgtactacgaggctccatcgaacatcgatggcttgcttctttatcagaacatgtgtgaataaacgctatttggtgaaaaaaaaaaaaaaaaaaaaaggaacaaa

SEQ ID NO: 13975 - DNA, 444 bp, Zea mays
  Clone ID: cC-zmpo148064b06a1
gatcacaattttattggtccgacgtatattatatgggccggggggcctctatatataggagtccaactctatttagcaggaagatcagacaagagatgtcccgctaaacaacttggctgaaacacaatcgaatttggaaaagcgaatgaagcggaaattaaaaagaactagtgagctacatcatcatcaaggatgagataccatgcatgcatgcaaaaggaaggtcatcatcagaccaggcaagccagtgcctcgatgcttcccttggcggtgcccttggcgttgctgcaaacggccatggttttgttgttcttgccggcgtactccaccttgacatcgatgagggagacgccgctgcatggctgcgtctcccagcagagcaggctgatggcctcgggcgtggacgacgtgccggtgatgttgcggaacgtgacgtccttgacg

SEQ ID NO: 13976 - DNA, 519 bp, Zea mays
  Clone ID: cC-zmpo148064b06d1
cccaagatcagcatcctgaactcgaccatcggcaccggcgacgacttcgttttgattgggcccgggtgcaacggcgggttgggggacagcatcacctgcggccccgggcagggcatcagcgtcggctgcctaggccgctacaaggacgagaaggacgtgagcgacatcacggtgcggaactgcgtgctcaagaacaccaccaacggcgtgcgcatcaagtcgtacgtggacgccgagtgcgtgctgacggcctcccatctcaccttcgagaacatcaggatggaggaggtggccaaccccatcgtcatcgaccagtacttctgcccgcagaaggtatgccctggcaagcggagcaactcctcgcatgtctccgtcaaggacgtcacgttccgcaacatcaccggcacgtcgtgcacgcccgaggccatcagcctgctctgctcggagacgcagccatgcagcggcgtctccctcatcgatgtcaacgtggagtacgcctgcaagaacaacataaccatg

SEQ ID NO: 13977 - DNA, 283 bp, Zea mays
  Clone ID: cC-zmpo148064b07a1
ggggctcgggataaaaaaaatcctttcacttgacttcaattataatgcatgtccccccaaactttacaaaaccatccggttttatttccccttccatccaatcgaaacaacattaaccacccttacccccttcttaaaaaaatttctttttcttccatcaagaggcaatggtaacaggaacaatactttccatttattatcaggtcaccttgttttttcaccaccagtatcacgacccagagggaaactcaccctctccaacttcaactgtttttcccccctt

SEQ ID NO: 13978 - DNA, 231 bp, Zea mays
  unsure at all n locations
  Clone ID: cC-zmpo148064b07d1
cgtccgcccacgcgtccggcgaaaggcaagggacgtaagaagtcccctttctctctgatcgaatgacacgacttcttnggggnggggttttattaacactctaactccgtaatctccctgatctaatcaaagacttgtattacttttggactgaatggtaagccttttgaaagatcgcgtggatcggggtaccaaccttgtctaccgcgacgcatgaggcagcgatccgta

SEQ ID NO: 13979 - DNA, 400 bp, Zea mays
  unsure at all n locations
  Clone ID: cC-zmpo148064b08a1
tttttctttttttttttctttttcacattcctgaactttaagccnnggttgggattaacattagtggctcatttaataaaatcaatgcttgtcgatgctttgttgcgttgcctatcctattaaccacgttgattgaaccttgctatgggcatgacagttggcatccaattttctgcactacaggcacaaccatcgaacaccacggacaacgactacgacgaaccaaagcaggtccgtttttccctctggggtggcaaaaactgcatcaaccttggtgtcactaccgccattaggcccataaacaaccccaggctgaggtccagggatggaggctacgccactcccacgaccatcacccacagtgactcttcattggggagcctgaggacaatttgtaccc

SEQ ID NO: 13980 - DNA, 522 bp, Zea mays
  Clone ID: cC-zmpo148064b08d1
cacccgccgctgaacggagggtgtcccctttcctttactgtaggcctaatttgtttttaagggaggcaaacccattattagcttgcgataggtttatttgttttaatctcaatacatgtggattgaaggggattaagtgagtttaaattcatagcaagtcaaaatttctcctaatccctcccaattgtgggatgggaataaccgaacgaagccctatgaagaactactagtacaatgcccgtatattgtgacggcgtacaaatcgtcctcatgctccccgatgcatagtcactgtgggtgatggtcgtgggcgtggcgttgcctccatccctggacctcaacctggcggtggtcatgggcctaatggcggtcgtgacaccaacgttgctgcacttcttgccacccaagagcgagaagcggacctgctctggttcgtcgtcatcgctgtccgtggtgttcgctggttctgcctgtcgtgcagcaacttggatcccaaccgtcatgcccataagcaggttcaat

SEQ ID NO: 13981 - DNA, 449 bp, Zea mays
  Clone ID: cC-zmpo148064b09a1
atactaagatattgcatggaagggggcggggattcccgtacccttgatagtgtatagctgtacaatgcagaattaaacacaacatgtaggtacatattcacttgatccgatacaccagagttcacaaaaaaaaactctcttgccaccccaaaacccacataagtacacctaaggaaacaagaacacaggactcctccggccaccgtggacgccgtcgtctccggagaccagcgagatcagccgcatcagcggcgctagagatggtgggctagtctccggagaagactgtagctacgtatatcttgcgacctttgcgggcctcctcggtgagctcggactgcatgctagtccttgctgcctagaaggtcggaggaggaagtggtggctagctggttgaggcccgtggagtgtctttgctctaccgcccactgtgcctcgcgatcgccggc

SEQ ID NO: 13982 - DNA, 646 bp, Zea mays
  Clone ID: cC-zmpo148064b09d1
acccacgcgtccggacggcaccatcatgaccatctccaaggaccgcgtcaagccgtcgcccacccccgactcgtggaagctcaacgggatggtcgccaccggcatcgtgctcggcacctacatggccatcatcaccgccgtcttcttctacctcgcccacgacaccgacttcttcacggacgtgttcggcgtgaattccatcaaggagaacgacagggagctgatggcggcgctgtacctccaagtaagcatcatcagccaggcgctcatcttcgtgacgcggtcccggagctggtcgttcgtggagcggccgggcttcctcctgctcttcgccttcttcgccgcccagctggtggcgacgtgcatcgcggtgtacgccgactgggacttctgccgcatccaggggatcggctgggcgtggggcggcgccatctggatgttcagcatcgtcacctacatcccgctcgacgtgctcaagttcatgatccgcgccgcgctcaaagacaaggccacgggcaacaacgtccacaacaagtgatacgtttctctgggtgctcgtcgcggacggccgttatgaacaaggactgcggcatgggcccgccatcgcgaggcacagtgggcggtagagcagagacacttcacgggc

SEQ ID NO: 13983 - DNA, 346 bp, Zea mays
  Clone ID: cC-zmpo148064b10a1
ccacaaaaaaaaaaaaaggggccggttaaaatcacataaccaaaataatcacttgcctcacaaaaaaccaattcaacatcttatttccattccaccaaacaacatgacaacctaaaccccaaaaaaaaaatcaacccattttgcatggaaaggaaaaacaatggccttcatttaattcccaacacgatcttctgtgtccttccccctccttatcttggcccgcgtcacacttatcgtctcctccatcggcgtctccttttcaaacccagggtcaacctctttttcaccctctagggcctcaccactggcctcttcaatggccattttatcccccccttcggttcca

SEQ ID NO: 13984 - DNA, 592 bp, Zea mays
  Clone ID: cC-zmpo148064b10d1
cgaccacgcgtccggttttggagagattcggagatttcacaatatcatggttaccgttttactcggaagcaaagctgatgttctttggatagcgtgtggtaccctaagacaaagggaactacgtatgtttatggaactttctttaaaccatatatttctcagcatgagaatgaaatcgaccggaatctccttgagctgagagctcgagccaccgacacggttgtcctttattttcagaaggctgcttcggcaggacaaagtactttctttgacgttttaaaatatgttgctgcccagtcaccttctcagaaatccaggcaacgccttcatcgggaatcacagcagccgccacaacaacagcaaccacaagtgcaggtgcagcaggcgcaaccacaaaaacaagcggcacctgttatgcgcagagcatcatctattgctgctcggcaagcagcaatggcacaacaatctcaggagactaaacccatttcatcttcgcccaagatcaagcgtcaaacatcagcgagatctggttcagtggcatccacaaagcctccggtagctgcatccgcgctaaaacctggtggtagcccaa

SEQ ID NO: 13985 - DNA, 225 bp, Zea mays
  Clone ID: cC-zmpo148064b12a1
gcatatgtatgtcaaatttattatataactctttgggtgaagggagccaaatttaacctgtacattttaaacaggggagtatgccataaccttttacagcaagacgactatatgctatacacacgttacatggatgcgcaatagtcaattattcgttagcacatcacgctcacacctgtctattcacgtactcaccggcgccctccacgatgccggcggtcatcc

SEQ ID NO: 13986 - DNA, 614 bp, Zea mays
  unsure at all n locations
  Clone ID: cC-zmpo148064b12d1
cccacgcgtccggaggccgccgccgtcaccgtggatgcgccgccatagtcgtcgttgttttcgtcgtcgttgttgtcgtgacgggcgtgggcggcaacatgcgacccacggatcatccaccgcgacatcaagtcggccaacatcctgctggacaacgacttcgaggccatggtcgccgacttcgggctggccaagctcacgaacgtgaaccacacgcacgtgtccacccgcgtcatgggcaccttcggctacctggcgccggagtacgcgtccagcggcaagctcacggagaagtcggacgtcttctcgtacggcgtcatgctgctggagctgctcaccggccgccgacccggcgaccgctcctcctacggccaggacggcctcgtcgactgggcgaggcaggccctgccgcgcgccctggccgacggcaactacgacgcgctggtagaccccaggctgcggggcgactacgacccgacggaggcggcgcgcgtcgtggccagcgccgcggcctctgtccgtcacgcggtgcgccgtcgtcccaagatgagccagatcgtcctggcgctgcaggggggcatgccgcttgaggacctcagcgacggngcgcccac

SEQ ID NO: 13987 - DNA, 407 bp, Zea mays
  Clone ID: cC-zmpo148064c03a1
ctgccagcatgcctttttattatggtccagtgcaatctatgaaaaacacacatttgcgtgacattacatttggagttccatcgacggtatatttggaaaaaaaacaattagcttagaaaatgccacattaataggaatacaatatatagttccgtccatattaaatggttatcgcatgcgtggccagccggtgacgacgtacgtatagactcgctcagcgcctgagctgaacgccacgttaccccggcgcatgcatacatgcatgcatgcatgcatggttcattcatttcaaggggctttgctttcaaaaggaagaggggtgcaagacctcttgcacttcttgctgaggcgcgggttcttcttcttggcgcaagtgaccctgcaggccttggtgaccttggtcgcct

SEQ ID NO: 13988 - DNA, 533 bp, Zea mays
  Clone ID: cC-zmpo148064c03d1
cacccgtgcgcagccagctcgcgaaaataatgaagagccgcagcatggcatcttcggcctcgctcttggtgctagccctcgcgcgagtgggggccaccgccccacaggtagcggaggcaaagaagaagagagcggcggagagcggcgaggcggcggaggcgaagaacatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctgctccttcttgaagcgaagccccttgaaatgaatgaaccatgcatgcatgcatgcatgtatgcatg

SEQ ID NO: 13989 - DNA, 497 bp, Zea mays
  Clone ID: cC-zmpo148064c04a1
ggatattaattgaaagaaaccagaaaaagaatggggttcggggagacatctgagaaggatatacagttttgcaaagtgcaaacaaaacttctgctgcctagaacagcgagatgtaaagctatttccttcgtagctatgtcatcaagtcatcaaggagctaggcaccaaagcgcgtggcatcccatatttcttctttgggccttgttcgtttgtgtagaattacatccagaatcgttcccgttgagatttatataaactagagaagcaatccccggaatcgttccagctgaggtttatataaactaaagcaatccgattaggaatcgttccgatccatcaatccgtaacaaacgaacggggccttagctgtctgaacagcttttagcaaacaaaaccccctccatcagagtatatcatgctttcacagcttcactatcaacttggctttcattatcaatttgctttccattcatttgtggtcgtggtctccgatcagc

SEQ ID NO: 13990 - DNA, 561 bp, Zea mays
  Clone ID: cC-zmpo148064c04d1
gtcccattacagcgttgatgttgttgttgcatggtatacggtgaattttttggtcttttttgtggataagaagcttacggaactggctgatcgatcggtggggtccacatcaatacttcctctgagtgcaaaggataaagataccaagttgaaagaagaaaatacgagattgctgaatggtaactctatggattcagctgatcggagaccacgaacacaaatgaatggaaagcaaattgataatgaaagccaagttgatagtgaaactgtgaaagcatgatatactctgatggagggggttttgtttgctaaaagctgttcagacagctaaggccccgttcgtttgttacggattgatggatcggaacgattcctaatcggattgctttagtttatataaacctcagctggaacgattccggggattgcttctctagtttatataaatctcaacgggaacgattctggatgtcattctacacaaactaacaaggcccaaagaagaaatatgggatgccacgcgccttggtgcctagctgcttgatgactggatgacatagc

SEQ ID NO: 13991 - DNA, 498 bp, Zea mays
  Clone ID: cC-zmpo148064c05a1
cactgaatatggattgaatgaatgggcttggtatatacagggattggactaaatgcctgtcctatccgaacagcgctactcgtttacacattagagcagctcgtctacaggcaattctgcttcccaggttcattcattaataatgtggtgaatggctaccgaatcatgttctgatgatggcaacacaggcgcctctgtaggccagcagtggagggagtttaggtcgaggtaccgccaagctgtgtggccatgcgaaccatttttatcatccagccacaagggcccgttgatccgaactaatgaagccactgcatgctggatgttgacatatattacaggtgacgtggacaccgctcggtgctttggtgatcatgacccccctaccgccatttctggggggttttcttgtgcctcattcttgcccagcaatgctggggtgactgaaacaacaccgatcaggaatagcagtgcttttgactgggtgtcgtaaaggtcact

SEQ ID NO: 13992 - DNA, 482 bp, Zea mays
  Clone ID: cC-zmpo148064c05d1
cccgtgccgggaaagctctcttgctcctcctcctcctctcgaattccgtcttttgtttttgtcgtcctcgcccggtttccccggtttgggagaggggaaagaggaggcggaggagagggatggggagggacgagaggttcccggtgtgggaggccgcgctcggcgccggaatcgccgccgccttcgccgctggactcgtcggtgtctacctttgcatgccggactccgactacagcttgctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgcttgctggtgctctgtttgggcaactgcgtggccttgcgctggtggtctttgctgccactgcaggtgcttcttcgtgctatttcctg

SEQ ID NO: 13993 - DNA, 447 bp, Zea mays
  Clone ID: cC-zmpo148064c06a1
acgcttagccaaggttatgcggggatgggggggcggaagcacggtggttggcggcggtcccatccggccagcccagtgcaaataggtgagatcttgggtgggggactgggggcccaagtttcaccaacgcacctacacgcttagaaaagctccagcttttacagggaactgcgcgcgagtttacgctgcagcactgagagtaatccacaagagagatgatggagtcgtgaaaaaggcgccgtatctttctctttcctgaccagatgaaccgctgctgcaccggcacgttcttctcgtccgttgctgaaactctgccacccctccctaaggaggaggaggaggcaagagagtgggctttcggcttcagtcgtaggggttcctgaacttcttcaggaagtccgggatgtcttaggccaacatgtcgttcacgccctggaccatcttggg

SEQ ID NO: 13994 - DNA, 555 bp, Zea mays
  Clone ID: cC-zmpo148064c06d1
cccgaccaagttgatgcacagcagctgatgagagtgtacggatctctgttgtggtcgctcgggaaagtcctgaggacacgggaagtcatgcgtgtctacataggttcattcaacgacaagccgatcagggagacagcggctgggccgctgggcatggagctgttccagaaggaacaagatgacttgctctcggacctgaacgacatccccaagaaggcctgcgaccgtcggatcaatgagttcgtgaagcgggcgagggcggccaaggtccacgcgcacataatcagccatctgaagaaagagatgcctgcgctgatgggcaaggccaaggctcagcagaagctgctcgacgggctggatcaacagttcgccaaggtccagaaggagctgcacctgccgccaggggacttgccgagcgtggaggagtacagggagctcctgagcgcctacaacttcgacaggttcgagaagctgaggcccaagatggtccagggcgtggacgacatgctggcctacgacatgccggacctgctgaagaagttcaggaacccctac

SEQ ID NO: 13995 - DNA, 448 bp, Zea mays
  Clone ID: cC-zmpo148064c07a1
gctggccggcaggcaaaggcgggcaggggtagagttgaccattaattacgggcggcattccaaacacaagagttatatacaatgcaaggttgtgttgaatataactcttgtgttgttaccatcgatcgccaatgatgaaagctgcaacctagagctgcacacgcactaccacttcctgccgacgcggcatttgagcgcgccggcgtacctggagagcgactcggcgtactggccgcccttggcctggatgaggtcgagcctgtcttacttgcgctcgttctggccgccggactggttgaagaaggctcccttgaggaacaagtcgtcctgcgacttccacacccagttcttgtactcgctgtactgcgtgtactcccgcttggtcacctccttgaacctgctgtcactgacggcgcggaagcgggtgccctggctgatgatggtgggg

SEQ ID NO: 13996 - DNA, 560 bp, Zea mays
  unsure at all n locations
  Clone ID: cC-zmpo148064c07d1
gtccggcgctgccgtcacggcttcttccacgtggtgaacaacgactacttcgctctggctcatgtacgccatcggcgggggccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaacacaagagttatatacaacacaaccttgcattgtatataactcttgtgtttggaatgccgcccgtaattaatggtcaactctaacactgcttgcctntgcctgccggccagcataaaaaaaaaaacaaaaaataaaa

SEQ ID NO: 13997 - DNA, 449 bp, Zea mays
  Clone ID: cC-zmpo148064c08a1
atagcaactgccaacatgcctttggattagtattcattcaatcgatgaaaaacacacatttgcgtgacattacatttggagttccatcgacggtatatatatttgaacaaaaacaattagcttaaaaaatgccagattaataggaatacaatatatagtcccctccatatcagatggttatcgcatgcgtggccagcccgtgacaacgtacttatagactcgctcagcgcctgagctgaacgccacgtcaccccggcgcatgcatacatgcatgcatgcatgcatgggtcattcattttaaggggcttctcttttagaaggaggaggggtgcacgacctcttgcaattctcgctgaagcgcgggttcttttccttggcgcatgtgacacttcaagccttggtgacctcggccccctttaccacgtacgccttgttccactccttctggc

SEQ ID NO: 13998 - DNA, 545 bp, Zea mays
  unsure at all n locations
  Clone ID: cC-zmpo148064c08d1
cgtccgaggatccaggcaagggcaagtgcaccgagcagaagggcatttcgtttccggccatgaaggtctgccaggaggagggggacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttgttcaaatatatataccgtcgatggaactccaaatgtaatgtcacgcaaatgtgtgtttttcatcgattgaatggataataataaaaaggcatgctggcagttactattaaaaaaaaaaaaanaatttatattng

SEQ ID NO: 13999 - DNA, 64 bp, Zea mays
  Clone ID: cC-zmpo148064c09a1
attcagacaagtttccacgatcgggcggggtcctgtttacaacgaaagttagctccaacatgca

SEQ ID NO: 14000 - DNA, 105 bp, Zea mays
  Clone ID: cC-zmpo148064c09d1
aattttcggttcgacccacccgtccgtgcatcttggagctaactttcgttgtaaacaggactacaggatgatcttggaaacttgtctgaatatgattgggggggg

SEQ ID NO: 14001 - DNA, 362 bp, Zea mays
  Clone ID: cC-zmpo148064c10a1
ggttgaggggaaaaaccaacacttttttttttcattaacctcacaggctaacatttaaaccaattttttaaacacaacaactctttttttacaccttccaacatttcattccaacaaatgcaaattcccacaatcacaagttccaagttccctttggacaaaaaccattttcattacccgatcctaattctcaccacccttaaaatttattcttaaaaagacaccttccccccattcaaacctatttttttttaaacaccccccccaaccccaattccttaaactcaaatgatttggccaccccgaaaaaatatttcctttggttaaaattaattcgaagcctaaaaaccctgttttttcta

SEQ ID NO: 14002 - DNA, 598 bp, Zea mays
  Clone ID: cC-zmpo148064c10d1
acccacgcgtccgaattacccatctagtgaccagtagtgaaccgacgaaaaggagtgatggcaaagaggtctcacacagcaaacaggagagcctggcacgggaagatggtaaccagaagggtgagactgaacaggagcaggctaatcctacactacgtcgccaaggccagcccaatgcaaggtaccacaggggaggtgggtcacacaggggaagggggggttatgacactgggaggccaaaccatgtcacaaatgtggagaggcggaagggtggcagccatcttgaataccagccagtcggaccccaaaacaaagctgcagacttccaacagagcctgggcatggaagaacgaaccgaggggcctcctgcttctggacaagcgttcaggcagcgtggacacaacagggggctacgcccagcaggccgctttgtccagcgaaaccctgcttctacgcctaccactaattctcaccaaaatgaataatcttccgcggctgccacatccactgagcttcaggaactcgcgcttgtggtggtgtttcacaacagataggtttggatgcgcggcaggtgtccttctacgactaaactctactg

SEQ ID NO: 14003 - DNA, 503 bp, Zea mays
  Clone ID: cC-zmpo148064c11a1
aattgggattgcatatataggaggtacatgtacaatacaatattcgtgttgttgtttgtcacactccttatatccttttattaaataaaaaataaaaaataaaggtctatcaagtgtgccatttgatacttattattatttggttagtttatttggcggtttatgcagtgtttgtcttccagccggcggagatgacatcgtcgtataccgtcttagtgcctccctcggtggtgagttggaccgtgatgggtcccttcatcggcttgtcgctgtccttcctccagatggcgccccaggagtgctttataggctcttacctgtcagatcccttctccttgatgttcaccgtcacaatgtctccatcgccgtcgacttacttgaccaacaaggccaggtaggttgtcgttgcacccccttctcaagtggaatgtgaccttatatccatactttgactttaccttttaaattgcatgttaatgattgcccgcttactcaactttttc

SEQ ID NO: 14004 - DNA, 620 bp, Zea mays
  unsure at all n locations
  Clone ID: cC-zmpo148064c11d1
cccacgcgtccgaaggacgtgaataaggcccctttcaatagcatgggcgcgtgttgcaacgtccccatcttcaaggacggtctaggttggggatcctgcttcgagatcaagtgtgacaagccagcggagtgctctggcaagcccgtggtggtgtacattacggacatgaactacgagcccattgcggcataccacttcgacctagcgggcacggcgttcggtgccatggctaagaagggtgaggaggagaagttgcgcaaggcgggcatcattgacatgcaatttcgaagggtcaagtgcaagtatggatctaaggtcaccttccacttggagaaggggtgcaaccccaactacctggccctgttggtcaagtacgtcgacggcgatggcgacattgtggcggtggacatcaaggagaagggctccgacacgtacgagcctctaaagcactcctggggcgccatctggaggaaggacagcgacaagccgatcaagggacccatcaccgtccaactcaccaccgagggaggcactaagaccgtctacgacgatgtcatccccgccggctgggaagccaacactgcctacaccgncaaataaactaaccaaataataataag

SEQ ID NO: 14005 - DNA, 533 bp, Zea mays
  unsure at all n locations
  Clone ID: cC-zmpo148064d01a1
aaaacgcaaattctatttcatcggggcgggctgaattatagatttacaaggacaataatctccatgactgcacgacaacatacatctaaaatgccaatgcatcgttgaacccggcatcataagcggcgtcggtctcatagtcaccgatcgcctctccgagcatcatccccccgaccgcaccgtctaggagccctaggccgagccccatccccatacctccgccatgcctcgccggtgcagctaccggctgtgctgcgtagttgtacatcgccggttgtggggaaacaacattgtacccgtacggtggcggagcaaggtacccgtaaggctgccgcgggtactccgcgtacggcgaacaatattgttgcggcgggtatgcggacgccatggcctgcggcggtgggtacacggtgggcggcaccatagtcttgtccgtcgtgttcttggagtcctgcacgtacttcttggcgtactggactctgtttgcttcccggtcccagacacaagagacggcggggacctcngtgaactta

SEQ ID NO: 14006 - DNA, 502 bp, Zea mays
  Clone ID: cC-zmpo148064d01d1
aacgtcgtacgagaacctttctccctcctccacctttctccttttctttccacggcaaaacaccttcgccggggagagcgtggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttgcccatcccggctgccgctgacaccctgggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagctaccacgtgcgcaggcctgactctggccgcgcccacagcagtactctacttctgctataagtttcaccg

SEQ ID NO: 14007 - DNA, 374 bp, Zea mays
  Clone ID: cC-zmpo148064d02a1
gggggggggatatttataatgtataattcctggcttgtctcaataaaacaacaaatttcatctacacacataggaagccaagggctgcattttccccttccaaaaaagaccaaatggttggtatcatccatgatccatccgacaccattttttaaaatagaataggatgatgacagggcacacaaacccagaggggccttgtttacaaaacaatttacaatacacagctgtttgggaaagcttttttttgccccaaggctttggtgggcacgacacaggaacaccaacgctccacaaaacggtcctttttcttgaacccaaaatttttgcaatgataaaaaatcacaatcccgatcccttgggaaggggggagg

SEQ ID NO: 14008 - DNA, 617 bp, Zea mays
  Clone ID: cC-zmpo148064d02d1
acccgtgcgggagcttttaaccggtcgcaagccagttgaccacacactgccttgtggtcagcagagccttgtgacatgggctggaccggggcttagtgaagacaaggtgaggcaatgcgtccatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtgggcctcccacgctgccgagcgatccggactgtgatttctcatcgctgcgacaactttgggttcacgaaaaaggaccgtcttgtggagcgttggtgttgctgtgtcgtgactgccaaagccttggcgcagagaagagctttgccatgcagctgtgtattgtaaattgttttgtaagcgatgcacctcctggtttgtgtgccctgtcatcatcctattctattctagaaaatggtgtacgatggatcatggatgataccaactatgtggtcttctttggaatgcgaaaatgccgcacttggcttcctatgtgtgtagatcagctttgt

SEQ ID NO: 14009 - DNA, 237 bp, Zea mays
  Clone ID: cC-zmpo148064d03a1
aaaactcccattacaagggggggggtttaaaccccattacagtgatttgagagggcatctcaagattacatcaatagatatatccgggcgttctcatttggctcacccccacccaacgtcccttctcccttccctaggcttccttcgtctttggtctttttgatgattttatttcgccgagcagcacaggaatggattaattagactggatggtcaaaacacaagcggacgcgtggg

SEQ ID NO: 14010 - DNA, 247 bp, Zea mays
  Clone ID: cC-zmpo148064d03d1
acccgtgcgcccacgcgtgcgctcgtgttgtgaccatccagtctaactaatttcattcttgtgctgctcggcgaaataaaatcgtgaaagggaacaaagacgaaggaagcctagggaagggagaagggacgttgggtgggggtgagccaaatgagaacgcacggatatatctattgatgtaatcttgagatgccctctcaaatcactgtaatggggtttaaaaaacaatcattgtaatgggagttat

SEQ ID NO: 14011 - DNA, 525 bp, Zea mays
  Clone ID: cC-zmpo148064d05a1
aaaaacggagggagtatttaagggccaagcacacatatttatatccacgtacacacaacgaaacggtaccacatgtcatccgttgtactactacacaacaaaacggcaccacacgcattagcgatagggttgtttcattggacatgtcacaaccaacacagacacaaacccatacacacgccagaagtgaaccacatcatttgagatgggactcattgcctgatcaagaaaacatggccgcacacggacggaccaaccacccgtgtggcggcataagacaatatccatatgcacgctagcccaacaagattctgctttctcctccaggtggctgccgggtcccacggcctgcatgatcaccacttgtcgaggccttcccggctgcaaaaatgctactaccactcaatccttttggctttgcgcggttcagaagctgtttccctgcaggcgctgaatcccttttggagatggccttgccttcatcagatcaatagacttggtgctggaccctttcttctttgctgc

SEQ ID NO: 14012 - DNA, 593 bp, Zea mays
  Clone ID: cC-zmpo148064d05d1
aaccccttccttccttgcttaggagagagagggaggattttagagtatgaagaagatggagagggcggggggaggggggagttcccacacctccacgggcggcctactcgcgtggcctcaacccgatggcgccgcgtcgcaggcaccacgtgggcctaaccagccgacggaggaattcacgaaggtggtgttcggggggcaggtcaccgaggaggccgacggtctcaacaagacgaagatgaggactacggcctccgcacccaagtcgaaggagacaacagggatcggcatgtttaaggccgagagcgccgccgccgccgtcacaactgcatcccgtgatcgccaggctagccacatcactttttctcaggacgggaccattcctgccaggaagccaacttcagttgctggggtggcgaggcagcgcgaacttatccataccgttgagagttcgggggaccgtaagatgaagcggcaggtgtccaatgccaaatccaaggagctcaatggtcacaacatctttgctgatcatgaaaatccgagtcccacaggtcaaacagctctgctgctgctctggcacatgtgaaaaatgc

SEQ ID NO: 14013 - DNA, 441 bp, Zea mays
  unsure at all n locations
  Clone ID: cC-zmpo148064d06a1
gaatnnggttggtatttggagagggaatggtataccctcaaattcagggtgttacaccgtcgaacataatatagctgtcggatgtctgacgttttactgttgtgcgttaccaatggatagcatctaatgggcaatgcaaggacgagagaaaaattataactagagagatgggtcagtcgacggagggtctataagcatgcaagctccttgaggcaacccttggtgctgcccttggcgttcgtgcatatagccatggtcttgttgttggtgccgctatactctacgttgacgtcatccatggtgacgcccgtgcatgggaccttggcagtgcagagcaggctaacggccttcggggtggaggaggtgcccgtgatgttcttgaaagtgacatccttgacggtgacctttgaggcgcccttggcagtacacaacttgttgggg

SEQ ID NO: 14014 - DNA, 603 bp, Zea mays
  Clone ID: cC-zmpo148064d06d1
cgaccacacgatggcgtggagcaaacaatgcgatgagatccttgtttctcctggtcctcttctgcatcgggcatggggagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccacgtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgactgcacgatccttgccaactcgctggtgatggactttcgtgaacaaacgggaggtgtcctgtgtcacgctgctcaacttcaagttcttgcacatgaacattgtaccgttgcaggacatgctaatc

SEQ ID NO: 14015 - DNA, 389 bp, Zea mays
  unsure at all n locations
  Clone ID: cC-zmpo148064d07a1
aaatcatctcattgataaccggggtgggctttatggtagtacatgatcgccgcgacaaacagtggcgcgtcgaagcacgtaccaccaccaccacgcgcacaccttctccgtcgtcgnggccgactccatacatacacacgcccgccgacacctcacacagagacacacacgacacgagctggactcacgcacgccagaccagacgaatcatattttggagcaggaaccacgtatccagcgcggatctagcaaaagaggtagcccaaggcggcggcggcaagggaggccgcggcgaggggtaccgcggccgcggcgttggacgcgggagccggggcgggagcctctgcggctgcggcggacgccacgagcgcggcggccatggcggcgac

SEQ ID NO: 14016 - DNA, 557 bp, Zea mays
  Clone ID: cC-zmpo148064d07d1
cccacccgtccgcccacgcgtccgcaggcagcaagccgcttgggcgccatctctttagatcttcgtaccctcgaagagagatccggggcgggccaataaacacccggcttactacagactcgcagatggccggcctcaggatgaagttcgtcgccgtcgccgccatggccgccgcgctcgtggcgtccgccgcagccgccgaggctcccgccccggctcccgcgtccgacgccgcggccgccgtacccctcgccgcggcctccctcgccgccgccgccttcggctacctcttctgctagatccgcgctggatacgtggttcctgctccaaaatatgattcgtctggtctggcgtgcgtgagtccagctcgtgtcgtgtgtgtctctgtgtgaggtgtcggcgggcgtgtgtatgtatggagtcggccgcggcggcggaggaggtgtgcgcgtggtggtggtggtacgtgcttcgacgcgccactgtttgtcgcggcgatcatgtactaccctgctgcgttttctggttatcaatgagatgatttatttgattctttt

SEQ ID NO: 14017 - DNA, 478 bp, Zea mays
  Clone ID: cC-zmpo148064d08a1
aacaacgatcacagtcatttaggagggaacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggccgtccggcatgccgcgccccgcgcaagtgtcgtcccggcagttgtgcgtcttggtgcagatgacgcgggtgtccgcccaacagtccttggaatggacgggcaggacaaagcctgtgttgatgagaagcagcagaacgaggaggcctgaagccatcgccttgctcgtcgccttcatttcgagggagcacagcagaaggctggatgaaaatcgcttatattaatgtacccaccccatggatgctgc

SEQ ID NO: 14018 - DNA, 503 bp, Zea mays
  Clone ID: cC-zmpo148064d08d1
gacccacccgtccggcagcatccatcgcgtgcgtacattaatctaagcgatcttcattcatccttctgctctgctccctcgaaatgggggcgaggagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattttgggatatttgttatcatactatgaaatgactgtgaatcgctgttctgatt

SEQ ID NO: 14019 - DNA, 270 bp, Zea mays
  unsure at all n locations
  Clone ID: cC-zmpo148064d09a1
cccccctcccccccccttttttttttttctaccgacccccccatctaggggcccgggttttttttaacaaaaaaaaaagacctaccccnccaaacacaatatatattggcccaagctaacaaacttcgtaaaacaaccaaactttggggccaaaacacaaaattattttcccaaaccaaacaaaaaaatcatataaaccagggggaaaaaatccccaaccaaaaaagggtggtgtaaaacagaacggccacccccaaacccaaggcatgg

SEQ ID NO: 14020 - DNA, 610 bp, Zea mays
  Clone ID: cC-zmpo148064d09d1
cttaattgcgccactgctcgttatcctcctcttgcattgcattgcaggtcgtagttgagcagcagcaaccactgcacgggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaggctcggtgactacctcgtagagcaaggcctgtgattgaatgcatccaaacaacgacaccaacgccaacattaattaattggtagtctccatgccctgggattgtgcgtggccgctccgttaaacaccacccatcctttcgtcggcattttttcccccttgttatataa

SEQ ID NO: 14021 - DNA, 379 bp, Zea mays
  Clone ID: cC-zmpo148064d10a1
ggacaggacgacccaactaaatgggacggggtactttacaacaaaacagtgtgttttgtactgtgcaaatgtaccaggtataatacaaaccccctgttagacttagacagacgagtgcaaacaagaaacaaacaaaaacgtagaggggctacaacagcaatcccgtctgctcttcatccacaatatatatcaaagtttcgtttccttgcagccaagtccatccattcaccatcagcagatgacagcattcatagttctcgtctccacgaagcccatcccgtccgaacactcgtttgcggcggtactggtacacacagcgtttccatcgccgtcctgcccgagcaggccaagcgactttcgcaccccgcgaatgtatttt

SEQ ID NO: 14022 - DNA, 388 bp, Zea mays
  Clone ID: cC-zmpo148064d10d1
ctcgtacggaactacattcgcggggtgcgcgagtcgcctggtttgctcgggcaggacggcgatggcgacgctgggtgggccagtaccgccggaaacgagtgctcggacgggatcggcttcgtggagaacgagactctgaatgctgtcatctgctgatggtgaatggatggacttggctgcaacgaaacgaaactttgatatatattgtggatgaagagcagacgggattgctgttgtagcccctctacgtttttgtttgtttcttgtttgcactcgtctgtctaagtctaacagggggtttgtattctacctggtacatttgcacagtacaaaacacactgttttgctgtacagtattgcgtttaatttagttgcgtcgtactgtcca

SEQ ID NO: 14023 - DNA, 527 bp, Zea mays
  Clone ID: cC-zmpo148064d11a1
gtgtagttactgccagcatgcctttttattatgagccggtcaatctatgaaaaacacacatttgcgtgacattacatttggagttccatcgacggtatatttggaaaaaaacaattagcttagaaaatgccagattaataggaatacaatatatacttccgtccatatcagatggttatcgcatgcgtggccagccggtgacgacgtacgtatagactcgctcagcgcctgagctgaacgccacgtcaccccggcgcatgcatacatgcatgcatgcatggttcattcatttcaaggggcttcgcttcaagaaagaggaggggtgcaagacctcttgcagttctcgctgaggcgctggttcttttccttggcgcaggtgacgctgcaagccttggtgacctcggtcgccttaccacgtacgccttgtcgcactccttctggcagaccttcatggcccgcgccgtgatgcccttctgctcgagcacttgcccttgcactggaatctgcccgacagcaccatgttggac

SEQ ID NO: 14024 - DNA, 647 bp, Zea mays
  Clone ID: cC-zmpo148064d11d1
cccacgcgtccgcaccaccaccaagctcaacaacagccagctcgcgaaaataatgatagatccgcagcatggcatcatcggccgcgggcggggtgctagccctcgcgctagtggcggccaccgccccacaggtagcggaggcaaagaagaagagagcggcggagagcggcgaggcggcggaggcgaagaacatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatgg

SEQ ID NO: 14025 - DNA, 380 bp, Zea mays
  Clone ID: cC-zmpo148064d12a1
cattagctcgtgtgtgtgtggatataagcaaaacatctcatcagtaaagagattagagattcgtgtctctcgcttttgcttcgtactcaaatagatatatcgcgtggcatgcgtcgctacttgggcggtggctgcatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccaccttctcccccatcttcgtgtacgagtagacgacccgtgaggagtcccccca

SEQ ID NO: 14026 - DNA, 568 bp, Zea mays
  Clone ID: cC-zmpo148064d12d1
gacccacccgtccgcttcggtggtccaccatggcgcatcgagcggtggccacgattacgactaataagcccctcctcctcctcgccggggcggccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcaccgtggggagcgccacgctggcggtggagtcggactacttcacggcgtacggcgtggt

SEQ ID NO: 14027 - DNA, 468 bp, Zea mays
  unsure at all n locations
  Clone ID: cC-zmpo148064e01a1
atgtgttctcagacgttgcagtagcataaaaggggtnagtcagaattacacaatttaatgaacttgatacatagttcaatagattttcaattatttggtcagctggtcttccataaatttgtcaactggcctctacatcagcttttcatcggtgctctcttgatgcaaagattttgctttggtttctcttgatgcagaaccttctcatctacatgtcatctggcttgtcatgttgcataggcttctccaagccataagaatgaagtatagacgctattgtttggtgcaatgtcaacctttgctttgctggaactaagtcctatgaaagctacatctgcttttatctgataatatggccttgttcaaatctttgaggacttangtggagaagacttaacaaaacatgagttctgggccatcagggtgatagaacttggctgtaggttgtccttatggtttcctcgtttg

SEQ ID NO: 14028 - DNA, 481 bp, Zea mays
  Clone ID: cC-zmpo148064e01d1
ccgtccggcctcgcatggccgccacgggggtcagccgaggctttttgtattacacgggccgcgtctggcatgcgggggaggagctttgcctccgcatcctcacatcctctgccatcagcctcctcttcgcgttgctcctgcctccacctctgaatcgaaaggtgctatgtaagaatgcacacgaggaaaccataaagacaacctacagccaagttctatcaccctgatggcccagaactcatgttttgctaagtcttctccacctaagtcctcaaaaatttgaacaagggcatattatcacataaaagcagatgtacctttcataggacttagttccagcaaagcaaaggttgacattgcaccaaacaataacgactatacttcattcctatggcttggagaagcctatgcaacatgacaagccagatgacatgtcgatcacaagcttctgcatcaagagaaaccaaagcaaaatccttgc

SEQ ID NO: 14029 - DNA, 314 bp, Zea mays
  Clone ID: cC-zmpo148064e02a1
atctgagtattcattttgtctaaggggcgggggacaaacatatatcctcttatattctaacgtttttttttctgtgtgtgtatgtgtgtacaacaaatgagtacatgtgcaatttcatcacaagtgaaaattgatacagggtgttcctgtatcgcttagtatggatcgactccgatttacaaatgaaaaccgcatacttgcatcaaatcagcggcacgcgctggggcatcgtctgatatatgtttccaaggagatagatagatatatagattccgggcggtgggcggcatcatgccagtgttgatcagcactgg

SEQ ID NO: 14030 - DNA, 408 bp, Zea mays
  Clone ID: cC-zmpo148064e03a1
ccactcgggggaggtcgatcatgaacccgaacaaaaggattacatatactagaatttggaagtctcagtagtatataaggttagcggtgcatgctgccaacttaattagcttgctgctgaaggtccatagcccgctgtgccggatgaatcgaagggaattcaaagtctagtagaattggacgttggaagtgtagacggcatcgggtctccagttcgccgggatgacgtctttggcgatgaccttcttgccggactcgctggtgaagcggatggagaaggggcccttgagcgccttggcactgtccatccttcagatggcgccccaagagagctttatgggctttcactcagccgacaacttgtcctggatttccatcagcacgatgtcgccgtcgttcgccacatact

SEQ ID NO: 14031 - DNA, 577 bp, Zea mays
  Clone ID: cC-zmpo148064e03d1
ccgtgcgcgaataacacaggtgagcgcgacgatggcatccctttttaatttcatcatggtcgtgggcgccatccgtgcggggctcgtctccggcgggtcgtgcgggcccccgaaggtgccacccggccccaacatcaccaccaactacaactgcaagtggctcaccgatagggccacctggtacggtcagcccaacggtgccggcgctcctgacaactgcggtgcgtgcggcatcaagaacgtgaacctgccaccctacatcggcatgactgcgtgcggtaacgtccccatcttcaaggacggcaagggctgcggctcatgctacgaggtgagatgcacggaataacctgattgctctggcaatccagtcacggcgtacatcactgacatgaactacgagcctatcgctccctaccacttcgacttgagcggcaaggccttatgctccctggcaaaagccaggctcaacgacaagattcgccactgcggcatcatggacgttcagttcagaatggtgccatgcaagtaccccagccggcagaaaatcctgttccacatcgagaagggcttgaacccc

SEQ ID NO: 14032 - DNA, 446 bp, Zea mays
  unsure at all n locations
  Clone ID: cC-zmpo148064e04a1
agataacaaaaggcaaattctatttcaggggnggggattaattagagatttacaaggacaataatctccatgactgcacgacaacatacatctaaaatgccaatgcatcgttgaacccggcatcataagcggcgtcggtctcatagtcaccgatcgcctctccgagcatcatccccccgaccgcaccgcctaggagccctaggccgagccccatccccatacctccgccatgcctcgccggtgcagctaccggctgtgctgcgtagttgtacatcgccggttgtggggaaacagcattgtacccgtacgggggcggagcagggtacccgtaaggctgccgcgggtactccgcgtacggtgaacaatattgttgcggcggatatgcggaccccatggcctgcggcggtgggtacacggtgggcggcaccatattcttgtccgtcgtg

SEQ ID NO: 14033 - DNA, 383 bp, Zea mays
  Clone ID: cC-zmpo148064e04d1
ccttgccacaggacccaagcagaccacagcatttgctgttacccctgctggaacgccatggggggcttgggcatcccggctgccgctgacacccgcagactcgcactccacgtgaggctacgcgcccatcgtgtatacctgggcgatcgcgacatctgcgatgagatagtgcccatcaacgacctcctggccggcgccgacacaggtggcgatccaaagcccgtgagctaccaggtgcgcatgcccaactacgaccgtgcccacagcgtactgtacttgtgctatatatataccgaggaccccttcaagactttgttgtgggcaccaagaaagcatacttgatccagacaccgctacaaacatgcatgaccttcaagaacacg

SEQ ID NO: 14034 - DNA, 428 bp, Zea mays
  Clone ID: cC-zmpo148064e05a1
ctttctctcttttttcttctttttccccccctttcttttttgggtttggtttttttttataaaataaaaaaggctcctcccacaacttcattttttaaaatgaatcctattttttcaaaaaaaaataaaataaattcccttgaaaaaaaaaaaccccctaaaaaaaaaaaggttgtaaaaccacccccattaaaaaaattattcaaaaagcaacatcggcttccaccattttccttcttaaaaaaaactaccgctccctgtttaccgaaaaactccttttcaccgaattaataaaaaacagggaataattaacccccggggcatacattcaatccgtctttggcttgcccccttcaacaaaacacttaattaatttattaaggccaacaccccaagcggggaggaatctattcctcccccccccccca

SEQ ID NO: 14035 - DNA, 456 bp, Zea mays
  Clone ID: cC-zmpo148064e06a1
ggaaagggttattttatattattttaaaaccaatccaaacagaggtggttcatgttatacaaacttatacaaaatacacccctgggggataaataatgattaaatcaccccctacttcctttggaaaaaaaaaattcaccaacctgacttgaatgctaacaacgccccaacacaatacttgaaggcaaacctttttaaattaattagcaaaacaacaacctgggatccatccttgtttttttacataaaaaaaaacccacccagcgcgacctggcttggccaatccataaactaaaaaaaacactctgatgcccaccggccttaataacggtttgcccgtacaaaaaaacattttgccaaaaaaacgggtaaaccttgaaacgtaagttcctggcttggactttaccaacttttttggtgttcacctgcttggggcctccccccgaacgatttaaa

SEQ ID NO: 14036 - DNA, 522 bp, Zea mays
  Clone ID: cC-zmpo148064e06d1
gggggcaaccacccgtgcggtgtggcacacggaggacgacctgttcatgaacggctttatcttcaatccgtccggcggcgcccccagggagggggacaccaacgagtgggtaaagcccaagccaggaacctacgttacaaggctcacccgcttctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgttcgccttcaagtactgtgttgtggcattgttacacatcacagtacagcttggtcaaatttttttttccacagaggaagtagggattgatttaatcattgatttaatcccacacgcgtgtatctacgtatacagtttgtataacatgaaccacctctgcttgcgattggtctaaaaataaatataatacttatata

SEQ ID NO: 14037 - DNA, 399 bp, Zea mays
  unsure at all n locations
  Clone ID: cC-zmpo148064e07a1
gcttgtgcctgggccaaaccggggcaagggtatgttaagaacggggaatgggtgacagcagcaagtgaatcaagcactctgatacattttttattttccttttcttccttttctttccgtagatactgctatccatgccatgcgttcgctctgtatcgttgtagttttgtgcagcatgtccgcgacgccgccgtggtatactttactggtcgtcgtcgtcgtccgagtccagctgcttgagcagcgcggcgcatacggggagcggcacgtccttgaagtagcctatcgggttggcggggcgcaggctgtcngatatgccaacgttcctggtgagcaggacaccggcgcggtccctgagcgcctggacctcgttgcagtcctttgccgggctggccacca

SEQ ID NO: 14038 - DNA, 347 bp, Zea mays
  Clone ID: cC-zmpo148064e07d1
gtccgctcgtctcaccctcgctccctcacacaaataataaggttaggttccgcccttttcctccgacatccacggggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcg

SEQ ID NO: 14039 - DNA, 308 bp, Zea mays
  unsure at all n locations
  Clone ID: cC-zmpo148064e08a1
cttttctctttttttcttctttttccctctcctttttcccggggtngggttttttttttttgggaaggaccaacctgcccaaaaaaaaaaaaaatatgaaaaaaccctcaccggcaaagaccttaaagggtaaaaaggggctgcccccgcccctcaactttgtacccctaaacaaaaaatcatcggccccgaccccaggagctggcgcctccattggccacttttgggctgctgaaccaacgaccatccatgggggttaaacctaaatgaccgaaccccgacccctggccgacccccgggttcccccg

SEQ ID NO: 14040 - DNA, 227 bp, Zea mays
  Clone ID: cC-zmpo148064e08d1
ccacgcgtccgagctcagtcatctacgattcgacaccttggattgtcgatcgttcagcagcacaagaggggaggatggagacgacagctcctcgggtccggtccgatcgattcttgcttacgtgtacatagctgaggcgcaggcgcagcacctacttacccattaacgtcattgccagtgagagtttcatcataattttatttttattaaacaagatgatacatcac

SEQ ID NO: 14041 - DNA, 452 bp, Zea mays
  Clone ID: cC-zmpo148064e09a1
catattaatcaagttacgcgggatgggtttggatgaatttccagattgccctccttccccaactctaagctgtagtatttttttttctctacaacaggagcagtccagagctgatgctccttgcgccatttacaggattagcttatcggatgcggggttagcttacaagaactaaccaggattggaaaataacagcaaatgactgcaaatgtaccatggatggatggatggatgagccatgcgtgtgtgtgcgtgttttttacaagctgaggatctcctacagcgctgcctggtcatggttgagaggttgcagcaacaggaggcggccaatgtttgcttctttgtcggctgatcaagttgtgccaagcggtagcgaccagggacaggccactgaacctaagccatctggttccctctttaggttgagcaaccttggtagaatcgtgtgcctt

SEQ ID NO: 14042 - DNA, 536 bp, Zea mays
  Clone ID: cC-zmpo148064e09d1
ggggcgaccacccgtccgcccacgcgtccgccgcgctcccgccccacgcacgccctttcgctcaccggcgccccgcccctcccccacggtgggggcacccgcaatggggtgcgcggcgtctgccgccaacggggccgggccccggcggcgggggtgggcgcgggcgcggatgcggcggtacagcgaggcgtccacctcgggtctgccgccgccgccgccgccgccgcaggaggcggcggagtcgtcgtccgggggcaggaggcgagggcgcaaggtggcgccggagcccaaggagccggcggaggaggggaccgccgcgctgccgccgatgcccggctcgcccagcttcaggtactactgccagaagaagacggcggccgtcgacaggatcgtggccgacgccgacgccgtcgacgccgatgactccgtcagggtcagagcgacggcgcgtcagctgagcaacaggtgcgaaatcacggcgaccaaggcacacgattctaccgaggttgctcaacctaaagagggaaccagatggc

SEQ ID NO: 14043 - DNA, 545 bp, Zea mays
  Clone ID: cC-zmpo148064e10d1
gggaggatgcacagatttaactgtgaaacaagcggccttgcttagctgataaccagcattcttcatagggtgggggacgacattgacagaaaacacctgccgcaaattttgtacgaagacgaggaccgtgataaggtcgtgctttcgtcggacagtgaccttatagccgctgtggaccatgcgagaaagatcggttggaagagcataaggttgcatctggattacgccggcgttggccggcggaagggagggggtggaccttcggacttggagtacgctggcaaggacgcagcatgggcttctgcgtacagcgccgtctcggcaggggcggctctggttgctgggctcggtgtgatggcctacttgaaacggtcggggtaaaagcttggaggcggagagcacgacggcagagggagcacacgcttctcatcggatctgtgtgatacaaatgatactgcgtcggaacgagcagaatggctgtgtaagtaattcttgtgaaaaagagagagagagagggagattttaataatactagtgtcaaggca

SEQ ID NO: 14044 - DNA, 230 bp, Zea mays
  Clone ID: cC-zmpo148064e11a1
cttctatcctataaagcgaacaccctttttcattttctctatgtacgaaacccacttacttaaaaagggaaacgggtgaaactccatcaatatgcatcacccatcttcactctcttacaaaacaacaacaacctcattaattaattaaacaaaacatacaaacccttcactcctgcacacattaattaacactcgtacacattttcatgatccataacatcctctcaaca

SEQ ID NO: 14045 - DNA, 557 bp, Zea mays
  Clone ID: cC-zmpo148064e11d1
ctaaaaagcggggcacttcgtagccgcaagcattcttttttccttctccattccatcggtgaccatgggggggggacattgatcggcttctctggaggtgcgtgtgagcagctcggaggtcagccgccgagagctcataggcaatggcaaccgcaaggaaggatcctcagcaggttgataaagtcaacctgaaacccagcgagtctggcaaaggggtagtacggcgtgcaaggtctgtcccgacctctccggatcgcagatcgtccccatccccggccccagtctcagacaacgccagccgaccggcatcatcactcaacactcgcacgacctcgtcccggtccacaacaacatctagctcggcggcctcttcaagccacgggaagacgatgcgctccgcttcgtcgtccgtgggtggtgcaagtgcaagcgcaaggcagacaaacgcggcgagaaggagagcagagaagcccggtgccacatccgtgtggcctgcggccggcggcgcggttacgaacgcctcgtcgtctaaggatgtggccagcagggcagcaaaa

SEQ ID NO: 14046 - DNA, 315 bp, Zea mays
  Clone ID: cC-zmpo148064f01d1
aaacaacacacacataaaaccaacctttttaattttttcaccccctcccaaatcccaaggtgctgggtaattttcaaaatcattccatcccctctccactaaaaaatctttttccctttttcctttatcctcatgttaatgttctctgatatctcttatacctcaaaaaaataacataaattttcaaatttattaacttaaccacctttaccgtgaacattgtgctaatcatcgtcttactactcaaactaaaaaaactaaaaatttacctgcctctatataagatccaatcttacatactccttacattctaca

SEQ ID NO: 14047 - DNA, 490 bp, Zea mays
  Clone ID: cC-zmpo148064f03a1
atccttaaggggcccccttttttttttttttactttctggaaagatgtcatttggggggcgggtggatttacatttttttaactccgcaccatatcggaatgcatgagcgaaagaatgaatatgcatgcatgatgcatgttatcatctgcatggttgcttgtgggcatatgcaggttgaagaagaggaggaaaagtggctacttataagttcttggatgcctggtacgtgacaccgaacttccagtcagcggggagaacgtgccatgaggtggccttgcggtggtcgctggtcatcacccggaacgtcagcgactctcaggtgaggtccttcccggtctgccacacttgcccccagttgcgctttatcttccgccacttgacaacgcttgctcccctttaccgacaccggcgggatgtcgccggcgccccccacattggtgatcgtcaccatgttgaagaacttgtttccggtgatggtgtaccggatgc

SEQ ID NO: 14048 - DNA, 328 bp, Zea mays
  Clone ID: cC-zmpo148064f03d1
gatggctgggtcgtggatggcggtgccacaacctctctttctgtctctgctggtcgccgtgctagcaggggccggggatgtcttcaacaccggccacgccaagcccctaacgcctggcgggcgcgtggtacacgacaaccacggcaagttcacggccgggccgtggaaacccgtccacgcaaccttgtacggcgggcgtgacacgtccagcaccacggcgggcgcgtgcgggtacaaggacacgcgcacgcaggggtacggcgtgcagaccgtggccgtgagcactgtgctgatctgctacccaacgctctgcgaagggtgctactac

SEQ ID NO: 14049 - DNA, 372 bp, Zea mays
  unsure at all n locations
  Clone ID: cC-zmpo148064f04a1
aaaaatgcctccaaaaatggcatggggtnggagcttttgcttgttttccactctttgcaattccatcatgaacccgaacaaaaggattacatatactaaaatttggaagtctcagtaatatataaggttagcggtgcatgctgccaacttaattagcttgctgctgaaggtccatagcccgctgtgccggatgaatcgaagggaattcaaagtctaatagaattggaccttggaagtgtaaacggcatcgggtctccatttcgccgggatgacttctttggccattaccttcttgccggactcactagtgaggcggattgaaaaagggcccttgatcgccttggcagtgtccatccttcagatggcgcccca

SEQ ID NO: 14050 - DNA, 488 bp, Zea mays
  Clone ID: cC-zmpo148064f04d1
gaacacaggtgagcgcgacgatgggatccctcgttaattatcattttggtcgggggcgccgtccttgcggggctcggggccagcgggtcgtgcgggccccccaaggtgccacccggccccaacatcaccaccaactacaacggcaagtggctcaccgctagggccacctggtacggtgagcccaacggtgccggcgctcctgacaacggaggtgcgtgcggcatcaagaacgtgaacctgccaccctacagcggcatgacagcgtgcggcaacgctcccatctataaggacggcaagggctgcggctcatgctacgaggtgagatgcaaggaaaaacctgagtgcttggccaatccagtcaccgtgtacatcactgacatgaactacgagcctatcgatccctaccactatcacttgagcagcaaggccagcggctccctggcaaagcccgggctcaacgacaagattcgtcactgctgcatcatgga

SEQ ID NO: 14051 - DNA, 299 bp, Zea mays
  Clone ID: cC-zmpo148064f05a1
ctcttcaaacaaatggaaaaccaaagggttggtttatttatgattacagaacgacttgacacaaatagataaattaaatcacgtctatgtaattaacacaacccgtcaccatgcatatatattcatatcacatcacatcaataataatatatggaaacagcggtgcaggtgacgtcttccaagtcgaccaccgcagcaacagtcaccaaaaacgagcgaggcaactgcaatggcaacggtggacggatccatcgtcgtccatgcgcgcgtacgtaagcacgcacactcttaatggaggt

SEQ ID NO: 14052 - DNA, 381 bp, Zea mays
  Clone ID: cC-zmpo148064f06d1
tgaactctggcatcttcaccaacaacaattttatctctattggacccgggagcaacggcgggtagggggacatcataacctgcggccccccccatgtcatcatcgtctgctgcctatgccgctacaaggactagaaggacgtgagcgacatcacggtgcgtaactgcgtgctcaagaacaccaccaacggcgtgcgcatcaagtcgtacgttgactccgagtccgtgctgacggcctcccatcttacctttcaaaacatcacgatgtatgaggtggccaaccccatcgtcatctaccagtacttctgccctcaaaaagtatgccctggcaagcggagcaactcctctcatgtctccgtcaaggacatcacctttcacaaca

SEQ ID NO: 14053 - DNA, 341 bp, Zea mays
  Clone ID: cC-zmpo148064f07a1
atcgaattgtaatggattcaagggggggcaagcgatatacaagtgttaatccctctctcagggggaagaacatcagcggcatgcatcaattcgttaaattaaggagaaagagggaacaaagaaaaagaggacaaaaggtgtgtcgaatcaaaaacatgcccacgcatcggaatgcgcgcagccatgtcactctctctcccgcttcgtctcttcctcggcctccgggcgaccggccgcggccggctcactgaatgtagtaggcgaagaaggaggcgacggcggcccctagggcggcgccgacggcgggcgctactgcagaggaacctctggtggggcccgga

SEQ ID NO: 14054 - DNA, 390 bp, Zea mays
  Clone ID: cC-zmpo148064f07d1
cgcagagctagctagccagccagccagcagccagcttgcttgccttgcccgtccttcttcctcgcctccggtggggtccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcccgcattccgatgcgtgggccatgtttttga

SEQ ID NO: 14055 - DNA, 492 bp, Zea mays
  unsure at all n locations
  Clone ID: cC-zmpo148064f08a1
aacttggcaatccatttcttaagggttnggttttaaacaacagcgaagtctcactctacctatatatggagatgaagaagatggagaaggaggatgacaccatcattgttggcgccagcatcactgtcgtaatagggtagtggtagcaaatagatatcacggtccaatgcatgcatgtgtaatgcattgcttgggatccaacccaatctagtatagctagcataggtcggcttaaagtattgtcagcactaaagttaattatttggcggtgtaggcggtgttggccttccagttggcagggatgacatcgtcatacacggacttggtgcctccctcggtagtgaggcggacggtgaggggtcccttaagcggtatgtcgctgtccttccttcaaatggcgccccaggagtgctttagaggcttcgacgtgtcggagcccttcttcttgacgtccactgccacaatggcaccgtcgccgtcgccgtacttgac

SEQ ID NO: 14056 - DNA, 501 bp, Zea mays
  Clone ID: cC-zmpo148064f08d1
acaaaacatggatgtgaatgtgagaaccatgtggtcgtttgattcgggcacaggttgcgatggctgtggggtgggggttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgacatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctgcgcaaggcgggcatcatcgacatgc

SEQ ID NO: 14057 - DNA, 396 bp, Zea mays
  Clone ID: cC-zmpo148064f09a1
gataaggaggatgacaccatcattgttggggtcggcttcactgtcgtaatagggtagtggtagcaaatagatatcacggtccaatgcatgcatgtgtaatgcattgcttgggatccaacccaatctagtatagctagcataggtcggcttaaagtattgtcagcactaaagttaattatttggcggtgtaggcggtgttggccttccacttggcagggatgacatcgtcgtatacggacttggtgcctccctcggtagtgaggcggacggtgaggggtcccttaagcggtttgtcgctgtccttcctccagatggcgccccaagagtgcttcataggcttgtacttgtcggagcccttttccttgacgtccactgccacaatgtcaccgttgccgt

SEQ ID NO: 14058 - DNA, 594 bp, Zea mays
  unsure at all n locations
  Clone ID: cC-zmpo148064f09d1
cactaacccaagacaaaacatggatgtgaatgtgagaactcatttggtcgtcgatgcgggcacaggttgggatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctgctgcaggcgggcattatcgacatgcagtttcgaagggttaagtgcaagtacgactccaggtcaccttccaccttgaaaaggggtgcggccncaactacctggcact

SEQ ID NO: 14059 - DNA, 305 bp, Zea mays
  Clone ID: cC-zmpo148064f10a1
aaacccatagtaaatatgtaatgggggacggggctcatgacatggcaatgcacttgcattgtccacggacgcggacgggtgcttcattgttaaaaaaaatacaacttgcaccccaaaaagtaccttgaccatctgtcgacactatatgaaaaccagcagtggtgttacatgcatgcatgttttgacttaacgagcctaggcaattaagcccacagaaattaaagttagcgtcttcctctctacgcgtcgccagacgccttgttggggctgccgcctctggtgggggaaccaccacctgcgtgctt

SEQ ID NO: 14060 - DNA, 596 bp, Zea mays
  Clone ID: cC-zmpo148064f10d1
attaaaggcgcgggggcaacaacaagaatggggggcgttgtttgtggcggcaactcgcgggagcttgaccagaggccgacatgggcggtggcgtcggtgtgcggcgtgatcgtgctcatctccatcctgctggagaaggggctccaccacgtgggcgagttcttctcccaccgcaagaagaaggccatggtggaggccctggagaaggtgaaggcggagctcatggtgctgggcttcatctcgctcctcctcgtgttcggccagaactacatcatcaaggtctgcatcagcaaccacgccgccaacaccatgctcccctgcaagctcgaggccgccgccgtcgagggcaaggacggccacggcaaggaggccgccgccgtggtcgctggcaagaagaaggtcgccgtcgccgtccctggaaagaagaagaagaaggccgtcgtcgccgccgaccatctcggcggtgtggtggactggccgtcgccctactacgcgcacaacgccaggatgctggcggaggcgagcatggcgaccaagtgccccgaggggaaagtgccgctcatctccatcaacgccctgcaccagctgcacatctt

SEQ ID NO: 14061 - DNA, 267 bp, Zea mays
  Clone ID: cC-zmpo148064f11a1
ggggtatgttttttttttttaaaaaataaagccccaatccccccttttttatataatttggccataaaaaattatattaccttctctaaaaaaaaaaaaaaaacaaccgcatcgacctttattaaataaaaaacataaccctttattggccgagcccatcccatgttttgtccaatcgcatttcatacacatgcccaccgaccttttttaatattactagggggcaccttatatactgtttttttttacaaaaaaacaaaacccttt

SEQ ID NO: 14062 - DNA, 517 bp, Zea mays
  Clone ID: cC-zmpo148064f11d1
caaagccacaacacatacaggaaagcaagcaagaatcatcggtttaatggcccgtgcatgcgtgttccgggtggggctcctcctggccgccatcgcggtggcaccgttcgcgggcgccgcacgcgtggacgttgtggagggtaggtccatggcatccgccgatgcaccggaggcggcggccgatgctcccgctcctagccccgactccgcctcatccccagactcgtcatcggaggcgccctctagcagcagttcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgcttatttctttatttattatatgtctctctcgtttgctttttatttttcttaatgcaagtaatataatttgttatacccaatatatatagacaatgtgtgctatgcgctttaattctta

SEQ ID NO: 14063 - DNA, 356 bp, Zea mays
  Clone ID: cC-zmpo148064f12a1
ttttcttctattttttttaaaatttctccactctcttgtgtaccagtttttattttttattctaataacaaccacttcttttattccattaattataagcatgcacaaaaaaaattacctactgtccgtgcatgcaccttccacctaatataattattgccatatcataccttattatcaaagaaaaaaccatcaacgtgactacccttccattctctacagtttacatctccgcataggacaaaataaacactctccacttgccacaccatataacaaacttaccctccttgactttttccattatttttcttcactaacttcttcttaaaaaacaacttgttctaattgggcct

SEQ ID NO: 14064 - DNA, 619 bp, Zea mays
  unsure at all n locations
  Clone ID: cC-zmpo148064f12d1
ctcaaggacaagctaaggcacgtacgaatcaatcgatcgcagcttcttgcgagtgatgcatgatccctgtttgcttcggctggtttgcatatacattgcgtgcgtggagagcagcgagatggaccacgacggagacggcaggctaagcctggaggagttcgtcgcccaatctcacatcatcatctccggcgcgcgtcacgacgacgacggtggccatgcccatgaccttgagcgtgccgaagctgcgaagaagttcacggaactggacgccgacaaggacaagctacttgacggtggaagaagcgcgctgcgtactgcagagcctcgttacgggggagttctcctatgctacctcacatgccaagttcttgatgaaggctgatgtgaaccatgacggcaaactgtcgctggaggagatgctagacgactacatatccttctacagcaccgtgtatatggatgatcattacgccagtgaaggtgaagtagatagtgattcccgcgacgagctatgagcagttaagccaggacaggacagcacgtcggaggttctttactttcaaatacactangattttgcagccaaaggaaatgggaaatgtacaatcagctgcaaaca

SEQ ID NO: 14065 - DNA, 476 bp, Zea mays
  unsure at all n locations
  Clone ID: cC-zmpo148064g01a1
caccaccaaagagatataacgggggacggggaaagatatacaacgtgtcaccactttcatccttttacactacggctgtttcacttgaataaaaagttgaataataaaaagtggtgcttataacaagaacaatcttatattgtccatatgattactgttcacatgcaaagaacctgtgctaactatacacaactagtataaataatctgaattccaagctggtaaataaatgaaagaaaccagaaagaaaaagggttacaaatgagagagccgaggaagatgtacagttttgcaaacaaaacttctgctgcctaaaacagcgagatgtaaaactatttccttcgtagctatattttatgaaagtcgtcaaggagctaggcagttngcaccaaagcggatggcatcccatatttctttagtcgtctgaaacgtcttttagctaacaaaatccccttcttgatagttgatcatgtttt

SEQ ID NO: 14066 - DNA, 589 bp, Zea mays
  unsure at all n locations
  Clone ID: cC-zmpo148064g01d1
ccgtccggggaggaggagaggaaagagacagacgaagggcgcacctggtttgaggacctggaggaggaggcacacggcacggtccttcctcttgcacgcggagtcctcaagcgggcctcctcctcggccttggctcaaattccgggtgccataacacgacctccgccggcggccaccggcagccatgtcgcccttctacctcgctcgcggtgcttccaagctagtgagaaggattacctcggagacatcggtcgagctcaagattctatctgataaatggcggcttctcctcgctggcctcattttccagtacatacatggcttggccgctcatggggttcattatctgcaccggccgggccctacccttcaagatcttggcttcatgattcttccngagcttgngaaagaaaggggttacatcagtgagacattgtttacattcgtctttctcaccttcgttttgtggacatttcatcctttcatccttcagactaaacgcttgtacactgttctgatatggcgcacggtacttgccttcttatgtgcttctcagtttcttcgaataataacattctatgcaacacag

SEQ ID NO: 14067 - DNA, 462 bp, Zea mays
  Clone ID: cC-zmpo148064g02a1
atagcccaattagaacatgttgttggggagggagaacttcgtggaggaaaataatgggagacatcgaaggttactttgttacatggtgtggccggtcgagagtgtctttcccgacctatgccaaactgtagagaattcaagtgtcgtctccttgcttgatcacagtatcacacactgaacatcaggcatcatcagccaattatattaattggcacgcatgcacggacagtccatcagctttgctgcgccagcttctccttcccggcctccttggcgttcttttttgcctccaccgacgtcgtggtctcggcggcggtggcgaccttttcctctgcatgggctgctgccgctggcttctccttctcgacgacggtcttcttcacggctttcttctccttgtggtcgggcttggcgacggccgcctctggagcgagcacctcattagcccttctgatgctcaac

SEQ ID NO: 14068 - DNA, 562 bp, Zea mays
  Clone ID: cC-zmpo148064g02d1
cgtgcgcccacgcgtgcgattgaagcacctcctcttcccccgcttggctttcaactcagccgccgcaaccgccacgtgagggatgggcgcctgcgcaaccaagcccaagacgcttgaggggcaggccccagctgaggccgtcgtctgcacacccaagggtgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgtcgagaccacgacgaccgtggaggcgaagaagaacgccgaggaggcccggaaggagatgctggcgcagcaaagctgatcgactgtccgtgcatgcgtgccaattaatataattggctgatggatgcctgatgttcacagtgggatactgtgatcaagc

SEQ ID NO: 14069 - DNA, 392 bp, Zea mays
  Clone ID: cC-zmpo148064g03a1
gggccagcaaccaatccatacggggagggggtgcatccgaaacaagacgaagggataccacaccaacttaaaatgaaggttcaggcacacaacttgccgtgaaatttaaagacagtttacaaccccatgcaggacgggaagtttgccacaaaaaaatcaaccatgcccacaaagcattgcacggggtacacacatgaaatgacaacggttgtttacgattcaaacatatcacgcagcaggcaggggaggataactttggtgagcgcaccaccacgggcattatttgccaccgaacaggtagcccagggaaaagccaccgccaggagcagcgtggaccttggttgaaggacggtccgtaaggaagttgccagtgttctcggacgcctggcgga

SEQ ID NO: 14070 - DNA, 417 bp, Zea mays
  Clone ID: cC-zmpo148064g03d1
cgtgcgccacgcgttcgagaacactggcaacttccttacggaccttcctttaaccaagggccacgctgctcctgggggggggtcttccctgggctacctgttcggtggcaactgatgcccgtgctggtgcgctcaccaaagttatccttccctgcctgctgcgtgctatgtctgaatcgtgaacaacccttgtcatttcatgtgtgtaccccgtgcaatgctttgtgcgcatggttgatttctctgtggcaaacttcccgtcctgcatggggttgtaagctgtctctaaatttcacggcaagtcgtgtgcctgaaccttcatcttaaggtgttgtcgtatcccttcgtcttgtttcggttgcaccccgtgatggtattgattggttgctgacccattaaaaaaaataaaaataattt

SEQ ID NO: 14071 - DNA, 409 bp, Zea mays
  Clone ID: cC-zmpo148064g04a1
gcatattaaccgcttaccattttatacggggtggggctctatttaagagttgggttgtgttcttaaacttgtacattgcaatgtcctctgtggcatgaaatttacatcatgtatatattttgaatggaattatacatccacactagtagaatgaataagaaagttcgcagattgccagaggcctaaaaaaagactggcgagagtgagaaagagagaggtgacgaacagtgagtgatggatgcaagtaggttcagacgcaggcgagctccttcgccatgccaatggacttgccgatggcgttcttgcagacggacatggtcttgttgtcggacctgttgtacttgatgtcgacgttgatgagctgcacgccctggcagggcaggttgttggcgcatttgagcgtgatggc

SEQ ID NO: 14072 - DNA, 533 bp, Zea mays
  Clone ID: cC-zmpo148064g04d1
ccacccgtgcgcccacgcgtgcgggcgttcatcagcagtgcggcgatgaaggcttccgtggccgctctgctggtgttcggcgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctggacggcaacctgctcggcaccggcgacctcaacgcgtacaagaggaactggatcgagatccagaacgtggacaacctgtgcatgaacggccacggcaccatcgacgggcagggagccctgggtgtggaacaagaacgagtgccagcgttcctacaactgcaaaatgctgcccaaca

SEQ ID NO: 14073 - DNA, 417 bp, Zea mays
  Clone ID: cC-zmpo148064g05a1
tttctccttttttttttttattcttctctcttttagggggaggttttttttttttttttttttcgcaccccaaaaaaaaccaaaaagttggttttatccataatccatccaaccccatttttaaaaaaaaaaaaagacaattaccgcccccacaaaccaggaagccccaccctaaaaaaaaatcttacaatacaccattttttgaccaaatcttttttcttccccaaggttttggcattaaaaaaaaaaaaaccccaaccctcaaaaaaaccttccttttttaaaaacccaaaattttccaatggaagagaaaaaaaccccccaacctcttttttttttacaaaacttgggaaccccacaaaaccaataggcccttaccaaaccctccttcccaaaaggggataaaaaaccttaaca

SEQ ID NO: 14074 - DNA, 519 bp, Zea mays
  Clone ID: cC-zmpo148064g05d1
cacccgtgcgcccacgcgtgcgtccacgcgtccgcatggctgcgcgcttccattctactcgcgttcttggcacctttgggtacggggcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtccatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtgggcctgccacgctgccgcagcagcagagcgatcctgactgtgatttcccatcgctgcgacaactgtgggttcacgaaaaa

SEQ ID NO: 14075 - DNA, 476 bp, Zea mays
  Clone ID: cC-zmpo148064g06a1
ggaacgtcgggaaccgtcttaggcaggggggagtatcacaaaacaatcttcgtgctcaaccagtaacgagtagataataaggagacgacatcaaatatcttccaaaattcaaaccaggacaacaaattgtgctactaatctcggtacagagtgatgactaattactgtcgactgatcaaacacaacggttgcactatgctgatggcaacacggagggccacaatttgttttaaaccttgaatccacggctgttcctcctgccacgagccttctcgaacttccttcccttggagcgcacatacggcttggtgtggctgtgcggcactccaggagccttgccaaagtgcctcactgcctcacgggcattcttggggcccctcaagaggaccgtgttctcgccaagtggagcacgaagagcaagctggtcaaatgtgaagcactcgccaccagcattgacaatcctggcccttgctgtc

SEQ ID NO: 14076 - DNA, 527 bp, Zea mays
  Clone ID: cC-zmpo148064g06d1
gacgacgacacgtatggcagggcagcaggccaaggtaagcagctttcgctttatccctagcgccgccgcacccgcgggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacaccgtcctctagaggggccccaagaatgcccgtgaggcagtgaggc

SEQ ID NO: 14077 - DNA, 498 bp, Zea mays
  Clone ID: cC-zmpo148064g08a1
acgttagaggcaagttcatatacttgccggggggggtctttttatagccatgacaactatatcacagagaacattacatgagccaaattgacacactgaaaaaaaggctccaaatttttcatgccggcatgctcctgctcttcctatgtacattggcaccaatgggctcaagcagcaacaatcatccattcttatattgcattattgttcaattctcccaatgatgcgaactgccgctgccgctaccggaggactgcgccgatggcgagaacaggctgttgagccactgcaaggatggcggcaaccggctgccgttctcttcggctttggcgggctccgcattgcctggaatacttgccctaccatcgccgccgccggtggcattgccttcaccatccgcgttgacactgacaaaaccaccggcggcgatgatgcatgagtctttggcggtggtggcccggaacttggaacccggcagacaagggcaggagctgtgca

SEQ ID NO: 14078 - DNA, 629 bp, Zea mays
  Clone ID: cC-zmpo148064g08d1
gggggacccacgcgtccggcgagcatggcgtggggctgggcgactacttcctcggtccctttctcgacgctctggtgcagcagctgggcggggacgactcgggacggcacgggacgccgccggccaagaaggaggccgtggaggcaatgccgaccgtggaaatcgccggtggcaatggcaacgatgacgacacggccagctgccccgtctgcctggaggactacgcggccggcgagcgcgctcgggagatgccctgcaggcacaggttccactccaattgcatcgttccgtggctcgagatgcacagctcctgccctgtctgccggttccagctgccggccaccgacgacaagggctcatgcagcagcggcgacggtggttttgtcagtgtcgacgcggatggtgaaggcaatgacaacggcggcggcgatggtagggcaagtattccaggcaatgcggagcccgccgaagccgaagagaacggcagccggttgccgccatccttgcagtggctcaacagcctgttctcgccatcggcgcagtcctttcgtagcggcagcggcagttcgcatcattgggagaattgaacaataatgcaatataagaatggatgattgttgctgcttgag

SEQ ID NO: 14079 - DNA, 381 bp, Zea mays
  Clone ID: cC-zmpo148064g09a1
aaaacagattattaaggggggggggggcggtcgatccgatccagcacatcttgcacgtcttaattatcctctcaggcggcggcggcggacgccgtgtggttaccatgagaagcatcggcgagggacatggcgacggagcacatcttgccgagggcaccaatcttgtcgacgatgcgcatctcgccgccgccctccaccttctggcagtcgctcaggcacgagtcgccgtcgagcttcgccgccgtgagccacgtgtcgacggcggcctcgtccttggccttctgcaccgccaccttggaccgttgcaagtcgaccagcgcgccctggaacttggccacgcactcgttcaggcacacggggcggcatgccccccggcatttt

SEQ ID NO: 14080 - DNA, 587 bp, Zea mays
  unsure at all n locations
  Clone ID: cC-zmpo148064g09d1
cgcgttccctgtaatgccaccaccaccgtcatcaccatcgcttgcccggatcgtcaacatggcagccgccctgggtgtcgtcatcgccgtcctcgccgtcgtctcggtctctctccggcgcgccacggcggccacggtccccaccgtcgacgaggcgtgcaagcagtacaccaagtacccggagctgtgcgtcaagtccctgtcgtccgcggcgccggaggcgaaggcgaaggcggagcggggcgggctggcggggctggccgggctggcgctggcgcaggcggcgcagtgcggcgccgagacggtggcgttcgtcaagggcctggagaaaatgccggggggcatgccgcccgtgtgcctgaacgagtgcgtggccaagttccagggcgcgctggtcgacctgcagcggtccaaggtggcggtgcagaaggccaaggacgaggccgccgtcgacacgtggctcacggcggcgaagctcgacggcgactcgtgcctgagcgactgccagaaggtgaggngcggcggcgagatgcgcatcgtcgacaagattggtgacctcggcaagatgtgctccgtcgccatgtccc

SEQ ID NO: 14081 - DNA, 248 bp, Zea mays
  Clone ID: cC-zmpo148064g10a1
ggaaggaacgttctatagaacagggaagagagaatcatcaacagcaaccatcgacggaatgggccacgagggtggtatgctagtgtaatagtataacatggcgacaacacgaaaggggacatcaaaactcatcggggtccctgcaaccaccaggcttcacatttaacagccttccctcacatgccatcagctggctcctcctcgtcctcatactcggcctcctccggacgcgtgggcggacgcgtggg

SEQ ID NO: 14082 - DNA, 254 bp, Zea mays
  Clone ID: cC-zmpo148064g10d1
cccacgcgtccgcccacgcgtccggaggaggccgagtatgatgtacgaggaggagccagctgatggcatgtgagggaaggctgttaaatgtgaagcctggtggttgcagggaccccgatgagttttgatgtcccctttcgtgttgtcgccatgttatactattacactagcataccaccctcgtggcccattccgtccatcgttgctgttgatgcttgtgttttccttgttctatagaaccttccttccgtatc

SEQ ID NO: 14083 - DNA, 303 bp, Zea mays
  Clone ID: cC-zmpo148064g11a1
ccaaaaaaaaaccccccccccattttttttttctataaacaaacaaatcccatttttatccaaaaattttttccccccccccttttaaacaaccaattaaaaatcaattaaataatctttgcccgggcgggatacccctcatcctatctcaaaacctccccccctttttcccctttataaaaacccctttatcaacccccaaaaaccccctaaaacccttcttttttaaaaacctcctttctataacccccctaaataagttcctctttcaaaaaaattaaaaaaaccccttttttctcctcc

SEQ ID NO: 14084 - DNA, 609 bp, Zea mays
  Clone ID: cC-zmpo148064g11d1
atttcttctcgcctctcccaccggcccggtcgcccggtgaatctaagcgtctccgatccgatccatcgggcgagggtatccacggcgatggaggcgagagcggccatgagctggtactgcggctcccttctggccgtggccatcgcgctgttcctgtccgtgtccctcggcgtgcgcgccgccggcgccggcgccggcgttgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgctggaccacctggacgacaccgagggcggcctcgacgacggcaagctccacgacgtgaagctgttcctggacacggcggaggaggacacgtggtcctgcgacgtctgctgcaagcacgctccatccacgcccgtcaaaaccacgctgctcgccaagaacaaggactttgaggcgctcatg

SEQ ID NO: 14085 - DNA, 193 bp, Zea mays
  Clone ID: cC-zmpo148064g12a1
taaactatcatcctctaaaacgaccacccttttttcttcctctttctctttttcttcttttattttttttgtgtactgtttatttttaattttcttttacaacccaacccttaatatattcaaataaaactcacacttactacacaaattattcaaaaaccacacaaaccaaaaaacactataaccccacaat

SEQ ID NO: 14086 - DNA, 123 bp, Zea mays
  unsure at all n locations
  Clone ID: cC-zmpo148064g12d1
cggtcgaccacgcgtccggcgcaaccggtagtgtgtatatcaggacatgtcacattatttttacctgngnccgataaatcttcagggggngggctttattaaagttcaagccaataaacctca

SEQ ID NO: 14087 - DNA, 432 bp, Zea mays
  unsure at all n locations
  Clone ID: cC-zmpo148064h01a1
ctttcctttttttttcttctttttctttctttttttttttcggggcnngggttttttttttttttggaacccaataaaatctggaaaagggaaaccgaaaaaaaatgcatgcaaatgcaagggcatccaacaaacaaggcaatccagggcccggaggcttcccttggcgggtcccttggcgttgctgcacacaaccatgggcttgttgttcttgccggcgtactcgaccttgacatcaaaaaaccaaacccccctgcaccggtgctttttggaacaaaacaagctgaccgcttcgggcctggaccacctgcccgaaaagttgcggaaggggaccttcttgaaggaaacatgccaggagtttctttccttgcccggccaaaccttttgggggcaaaaaaaccggtccaaaataatgggggtggcccccccccc

SEQ ID NO: 14088 - DNA, 522 bp, Zea mays
  Clone ID: cC-zmpo148064h01d1
ggggcgacccacccgtgcgcggacgcgtgggtccacatcaacatcgacacttctaatgacattaccgtgaaggatgtgaacatcacggggccggcggacgtcgagaacacggacggcgtccatgtcggcgggtcctccaatgtacgcatcaccaactcgaccattggcaccggcgacgactgcgtctccatcggccccgggagcgacggtgtcatggtgaacaacatcacctgtggccccgggcagggcatcagtgtgggctgcctaggccgctacaaggatgagaaggacgtgagcgacgtgacggtgcgggattgcgtgcttaggaacaccaccaacggcgtccgcatcaagtcgtacgaggatgccgagtctgtgctcacggcgtcccatctcaccttcgagaacatcaggatggaggaggtggccaaccccatcatcatcgaccagtacttctgcccccagaaggtctgccccggcaagcgaagcaactcctcgcatgtctgcatcaagaacgtcacc

SEQ ID NO: 14089 - DNA, 407 bp, Zea mays
  unsure at all n locations
  Clone ID: cC-zmpo148064h02a1
ggaaggcctatcaaagggggngggaggctcttattatataacgggtcaatccactttcttaactcttctcttttaaacaacagcgaagtctcactctatctatatatggagatgaagaagatggacaaggaggatgacaccatcattgttggcgccagcatcactgtcgtaatagggtagtggtagcaaatagatatcacggcccaatgcatgcatgtgtaatgcattgcttggcgatccaacccaatctattatacctagcataggtcggcttaaagtattggcagcactaaagttaattatttggccgcgtaggcggtgttggccttccagctggcagggatgacattttcataaacggacttggtgcctccctcggtagtgaggcggacggtgaggggtccctt

SEQ ID NO: 14090 - DNA, 485 bp, Zea mays
  Clone ID: cC-zmpo148064h02d1
cccgtgcggacaaaacatggctgtgaatgtgagaaccatgtggttttcgtttcgggcacatgttgcgatggctgtggcgtgggtgttcttggtgagcggcgcatggtgcggtcctcccaaagtccccccaggcaagaacatcacggtcacctatggcaaggactggttggacgctaaagcgacatggcatggcaagccgacgggtgccggtccctacgacaacggtggcggctgcgggtacaaggacgtgaacaagccccccttcaatagcatgggcgcatgcggtaacatccccatcttcaaggatggtctgctttgtgggtcctgcttcgagatcaagtgcgataagcctgtggagtgctcctgcaagcccgtggtggtgcacatcacggacatgaactatgagcctatcgaggcgtaccacttccatctagcaggcacggcgttcggcgccatggccaatacaggcgaggaggagaagctac

SEQ ID NO: 14091 - DNA, 443 bp, Zea mays
  Clone ID: cC-zmpo148064h03a1
gtgcatcttctctttcctttagggggctggcacagtatacacagacacgttctctggtgtgtcgcactttcaactcccctgtttcttacatggcgagccggcgaatgcatggtctgcttctggtcgtcggccgtcctcgctggtggcttgatctaacagggcttgccgggcgtgcaggcgagggagccggcgtagcgcgtgagcctggtgacgtaggacccgttcctgggcttgatgaggtccttcttgttgaactgcctgttgatctggccgccggtgacggtgaagtaggcgccttccatgaagaggtcgttctcggagtgccacacccagttcttccacaccgactccggcgtgtcatgctgcttggtgacctgcttcccggcaaggttgggccgcgcgatgtaacgcgtgccctggctgatgatggtgggggccttgct

SEQ ID NO: 14092 - DNA, 525 bp, Zea mays
  Clone ID: cC-zmpo148064h03d1
ccaccgtgcgcggacgcgtgggcgctcaccgccgtcctaccttcatatacctttcagtgtctctgcatagaaagataaggggtgggaggaggcgcagtgcgtggtgggattatttgtgaggagatattggagttattatatatatatatataggtagacgatagatagacagctagatctatataaccatggtggatgggttccgatggatcagaccgggctctttcgtcctgtacttggtcttcttcttcctgtccgcagccctgtcggaggccaatatcggcgacttcgatgaatactggcagcagcgcaagctcatggccgacgccgcggctgaggccacgtacaagcatgacccggtcgaggtcgccaaccaacttaaccgtgcagtccacagatccgtcgagaaggaggacattggcacgaggcgggagatgatggggacgacgacgaggaagtctaagttcagcgggccgtgcagggcgacgaacccgatcgaccggtgctggcggtgccggcaggact

SEQ ID NO: 14093 - DNA, 411 bp, Zea mays
  unsure at all n locations
  Clone ID: cC-zmpo148064h04a1
gcccaccacggccagttttagtccatctcgggcggcaacaacccgggggggggcgaccatcgcggcacgcagcgcctctacatccggctcaacaccctccactacctgctcagccacatccaggcgctcgacaaatccctctccttcttctcgcacggcgggtgcgcgtcgccggcgtcggtctcgaaccgccagctggcgccgtccggccgtttcgaccgtgcgcgcgccgcggcgcagtcggccatcgtccacgtcgccgaggtcgccgcgtaccgcctcgtcttcctggactcgcaccactccttctacggngggctctacgtgcggggcgtcaccaacgcccgcattcgccccgcgctccgcgcgctgaaacagaacccgtcgctgctcgtctccatcctcgtggac

SEQ ID NO: 14094 - DNA, 366 bp, Zea mays
  Clone ID: cC-zmpo148064h04d1
gggcctgctcgccaggggccacgacaacaacgaccacttggaattttacgaaccccacaaaccaaaccgggaggggctacactaaaaccaccagacgcgccccaaccaccaagaaggaaaccaacaacaaccggacccccaccaacacgccgaccacaagaacgaccccgacgacaaccaccccccacaaagaaaacccccccaccaaaaaaacgagccaatacacaaagaccaagccgaccacccacgacccccgcaacaaccacgaaacccccacgaaccacagagcccgcaccgaccaaacaaccgaacaagaccaactcccccaacaaaaaaccaccccggcgaaaaccaacccaacgaacc

SEQ ID NO: 14095 - DNA, 465 bp, Zea mays
  unsure at all n locations
  Clone ID: cC-zmpo148064h05a1
gtattattaattcaatatataagtattatatggggnggggagaccaatcgcaaacagaggtggttcatgttatacaaactgtatacgtagatacacgcgtgtgggattaaatcaatgattaaatcaatccctacttcctctgtggaaaaaaaatttgaccaaactgtactgtgatgtgtaacaatgccacaacacagtacttgaaggcaaacgtatgtagattaattagcagaacgacaacctgtgatccatccttgctttcttccatgaaatgaaacgcagccagcgcgacctggcatggccaggccatgagctagaagaagcagcctgatgcccaccggccttcagcacggcttgcccgtgcagcaagacagtgtgccggagaagcgggtgagccttgtaacgtacgttcctggcttgggctttacccactcgttggtgtcgacctgcttgggggcgcccgga

SEQ ID NO: 14096 - DNA, 467 bp, Zea mays
  Clone ID: cC-zmpo148064h05d1
cccgtgcgggcgcccccaagcaggtcgacaccaacgagtgggtaatgccctttccaggaacctacgttacaaggctgacccgggtctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaattttttttccacagaggaagtagggattgatttaatcattgatttaatcccacacgcgtgtatctacgtatacagtttgtataacatgaaccacctctgtttgcgattggtctaaaaataaatataatacttatatattgaattgttttgc

SEQ ID NO: 14097 - DNA, 295 bp, Zea mays
  unsure at all n locations
  Clone ID: cC-zmpo148064h06d1
aaaaaaaaaaagggaaaacaaacccaaaacatttaacctccaccccaaaaaaaaaaacaaaccgggaaggggggaaattaaaaacaaaaaacccccccaaacccccccaaacnancaaaacaaccaaacaaacaacaacacacaacaaacaaccacccaaccacaaaaaacaaaccaaaccacacacacaaaaaacccaaacccacaaaacacacaaaaccaaccaaaacnaaccaaaaacacaccaaacaaaaccaccacaaaccccacaaacaccacacaacaaaccacccca

SEQ ID NO: 14098 - DNA, 425 bp, Zea mays
  unsure at all n locations
  Clone ID: cC-zmpo148064h08a1
atattcngatattattttaataatggggacggagatatgtgatcaaacaaaaatataatgtactacaaagttgtagatcaattcgagagctatatgattttcatataaactttattttcatataaactatatccatgcaagccgtcaagaacatgcggtgaagaatgtctgtctcacgcagcgcgtgacgcttcgagactaatttatgttggtctagtgtgattcttataatcaaatcacgtaatacacatgcaaaaactcatatgcagtatactaatgtgtacacggaattggggtcctccagattacgaggcccaccagggcggttgccccctttgcccccgccctcaagggccggccggcgctggtgcctgcacgcgcgtgacgttgcgcgcacattgaccaaaaccaccggagatatgatc

SEQ ID NO: 14099 - DNA, 629 bp, Zea mays
  Clone ID: cC-zmpo148064h08d1
cttggcagcggcgggggttctgtgcctgctgctggcgaccgtttctcgcaggaggccgccggcgccgaggggagggggtcgtatgataagttgctcagctgcaaggtgctgggcaactgcgacaagaacaggggccccggggccacccgcccggggaagcccgtaaacaagtacacccgcggctgcagcccgctgacccggtgccgcggcggctgatcatatctccggtggttctggtcgatgtgcgcgcaacgtcacgcgcgtgcaggcaccagcgccggccggcccctgagggcgggggcaaagggggcaaccgccctggtgggcctcgtaatctggaggaccccaattccgtgtacacattagtatactgcatatgagtttttgcatgtgtattacgtgatttgattataagaatcacactagaccaacataaattagtctcgaagcgtcacgcgctgcgtgagacagacattcttcaccgcatgttcttgacggcttgcatggatatagtttatatgaaaataaagtttatatgaaaatcatatagctctcgaattgatctacaactttgtagtacattatatttttgttcgatcacatatctatgtcgaaaatattaaaataat

SEQ ID NO: 14100 - DNA, 481 bp, Zea mays
  Clone ID: cC-zmpo148064h09a1
ataaaaataaaatggctttaataccgagagggatagttacaaatcgggagtaggagctttatatgctactatcgatatacaaaccgagagcacagtacatatggtcacactactacaggtgcacgcatgtattgccgcttataaatgtgggaaaaaaaaagataacccgtttctctagcaatggaaagaagaaatgacaaaaacacggcacacacacagagaaggatggctttttttcactgatggtcgtctgatggaaacacttgttccgtagtgtataccgtgtggacgtgtggttaatttcatgcaggagctctcccttaaaccttaatcactgcagcagcagcagcagccgccgccgcctcctgatgagcggcggcggcgaccgccgagaaggtcttctccatgactttgagcttctcgggaggcggggccgcagcgaccgcgttggccgcctggccctatgcaacaaggatttttg

SEQ ID NO: 14101 - DNA, 605 bp, Zea mays
  unsure at all n locations
  Clone ID: cC-zmpo148064h09d1
gatcgattacagcagtggcggccaaggtgttcctcctcctcttactcagcatggtcgccgtcgtcctggctggggtcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttctgcgagacctacgccaagacggagaaggccttcagcggaaccatcgcctccggngacacgcccaagagcaagctggggatcacggacgccgtgctcaagctgaggctcgccaccgacgccaacatcaacaaggcctacgcggagggggac

SEQ ID NO: 14102 - DNA, 299 bp, Zea mays
  Clone ID: cC-zmpo148064h10a1
caggcttcactgttccgaaattggcgttgggtaacaaaaaaaatttgactttcatatttttaaaatgtgataccgggccgagaaatggttcccctagctgaccagtaacgataaatttgcctaggaaccagacttttcggtcggtaattcgaagcatgcatgcatagcataggagtgaccaagatgcgtgtgtgccgccacgatatcatcactcatgcagtcgaagcagtgctctgccccgaggtcggcgctggcgctggtacgctggcgccataagctggggcatcaggagacggggc

SEQ ID NO: 14103 - DNA, 604 bp, Zea mays
  Clone ID: cC-zmpo148064h10d1
cagaccacaaaggaggggacacacacacacacacaccgtcttttcccgcccgccgcgacgcgccatgggtatgggtcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccgaggacatcgaggaagccgtggcgcacctcagcgccctctcccgcgacttctccgacgccaggttcctcgaggtcaagtcctggctcacctccacgctcggcggcaccgtcacctgcgaggacgcctgcaaggacgcccccgtcagcgacatcaagaacgtctgcataaccaagagcttcgagcttgagaagctgctgcgcgtcacgctg

SEQ ID NO: 14104 - DNA, 439 bp, Zea mays
  unsure at all n locations
  Clone ID: cC-zmpo148064h11a1
agcttgatattggaagtccagggcttgtgcgaaatgaaacaggtccaaagaacatccaacagtatagtagggtaataagcgttgaacagtaacatcattacacatcaaacaaaaaaaaatatatagtgcccgtagaagacatctaacagattgcaactgcgattctgtcctgagtttccatgatacatccggagctcctagtcagttcgcagttgatattcaaggtaggcctcaagccttgctcgcaatgttgctggacagccagtccaggccctcatacagaccctcgccagttgaggcacaagtgctcttgatgtaccactgtcgctggggcaggggagtgtaatccaagctctgtcagtaatctcagcagcattcatggcattgtgacncatcttgcttgttggcaaaaaccaagcagacagcattacctagctta

SEQ ID NO: 14105 - DNA, 570 bp, Zea mays
  Clone ID: cC-zmpo148064h11d1
cgcaggtgtgaaggaagggggacgcggaggaagatggggctttcgttcgggaagctcttcagccggctgttggggaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctgtatgagggcctggactggctgtccagcatcattgcgagc

SEQ ID NO: 14106 - DNA, 610 bp, Zea mays
  Clone ID: cC-zmpo148064h12d1
cacgcctggcctgggctggccgcctccgaccaccgtacgtcttccaccgcgtcgccgccggccggcctgtggggagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgtcgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcagcagggtctctgatg

SEQ ID NO: 14107 - DNA, 375 bp, Zea mays
  unsure at all n locations
  Clone ID: cC-zmpo148065a02a1
aaagtataaattttcagcacgccanaaaattaaaacggancgggatcgaagaaaaacacacatgggcccgacattacatttggagttccatcgacggtatattaggaaaaaaacaatttgctcaaaaaatgccagataaataggaatacaatatatagttccgtccatatcaaatggatattgcatgcgtggccagccggtgacgacatacgtatagactcgctcagcgcctgagctgaacgccacgttactccggcgcatgcatacatgcatgcatgcatggttcaattaattaaaggggcctttgctttaagaaagaggaggggtgcaagaactattgcaattcttgctgaggtgcgggtttttcttcttggc

SEQ ID NO: 14108 - DNA, 551 bp, Zea mays
  Clone ID: cC-zmpo148065a02d1
gtccgctcctgcatcaccaccaccaagctcaacaacagccagctcgataaatttatgaagagccgcagcatggcatcagcgggcgtgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaagagtgcgacaaggcgtacgtggtgaaggcggccgaggtcaccaaggcctgcagcgtcacctgcgccaaggagaaaaacccgcgcctcagcgagaactgcaagaggttctgcacccctcctccctcttgaagcgagcccccttgaatgaatgaacatgcatgcatgcatgtatgcat

SEQ ID NO: 14109 - DNA, 568 bp, Zea mays
  Clone ID: cC-zmpo148065a03d1
ggaagaaaccccgcgggcaccccttcctgcctatatttctctttttgttttgcgcgacagggagagaccagcggcagggcgctccggtttcttgattgggtggtcatcggtgaaggaaggagaaattaagatgagcctcttcgggcttgggagcaagaatcagaagacgttcaggcctaagaagaatgcaccgtctggcaacaagggtgtgcagctgaagaaacacatcgatgcaaccttaggaagcgggaatttgagggatgctgtccgattgccaccaggggaggatctcaatgaatggctagctgttaacactgttgatttcttcaaccaggtgaacatcctgtatggtactctaatggagttctgcacaccagctacatgcccaacaatgtcagctggaccaaagtttgagtatagatgggccgatggggtgcagatcaagaaaccaattgaggtttcagcaccaaagtatgttgagtacttgatggattggatcgaagctcagcttgatgacgaattcatctttcctcagaaactcggaacccccttttcacaaaatttaagg

SEQ ID NO: 14110 - DNA, 348 bp, Zea mays
  Clone ID: cC-zmpo148065a04a1
ggaaacgcccactggaaagggggacgggttctaatggacaattagctttagccctgcgcttacatacaaatattaaaccgatgaaagcgaccctgttaaataaataaataaatatcgcatagattttgcaacccctgcacgaaacgaaaccagactccgctcctcaaaaggaggcgaaggctcccgctgttacagcggctgcggctcatacgcactccgcggtgcttgctagtgcgacagtcgcgtttctgtcggctgctccacccgcttttgctatcgcgccgggcggggcggggacatccatcccttggctcagacatggtggccccgttgggcgcccctacaggg

SEQ ID NO: 14111 - DNA, 492 bp, Zea mays
  unsure at all n locations
  Clone ID: cC-zmpo148065a04d1
cgcgtncgccacgcgtccgcccacgcgtccgcccacttttttttttctatatacatatatagacctaggaaggacaaagacgtacgataacctgcttattttgcgacccatcccgttcccacgcaaaggcgccgagcgtgatctccgtccgtgccgccatggcctcgcaccgggcgctgctgctgctgctcctcgccgccgcgctcgtcgctgcgctggcctctgtcgcattcgccgacgacgccaacgccatgcccaccatcctgacccccgtggcgcataccccgctggggtccttcgacggcgacaagccggcctctgacgaggacgccgtcgacgacgacgaggacgccgcccctgtcggcgcgcccaacggggccaccatgactgaacccagggacgacgtccccgccccgcccggcgccgaagcaaccgcgggcggcgccgccgtcagcaacgcgcccgttgcactcgccagcgccgcggcgcgcg

SEQ ID NO: 14112 - DNA, 552 bp, Zea mays
  unsure at all n locations
  Clone ID: cC-zmpo148065a05a1
aaccccggatccaataaagcggacggccaanaaaaaaaaaaaaaatttttttttttaaaaaaaanaaaaaaaaaaaagggggaaggtgaaaattaaaatttaaaggggggccacaaaaaaaaaaaaaagaaaaaaaaaaaagacccggacgaaaccaaaaaaaaaggagggtaaaaaaacaaaaaagggaagaaaaaaggaaaaaaaacttcacccaacggaaaaaaaaaaaaaaaggggccacacgcaaaaaaaaggaaaaaaaaaaaaaaagggtaaaaaaaaaaaatgggcaaaagaaaaaaaaaaaaagggggggaaaacaaaaacaaaaaaacaagggaaaaaaaaagggggcgggcccggggaaaacactaaaaaaaaacggcccaacaaaaaaaaaaaaagggggaaataaggaaaaaagaaacaaaaaaaacgccggaaaaaaaacggaaacccccacataaggacccggagaaaaaacccggaaaaaaaacgacccccaacaaggaaaaaaaacccccccccgaaaaaaagctaaaagaaaaa

SEQ ID NO: 14113 - DNA, 542 bp, Zea mays
  unsure at all n locations
  Clone ID: cC-zmpo148065a05d1
cgcgtncgcggacctatacgnggngtacgtgaaggcctatcttttcaaggagtacgtcaccgngggccggccggggacgaacgaggccttcatcggccaccgcgccgagaagaccatcatcacggggaacaagaacttcaagatgaacctgaccaccaaggacacggccaccatgcaggcgatcggcaacggcttcttcatgcgggacatccgggtggagaacacggcggggcccgagaaccaccaggccgtggcgctgcgtgtgcagagcgacctggccgtgttctaccagtgcaccttcgacggctaccaggacacgctgtacacgcacgcgcagcggcagttcttccgcgactgccgggtgaccggcaccatcgacttcatcttcggcaacttccaggtggtgctgcagaactgcctgatccagccccggaagcccatggagaaccaggccaacattatcacggcgcaagggcggcgggacaagcgctccgtgggcggcaccgtgctgacaattgaccatcgagccccacccggacttc

SEQ ID NO: 14114 - DNA, 581 bp, Zea mays
  unsure at all n locations
  Clone ID: cC-zmpo148065a06d1
cggacggccgcgacgcccgaggcgcggagggcgctgaaccttatanattattctactacctggacgccgccgacaagctgggtgcctgcaagcgcgccatcggcttccgcgacgccgtcaccatccgcgccacgatgagcatggtggcgcaggacacgcagaactgcgacgaggagttcaggaaggccgtcttcaagaaccccatggaggaccacaacaggtcgctcatcgagatgttcgagatctgccgcacgctctccaacatgatcccttacgaacatgtccattgatttgtttgtttctttttcccgaccccctactacgttcggtaacgtcgtcgtcgtcgtcgtcgtccggcctaaaacatatgtaatttgatgctggtcgcgtgtgtctgtcagtcgatagactggacgcatgccgacttcatgcggacctagcgcgtgtccttcttttcggtgttgccttttgcggcgtggcacatgtcttgagaccgtgggatgaaacggcttgttgagacttgagaggcacgcctgtagggcaccctattatatgattttataacatgcttatttgtgctt

SEQ ID NO: 14115 - DNA, 451 bp, Zea mays
  Clone ID: cC-zmpo148065a07a1
atagacagacagactatataacatgtattggggtgatcactgacaaagaaaaccgccccctccctgcgtggaacattcccatgcaatgtcacaatatgaaagcatcacaaaacaacatgccgcatagtaaagtgctgaaggcgaataatggacaaaacaaaatgcctcaatgctcctaccatgtattaaaatttgacggaaggcaaatattgtggacaacggttgcaggatgcaaagcaagaactggagcccttgatctcaagaaactaatcagggaaatctaccggttgcattgtagcagccatcccatacaatacgacgtgtgtcgggcggcaaaacatctgatcagctgaacaattaaaaacgctagctatcatttccttgcccatcctgtagtgtgccgcccccgcacggacgagcgcgtgccttcgggtgcatgaagagctttaac

SEQ ID NO: 14116 - DNA, 531 bp, Zea mays
  unsure at all n locations
  Clone ID: cC-zmpo148065a07d1
acctaacgagctttgctccgacgacgacgacttttctttcagccacatggcggacgacgccggggcgggcggagcggccgnttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcgcggccgtgcgggggcggcacactgcaggaacggcaagggaatgatagctagcgctcttaattgatcagctgatcagatgatctgtcgccacgcacacgtcgtcttgtatgggctggctgctacaatgcaac

SEQ ID NO: 14117 - DNA, 257 bp, Zea mays
  Clone ID: cC-zmpo148065a08a1
tttttaattttttaataattttttttaaaaaaaaactataaaattcggttgttttttattttttgaccggggcaaacccccccaaaatttattttaaaaaatgttaaatgtgttaaaatactaaatgaaataacaacttttaaacaaaattttaattatcttttattccttttttttccctaaataatggtattcaatccattctttcgttttttaactattatatttttggcaaaattttcccaaaacccccctgg

SEQ ID NO: 14118 - DNA, 229 bp, Zea mays
  Clone ID: cC-zmpo148065a08d1
gctggactcggacgacgacgacgaccagtaaactataccacttttgtttttcggacatgctgcacaaaactacggcggggcagagcgaacgcatggcatggatagcactatctacggaaagaaaaggaagaaaaggaaaataaaaaatgtatcagagtgcttgattcacttgctgctgtcacccattccccgttcttaacataacatgtgggccggcttggcccaggct

SEQ ID NO: 14119 - DNA, 336 bp, Zea mays
  Clone ID: cC-zmpo148065a09a1
atacataagacattaacggtccggaaggcttgtaaacaaaatataattcctccccaagacgtaaacatctttatcaatatcaggatatacaaaatttcgcccacttcttttcaataggaaaaaaatttcaagaattttatatacttatgagcagaaactcatgtttacaagttaccagccttgttggaagcatctttacaaggctttgttttggcgatgcttacaagatcactaaagagcgaattttcaggtctgcttggcctgttacgctgctggagggaacactacgcgggtgtgccatacaaactgttgccttgcatctagaggccattcatt

SEQ ID NO: 14120 - DNA, 533 bp, Zea mays
  unsure at all n locations
  Clone ID: cC-zmpo148065a09d1
gaacaangacccctggataaggctcaagnaatttttttgtccaggaacgaacgaccgcgccggaatattccaccacagcagcttgcccatcccaaggtgaacaaagcaacgacctttcactaccaccctgggaagctctgcctgcagaaactgagcaattagaagctgaccatcctggtgggttgtcagctctgccacaatttggagttagtcaaccccagccagtccaaattacacattctgggcagcaagtgttaccatcgcaattaatgccaactggacaaccgtgagggcagttccagcctagatttggggctcaacaaccatatgctacagaaaatacgcagtatggaggaatgtattcgccagtgcaaggcaaccaaccaacgggtatttatccccagcaaatggctggagatgtctaccagcaacagatgtttggtggtcagatgataggttatggctatgggccccagcctggaggctactacgtgccgaacgctccatatgcatatgccggtgcaaatgatctt

SEQ ID NO: 14121 - DNA, 269 bp, Zea mays
  Clone ID: cC-zmpo148065a10a1
agcaggcaacaacactgcaagagccgggttttttttaatagacagaactgtccatacaccaagatttttggattttttaactcccccgtataaaaaaaaaagctcgctctttaactgacttatccgggccaccggccacaccgatcaccggaccgcccgttagcttccctccgtttcccatgaaccacccaccgttttctagtccccgctgattttggcaccactctctccacttccaccgttggccctggcggcgcttatgcgtgcct

SEQ ID NO: 14122 - DNA, 427 bp, Zea mays
  unsure at all n locations
  Clone ID: cC-zmpo148065a10d1
gctggaggaggccaggaacgccgaggaggctgcnctggtangtttcaganggagaaggccaagngccgcgcggggatggaggccgccgaggcggcgcagaccctggctgacctggaggcgcagcggcgccgcaacgccgaggagcgcgcgcgccgggaggccgacgagaaggggcgcgctctggatgccatttccaaccacgacttccggtaccgcaagtaccacatcgacgagatcgagatggccacggagcgcttctccgacgagctcaaaatcggcgagggcggctacggccccgtctaccgcgcctcccttgaccacacccccgtcgccatcaaggtgctccggcccgacccgcaccaagggaggaagcagttcctgcaggaggtggaggtgctcaactgcattcggcaccccaacatggggc

SEQ ID NO: 14123 - DNA, 490 bp, Zea mays
  unsure at all n locations
  Clone ID: cC-zmpo148065a11d1
actcaccccgccttcacgccnccctctttatttaggncccgccctnnnccgacanncagaggggggacaggaaancagcggccagggcctcgaccccggcgacgaccnncgccgncanccaanccggcccccncngngccgcggcnggcaccgccgncgacaacgacctccccgactacgncatccagggccgcgtctattgcgacacctgccgcgccgggttcgtgaccaatgtcaccgagtacatcgcgggcgccaaggtgaggctggagtgcaagcacttcggcaccggcaagctcgagcgctccatctacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgttctgctcaccaagaacgtcggcatcaacgacaacctgcg

SEQ ID NO: 14124 - DNA, 471 bp, Zea mays
  Clone ID: cC-zmpo148065a12d1
ccctcgtcgtctctactcaccccgccttacgcctccctcttctttttggtcccgcccttttccgacattgagaggggggacaggaaatcagcggccatggcctccattccggcgacgaccttcgccgtcatcttatccgtcctcttctgtgccgcggctggcaccgccgtcgacaacgacctacccgactacgtcatccagggccgcgtctattgcgacacctgccgcgccgggttcgtgaccaatgtcaccgaatacatcgcgggcgccaaggtgaggctggagtgcaagcacttcggcaccggcaagctcgagcgctccatcgacggggtgaccgacaggaacagcacgtacacgatcgagctcaaggacagccacgaggaggacatctgcgaggtggtcttggtggagagcccgcgcaaggactgcgaccaggtgcacgcggacagggaccgcgccggcgttctgctc

SEQ ID NO: 14125 - DNA, 407 bp, Zea mays
  Clone ID: cC-zmpo148065b01a1
aatatcatattaaaggcgctctacctcgtttcatggggtactattgaataaatagtgcaggtcaggaacaaatacatagagttactcaatatatataactcatatatttaatgaattcttaattaaatgaaaaatgaatgcaagcattccctgcatgcgatggcacctcacgctggggttgcatgcgtggttcatatcatgtttgcaagagccatgcagttgttggccatttggttgagcttcttgtcaaacttccccatggggttggggacccccgcctgggtgaaggggcggtcgcacgagtctaagtcctggacggcgagctgcaacatgatcttggcggtgccggtgtccttgaacgtgatggcccgctgcgccccgccgaaggtgtcctgcgtgttcatgta

SEQ ID NO: 14126 - DNA, 522 bp, Zea mays
  Clone ID: cC-zmpo148065b01d1
cgtccgcccacgcgtccgctcgctggcccataaatatatatctatcttttgctttcgagcaattataatctcacagaaggatggcatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaagacaccatcggcgcggcgcagcgggccatcacgttcaaggacaccggcaccgccaagatcatgctgcagctcgccgt

SEQ ID NO: 14127 - DNA, 269 bp, Zea mays
  unsure at all n locations
  Clone ID: cC-zmpo148065b02a1
gganaagaagncattcgaatncgggcagggatttacatttttttaactccggcaccgtatcggagtgcatgagcgaaagaatgaatatgcatgcatgaagcatgttatcatccgtatggctgcttgctggcatgcaggttgaagaagaggagggaaagtggctacttagaagttcttggacgcctggtacgtgacgcctaacttacagtcagcggggagaacgtgccatgaggtggccttgcgggggtcgttggtcacccacgcgttcg

SEQ ID NO: 14128 - DNA, 284 bp, Zea mays
  Clone ID: cC-zmpo148065b02d1
gtccgcggacgcgtgggtgaccagcgaccaccgcaaggccacctcattgctttttctccccgctgactggaagttcgggggggcgtaccaggcgtccaagaacttctaagtagccactttccctcctcttcttcaacctgcatgccagcaagcagccatacggatgataacatgcatcatgcatgcatattcattctttcgctcatgcactccgatacggtgccggagttaaaaaaatgtaaatcaatgtgcaaattcaaatgacatcttaaccagttgtgatc

SEQ ID NO: 14129 - DNA, 367 bp, Zea mays
  Clone ID: cC-zmpo148065b03a1
cttgcaaaaaatccgttttgggctggtcaggctgtgactaaaacctgaccccaggaaagaatgtacagaccaagcatgttgagtgggccatcattgggatgctgcgactttctccatgtagtcgtccagcattttgttctgcactctgccgatgaaccttacgcagatgggcggcgtgacgttgtacctggcgagcagcgcgtacggtatggagaagagcccgtccccgcatatgagcccggacgcaagcacccgcgcgaacacctgcgcgtcctttttgtccgccctgttccacatgaagaggatcaagcttcccacgcacatttcgatggacacggccgggaccagtaagaacgaaacggccatg

SEQ ID NO: 14130 - DNA, 550 bp, Zea mays
  Clone ID: cC-zmpo148065b03d1
cggctatcgtccgggcggcctagggagcttgctctggtcctactttcattggttctacaccggaggacccggctggggcttcactgcgttcccgacgttcgggctcaccgcgtacaaacacggcttctacatcaatatgaatggaacttacgttggtgtgggcatgatcagcccttacctgataaacatctcgatgctcgtcggctccatcatctcctgggggatcatgtggccctacctcctaaccaagaaaggcatctggtacgacgccaatctccaagagaccagcctaaaaggcctcaacggctacaaggtgtttagcgcgataggtatgattctcggcgacggcatcctccagctcgtcgtgatctcgctgaagaccgtacacaccatgcgccaccaccagctagccgccgagacgatcaggtccttctccaacgtggactccatgccgcggccggtcctcagctttgacgaccgccgcaggacgcatgtgttcctccgggagcacatacccagcacgttcgccatcagcggctacgtcgtgctg

SEQ ID NO: 14131 - DNA, 613 bp, Zea mays
  Clone ID: cC-zmpo148065b04a1
aattttaaacaaaaacttttatttttttaaaaaccaaaaaacaaaaacagggaagggataaaatatataaaaccatacacccccaaccacaaaaaacataaataaaacaattaaattcggggcaaaaaaccaaaaaaaacccaccaataaaaaatatatacaaccccccaaaaaaacaatatttaacaccaccccttaacaaaaaaaaaaattaaacccaacagaaaaaaaattttctttaaaaacccaaaaataatcaaaaaaaaggggacgggaaaaaaaaaaacctaaaaaaaaaaaaaaaacccacaaaaaaaaaaaaaaaaaaaagatgaaacacataaaaatacaaaaactaaaaaaaaaaaccaaaaaataagaaacaccccacataataaaaaaccaaacataatatacaactcaaaaataaaaaactaaaacacaccaataatataaaaaaaaaaacacataaaaaccacataaccaaaacataataaaaaaaaactagactcatcaaaaaaaaaaaaaaacaaaaaatcctccccggaggaaatataaaaaaaaacaaaacaacacacaaataaaccccaaaaatacactacaaatccatcac

SEQ ID NO: 14132 - DNA, 524 bp, Zea mays
  Clone ID: cC-zmpo148065b04d1
gcccgcccacgcgtccggtctcactcaccccgccttcacgcctcctttttttttaaggtcccgcccttttccgacgggcacgggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcactttggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgcttaccaggaacgttggcatcagcgacaacctgcgccccgccaaccc

SEQ ID NO: 14133 - DNA, 404 bp, Zea mays
  Clone ID: cC-zmpo148065b05d1
atcatccgtggatccatcttgctaataaccctgcgtgcccttttttctcgactcgatcccgacgacggtccctttggcttcggcaaaccacatcaagccgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtcgattgatccattcatttt

SEQ ID NO: 14134 - DNA, 390 bp, Zea mays
  Clone ID: cC-zmpo148065b06a1
taaaaaaataaaaacaggcccgccccaaacaaataataataaaaaaaaataataaaaataaaacaataaaaaactcataaaaaaaaaaacataaaaagaaacaaaaaaaaaacaaatttaaaactcaaattaataaaaaaataaaaaaaaaaaaaaaaaaaaaaaaacaacacaaaacaaaaaaaaaaaaaaatttggcctccaaaaaaaataaaaaaaaaaaaaaaaacacaaatagaaatacaaaacaaaaaatcaaaaaaaaaaaaaaaaaccatcacaataaaatataaaaacaaacatagcaccgatcgaactaaatatataaataaaacacaaaaataaatatctttataaaaataaaaacaaaacacacaaaaaataatgcac

SEQ ID NO: 14135 - DNA, 518 bp, Zea mays
  Clone ID: cC-zmpo148065b06d1
aaaaaaaaaaaaaaaaaaaaaaaaaaaaaaaaaaaaaaaaaatttaattaaaaaaaaaaaaaaaaaaaaaaaagagcgggggaaaaaaaaaaaaaaccaaaaaaacccacccacacaaaaaaaaaaaaaaaccaaacaaagaccccacccaaaaaaaaaacccccgccccacacccacaacaaccgaaaaaaaacaccccaaacccaccccaaaaaccaagccatccaccccccccccaaacaacgcccaaaagaaaaaaaccccaagccccccaacaaaacccacccaaacacaacccccacttaaaaagggaacgaaccccaaaaaagccccacccaaacccccccccaaaacgaagacccaaccggaaaaccccaacacgacccccccccaaacacccccacaccaaccccgggcgtcctcgccaacccccaaaaaacacccacccttcccccccccaaaaaacccagtcccccgctccgaaccccaaaaaaatgcaaaacggcaccggaacccc

SEQ ID NO: 14136 - DNA, 631 bp, Zea mays
  Clone ID: cC-zmpo148065b07d1
ccgcggacgcgtgggcggacgcgtgggccaacagccacttcaccttcctttatcacgtgatgctgttcggcgccggcaaggagctgcccgcaggacgcggtgatgcacgtcacggtggcgttcaaccacttcggccgcgggctggtgcagcggatgccgcgctgccgctacggcttcttccacgtggtgaacaacgactacacgcactggatcatgtacgccatcggcggcaacatgaaccccaccatcatcagccagggcaaccgcttcatcgcccccgacgaccccaacgccaaggaggtgaccaagcgggagtacacgccgtacaaggactacaaggagtgggtgtggaagtcgcagggcgacgtcatgatgaacggcgccttcttcaacgagtccggcggccagaacgagcgcaagtacgacaggttcgacttcatcccggccaagcacggccgctacgtcggtcagctcacgcgcttcgtcggaccactcaagtgcatcgtcggccagccgtgctagtagacagcggcccggtcgggcacatactcctttttctatatacatcggatttggatgggcggcatatatgtacgtgtgtgtaatatattattactacatcttgtactat

SEQ ID NO: 14137 - DNA, 414 bp, Zea mays
  Clone ID: cC-zmpo148065b08a1
tttatatttttgacctggtttttgcagcaaacgaatcaagcactctgttacggttttattatttccttttcttcctttcctttcaatggatactgttatccatgccatgcgcgcgttcgctttgtattcatcttatagttttgtgcagcctgtacgctacgccgtcgtggtacagtttactggtcgtcgtcgtcgtcctaatccagctgcttgagcaacgcgtcgcatacggggagcggcacgttcttgaagtaaccgatcgggttggcggggcgcatgctgacagagatgcccaccttcctggtgagcatgacccctgcgcggtccctgaactcctgtaccctcattcaattctttgccgggctggccaccaacaccacctggcaaatatccttctccgggctgaccttaact

SEQ ID NO: 14138 - DNA, 592 bp, Zea mays
  Clone ID: cC-zmpo148065b08d1
gccgctaccctccctccgtacacaaataataaggaaagggcctgttctttttctccgacatccacaggggggaggggaggggcacgtgcattcacccggcggcaatcatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgttctgctcaccaggaacgttggcatctccgacagcctgcgccccggcaacccgttcggctacttcaaggacgtgccgctccccctctgcgccgcgctgtttaagcagct

SEQ ID NO: 14139 - DNA, 352 bp, Zea mays
  Clone ID: cC-zmpo148065b09a1
caaggataaatccacacccagtgggcgcgttatgcaatttcatatacttgccaacctttgttttttttatagccatgacaactatattaagaaaaaacattacatgatccaaattgacacactgaaaaaaaggctccaaatttttcatgccggcatgctcctgcttttcctatgtacattggcaccaatgggctcaagcagcaacaatcatccattcttatattgcattattgttcaattttcccaatgatgcgaactgccgtttccgctaccgtatgactgcgcctattgacaaaacatgctttttaaccactgaaggatggcggcaaccggcttcctttctttttagctt

SEQ ID NO: 14140 - DNA, 515 bp, Zea mays
  Clone ID: cC-zmpo148065b09d1
ccgcccacgcgtccgcacatgtgtgccgggccgaggtcacaatctttgctctgaggaggatgccgccgtagctgcggagagggataatataaagcgggcggagaccgccggcccctctggcctcgctgctcctccccccttcctccccccacatgcgctgcccccgcccggccctgccctgccctgctgcgcccaagcagctgaatctccgcacagacaattagagtagctgcattggcggggaaagcgcaagaagctcagcagaaatggcggagcaggcaggcgccggaaggtactggtgccacatgtgcgccgcggtcgtgagccccgcggagggcgaggcggaggtgaagtgcccgcattgccacagcggcttccttgaggagatggagaccgttcgcggcacgcccgcggccgatgacggcgacggtgaccgcgcggtggctcaagtgtaccccggcgccgaccggccgagctccatctgggcgcacgctatcctcagcacggtcgacagc

SEQ ID NO: 14141 - DNA, 355 bp, Zea mays
  Clone ID: cC-zmpo148065b10a1
gacgggaaaatgcagcctacttctattgctcagaccacagataattactggggtgggggtggttattttatgtacacaacgcccgtctgacggagatgttcacaccctcgtcacattacaatgatctgctcgttggctaggcagcagcaacataccgtcatgatgctgcatcgcatgacaagatgaaccggtaccgctgtcagaagaaaaaaaaaactcgccacgttttccgtcctcgatgagcagcagggaacccaaaaaataattttttttgaacaataatattcgtagtatgcagctacgttttgtggcttacaatccgacgacgaagcccctggccggcggtggaaggttc

SEQ ID NO: 14142 - DNA, 503 bp, Zea mays
  unsure at all n locations
  Clone ID: cC-zmpo148065b10d1
cggaaactgttnccgnntgccganatgcttctttggttctcctcccatcgcgacggagcccaaggggagtgcacgtcttcttcgtcgccgtccgccacgcacgtcttctgccgctgggccgacgtcccctccgtcgtcagcgcgcgaggccccggaccctccgccgccggccaggggcttcgtcgtcggattgtaagccacaaaacgtagctgcctactacgactattattgatcaaaaaaaattattttttgggttccctgctgctcatcgaggacgggaaacgtggcgagttttttttttcttctgaccgcggtaccggttcatcttgtcatgcgatgcagcatcatggcggtatgttgctgctgcctagccgacgagacgatcatgtgatgtgacgagggtgtgaacatctccgtcagacacgcgttgtgtacataaaataacctctgacagtacagtaattaactgtggtctgtgctataagagtaggcttgattttcc

SEQ ID NO: 14143 - DNA, 405 bp, Zea mays
  Clone ID: cC-zmpo148065b11a1
ataagcaatctcttttttccataaaagcatacattcaaacggaagggattatatagacaagtcctttcatacccatccagtcttactaaataaatgtgacaggcaacattgaatcattttccccttcccatgatccctatgatgcgtactgcggtggcgcccgtgctgccatgctagcaaccttagcctgctgctgcgcgctatgcaccttggcagatagggcgcggtggaaaaactgctcacgggacagtgcacgcacgctcctgaggtagccgtcaaagggcacggatccttcctggattgccttgtcgagcgcgtaaattgtgtcctcaagcgccaaatctgccgctgtgcactggaacatctgcctggacagcacaatcgccggctcgatggcttcatcgt

SEQ ID NO: 14144 - DNA, 498 bp, Zea mays
  unsure at all n locations
  Clone ID: cC-zmpo148065b11d1
cgaaaccctatctcggatccgatggctcgttcgccgccgcctttttcgttttccggcggcgcgcagnacgcgcagcggggcgtcaacacggcgctctcccagcggggcccgcccgcgctgccgtacgccgaggacgncaagnggctcatnccgaaccacctggtagcgctggccgaggccttcccctccctccatcccaaggccgccctcttcacccacaacgacggccgcgccgctcacctcctccaggccgacggcaccatccccatccaccacgccggtgcctcctacaacctccccgccgtcatctggctgcccgagccctacccgcgctccccgccgctcgtcttcctctccccgacccgagacatggtcatcaagccccaccaccgcctcgtcgacagctccggcctcgtcgccaacgcgccctacctccgctcctgggtctttcccttctccaacctcgtcgaccttgtccgatccctctcgcacctattc

SEQ ID NO: 14145 - DNA, 371 bp, Zea mays
  unsure at all n locations
  Clone ID: cC-zmpo148065b12a1
agaacgataattttttacatctttntacgcgttagtcgatacaattaactaacaacattataacacattgaaaattaaacacaaagaaaatagtaggagagcacggatgtatccatggatgagaggttgaccacacattatcatggtttaaaagacattgctctcatttttcttccatgtcttgtaacaaaattaaccgggccgacgtgtgtggccttaattggtggagtcatcattgtcatcctcattgcctgacaggccttctacaccctgggggccaagtgcaatatacggcccgctaggtacattgtgttgtgcgtcagacacaggggcatcggcggactttgtctcggccatctgtgctaccacca

SEQ ID NO: 14146 - DNA, 497 bp, Zea mays
  Clone ID: cC-zmpo148065b12d1
agagacaccaagcgtggaactcgcctaatcagctatcaaccatttcttttttgctagacaccgtacccatggctggcgcgggcgtcgtctttgtcattgccgctctcctcttcgtcgccatggacgtagcaccgatggccgaagcaaaaaccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacacgacatggaagaaaaatgagagcaatgtctttaaaaccatgataatgtgtggtcatccactcatccatggatacatccttgctctccctctttttctttctgtttgattatcaatgcgttatcatgttgatagttaactgtatcgactcatggtatcaagatctaaaaaattatcgttcttgtgttct

SEQ ID NO: 14147 - DNA, 379 bp, Zea mays
  Clone ID: cC-zmpo148065c01a1
aacaaccatccgtaacgacgatcttaaaaacccaggggcaaaccgccccggacataaccagaaagtcttacaacatcaggtggtgcaaaccacaccggggacaagagcagcacacaagcctgacgaagaccgcaacaggaaacttctagaactcatcaccataatcaccttcctcgccctcaacaaactcagcaccaacctcctcgtagtccttctcgagcgctgccagatccttacgggccatagagaactcgccctcctccataccctcaccgacataccagtgcacgaaggcacgcttggcgtacatgaggcccaacttgtggtcgatgcgggagaacacccccacaacactgggggaggtggagaacaagcacac

SEQ ID NO: 14148 - DNA, 511 bp, Zea mays
  unsure at all n locations
  Clone ID: cC-zmpo148065c01d1
cgcggacgcgngggcgcctatctccgcgactcaaagcttctttttttttttaccgccgccgcngcagctccaccgganggcgtcgacaccatgagggagggcatctcgatccacatcggccaagccggtatccaggtcggaaacgcgtgctgggagctctactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgtggtcactacaccattggcaaggagattgttgacctgtgccttgatcgcatcangaagcttgccgacactgcactggtcttcagggctttctcgtcttcaacgctgt

SEQ ID NO: 14149 - DNA, 56 bp, Zea mays
  Clone ID: cC-zmpo148065c02d1
gtccgaaaaaaaaaaaaaaaagaaaaaaaaaaaaaaaaaaaaaaaaattttatttt

SEQ ID NO: 14150 - DNA, 538 bp, Zea mays
  Clone ID: cC-zmpo148065c03d1
cgcccacgcgtccgcccgcggccacatcgacggcaagctccgttttggtttcaacggcatctcccacagggacagcgaggccccccttaagctcgccgagtacttcaacgtcaccgacggggtgttcagctacaaccagatgggcgacgtgcccccccgccgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgttcggtccaacgtctgggagcggtactacctcggggagcagttctacaatcagcgtcatcttgccggcgcggtcgctgcgcgacgagtacaacatgcccgaca

SEQ ID NO: 14151 - DNA, 231 bp, Zea mays
  unsure at all n locations
  Clone ID: cC-zmpo148065c04d1
aaaaaaaaaaaaaaaaaaaaaaaaaaaaaaacaaaaaaaaaattaaataaaaaaaaaaaaaaaaaaaacaaacagagagagaaaaaaaaaaaaaaacaaaccaaaccccacaccacnagccaaaaaaaaacaacaaccaaacaggaaaaaccccgaccccacccaaaaaaaacgccgagaaacaaaacccccgaacccccacacccacaaaaacaaaaagacccccaccaa

SEQ ID NO: 14152 - DNA, 456 bp, Zea mays
  Clone ID: cC-zmpo148065c05a1
agagctgcattttcccattccagaggaggccaaatagttggtatcatccatgacccatcgtacaccattttctaaaatagaataggatgaatacagggcacacaaaccaggaggcgcatcgcttacaaaacaatttacaatacacagctgcatggcaaagctcttctctgcgccaaggcgttggcagtcaccacacagcaacaccaacgctccacaagacggtcctttttcgtgaacccaaagttgtcgcagcgatgggaaatcacagtccggatcgctctgctgctgcggcagcgtgggaggcctactaggcagtatggtggttgccaaaccggctgtgcatcaaggggttcaaagccttgacgacgatgcttatgttgggacggaattcaccctcttattgcacgcagagggcgggcacagaaatcattttggctacagcctttggaggggatt

SEQ ID NO: 14153 - DNA, 552 bp, Zea mays
  Clone ID: cC-zmpo148065c05d1
gccggaaagatgggacgaaatctgcagtgaagaagcttgactccatttttttgcctgatcaagaattccttgtgcgggttgggagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatcttaaaccaggcccctgacatggctgcgcgccttcactctactcgcgttcttggcacctttggctaccatgcaccagaatatgccatgactggacagcttagcacgaagagtgatgtctacagctttggagttgtgctgctggagctttta

SEQ ID NO: 14154 - DNA, 203 bp, Zea mays
  unsure at all n locations
  Clone ID: cC-zmpo148065c06a1
tttttttttttattttttattttttacccccacacccaaancacacgggcgggttcaagtaacctnaattgacccatccatgcccgcccttcaaaataatctatcactgttaacaaactttatctccacaattctttattactaaactcatgagctgcctttattatttaaacaggatgtaccggcataagctgtaggccttc

SEQ ID NO: 14155 - DNA, 346 bp, Zea mays
  Clone ID: cC-zmpo148065c06d1
gacctggagcttgtcccctacgcccttggctaagacctcggcgatgaacattcgcgcgtagccgtggatccaccttgttacgggccacacgcacaccaccgggttgttgggcctgggcgtcaccctgttctccacccggtacaagaacccgcggcccgccaccggcggctgctgccccaagaacttgaggttgctctcgaacttggactccggcaggtccgtgtcgatccaatagtccctgaggtacccggcgctccacaagggctccccgggcccgggcgccagcgacctgcgcggcttccacactcaaatgacccggtgcgggagcacttccgcaactgtcttg

SEQ ID NO: 14156 - DNA, 386 bp, Zea mays
  unsure at all n locations
  Clone ID: cC-zmpo148065c07a1
aaaaanaancnaaaacttttaatttctgaacacgcgacgaacgaaccggggcaagatatacagggataggactaaatgcctgacctatccgaacagcgctactcgtttacacattataaccatttcgtcaacaggcaattttgctttccaggttcattcattaataatgtggtgaatggctacccaatcatgttctgatgatggcaacacaggcgcctctgtaggccatcagtggagggagtttatgcccatgtaccgccaagctgtgtggccatgcaaaccatttttatcatccatccacaatggcccgttgttccgaactaatgaatccactgcatgctggatgtttacatatatacaggtgacacggacaccgctcggtgctt

SEQ ID NO: 14157 - DNA, 551 bp, Zea mays
  unsure at all n locations
  Clone ID: cC-zmpo148065c07d1
ggtactgggaactctgattggtcttatcccagctgcttatgttattttcagggctggaanngctctnggagagggaggtgtttttagtgacctttacgacacccactcgatagcactgctattcctgatcggtgttgtttcagtcacaccagcattgctgggcaaggatgaggcacaagagaaaccaccagaaatggcggtaggcgcgtcatgatcaccaaagcaccgagcggtgtccacgtcacctgtatatatgtcaacatccagcatgcagtggcttcattagttcggatcaacgggcccttgtggctggatgataaaaatggttcgcatggccacacagcttggcggtacctcggcctaaacttcctccactgctggcctacagaggcgcctgtgttgccatcatcagaacatgattcggtagccattcaccacattattaatgaatgaacctgcgaagcagaattgtctgtagacgagctgctctgatgtgtaaacgagtagcgctgtttggataggacaggcatttaatccaatccctgtatata

SEQ ID NO: 14158 - DNA, 501 bp, Zea mays
  Clone ID: cC-zmpo148065c08a1
taaaaaaaaaaaaaaaaaaaaagggggataaaaaaaaaaaaaaccagaagaaaaaaaatggggaaaaaaaaaaaaaaaatatatagaaaaaaagagggaaaaaaaaaaaaaattccacgacaaaaaaaaaaacagaaaaaaaaaaacaccccaaaaaggggtgaaaacaaaaaaaaaccaatatattaaaggcccccataagaaaaaaaaaatcccaaaaaaaaagggataaaaacaaacaaagactttacaaaaaaaaaaaaaaaaagacccaaacacgtaaaaaaaaaaaccaaaaaaaaaaaaaaaaaaggagagggagaagagcaccaaaaaatacccaaaaaccggggtaaaaacctcgaaaaatacaaaaccaaaaacggaaaaggaaaaaaataataaaaaaaagggaaagaaaaaaaaaaaggcaaaaaaaagggaaaaaaaacaatcctggaaaaaaaaaaatacctaaaaaaaaaaaaaataacaaaccaa

SEQ ID NO: 14159 - DNA, 596 bp, Zea mays
  unsure at all n locations
  Clone ID: cC-zmpo148065c09d1
ctgggtcgnggatggcggngccacaacctctcctgctgncgtttcttttcgccgngctagcggnggccgccggggnggtctacgtcggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctactaggtgcggtgcgtggacagccctagcgggtgcaagcccgacgcggcagcgctggtggtgacggtgaccgacctgtgcccgcccaaagaccagtggtgcaagccaccgtgggagcactttaacctcagcatgcccgcgtttcttcagatcgtgcaagagaaggctcgcatcgtgcccattttcttaccgaaggtggcgtgcgcgaagcaaggcggcattcggtacaccatcaccgggacaagtactttaacattgtgaccatcaccaatgtgggcg

SEQ ID NO: 14160 - DNA, 524 bp, Zea mays
  unsure at all n locations
  Clone ID: cC-zmpo148065c10d1
tatcgaccagaagtactgccccaacaacatctgcgtcaagtttcngtctctccaaggtggccgtcaacgacgtggtcgggattaacatccacggcacctccaacaccccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataatccgctggtttgtattttctttcttctttggatcatcacaaaaccaaccgatgtaattattattagaccgacgcctcacaatcttggaacttattcattatgctagtgtatatctgtaatcccattccataatgttaatgttgatttgtggtcacgttt

SEQ ID NO: 14161 - DNA, 562 bp, Zea mays
  unsure at all n locations
  Clone ID: cC-zmpo148065c11d1
gcgggtggtcggcgtctcactatccaccaccgcgccgctcctgatttatttctcctcgaccggccagcgcaatgctggggttcgatcgatcggtcggtcgtaaggcaacccagcaagctatatatatatataggagattcttcgagcgagctagtagcgagatgggttccgccgtcctcttttactgcatctgcatcgccgtcgtcgtcgcattgtcgtcgtccatggtcgccgtcggggccgccgccccgggggaaacccccaagttcatctcggcgagcgcccttgagtgctccgctaacgtaacggaaatagcaaaggcgcgcaagctgatcgatgtccatggccacgggctgtgcccggtgcggttcgaccacacgcgcgggatcagcgcggtggccagcagctgcaaggaccgcccgctgccgtcgccggagcgctgctgcggngcgctcaaggcctacgcgtgcccctacagcgagctcatcaacgacaacgccaacaacggctgcgccaacgagatgttctacgttaatatgacacgccgcaggctgcggccggg

SEQ ID NO: 14162 - DNA, 278 bp, Zea mays
  Clone ID: cC-zmpo148065d01a1
cacacacaacacaaccggcccattattaaaccaacactgacacgaacagcatatacttcgacaacctccaaatggagagggcaccagacgacgcaggcacattggcagcttaaacgacccatgacttactgaccaccacggagacggagcacaaggtggagggtgctctccttttggatgatgaacactgctagggtgcgggcatcctccaactgattgccggcaaagatcaaactctgctggttcggggggatgccctccttgttcggacgcctggg

SEQ ID NO: 14163 - DNA, 307 bp, Zea mays
  unsure at all n locations
  Clone ID: cC-zmpo148065d01d1
ggagggcatccccccggaccagcattgttttatcttcgccggcaaacagcngagaggggggggtaccctatcagactacaacatccacaacgagagcaccctccaccttgtgctccgtctccgtggtggtcagtaagtcatgggtcgtttaagctgccgatgtgcctgcgtcgtctggtgccctctccatatggaggttgtcgaagtatctgctgttcgtgtcagtgttggtttaataatggaccggttgtgttgtgtgtgcgtactacccagaactatgacaaatcatgaataagtttgttgtttg

SEQ ID NO: 14164 - DNA, 309 bp, Zea mays
  Clone ID: cC-zmpo148065d02a1
aatcaaatccattagctacatgggcgggcgtcccataatgttacaagagcaaaccaactgagcaaagcaaagaaacacttggtccctccctccccaccagacaagagcgattacagcacagccaattacctgtccaccctaatgtttcaccgcgacacgaccattgttggtgagtttagtagaagaagatcatggtatcaacagcatcggcaacccccgcgatggcagctccacttccaagggcagcagcacccgcggagtcatcaatagccggttccttatccgcaagggaccccccggcggttgatt

SEQ ID NO: 14165 - DNA, 618 bp, Zea mays
  unsure at all n locations
  Clone ID: cC-zmpo148065d02d1
gccgcccacgcgtncgaacaaaaatgtcgcgcgtcacagctgctgtgtttttttacatcctcgccgttgctgccctggacggggtcgatgccccggcagagtcaccgcaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgtctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattatggtggacacgtaattggctgtgctgtaatcgctcttgtctggtggggagggagggaccaagtgttctttgctttgcaacttcgtntgctttgtacattatgggtcaaccgtatgtaactaatggattgataatctggctct

SEQ ID NO: 14166 - DNA, 344 bp, Zea mays
  Clone ID: cC-zmpo148065d03a1
tatagcatgagctagccatgctagacatcgttcttaccagacatttctgttcataataataacaacaataaagcacatgagacagtggtaattcctagggagatgcatggaatagatcgttccacgctttggtgaatcgagcccatctgaaatgagggaaacattctaggctcattccatgaatccaaaaatgccaagcttgttcgcgatatttgtcattacaagatcattttacactggtccaaaataaccgttctccttccacaattaaagttgttgcccatgtgaccaaaacaacggataatatggttaaactcaatttccgaccgtacaaaatattttct

SEQ ID NO: 14167 - DNA, 518 bp, Zea mays
  Clone ID: cC-zmpo148065d03d1
cggggaagagtcagcaatggaggcgagggttgcaggagtgcccttagtttattagtctggcctcctcccccgcgggccgcagccggccgacggccgtcctcccgcggcccccgcttcccgcctccaccggcagcctgggcgacggtggacggtcccctcgggcttccgctggaggacgcggagggccacgcccgccgcttcttcatgtggggtttcgcgtgcctccccttcctctgggccatcaactgctgctacttctggcccgtcctccgctcgtcggtcgcctcctcgcccgccgccttcgcccccatccgcccatatgttgtgcggtcggcaattggcttcaccatcttttccgttgttctggtcacctgggccacgaccttcgttgtcggaagcgagcggttatttgggccagtgtggaatgatcttgtgatgtacaatgtcgcggacaagcttggcatctctggattcatgggatgagcctgcgatgtctcccctactttagctgggctcgc

SEQ ID NO: 14168 - DNA, 210 bp, Zea mays
  Clone ID: cC-zmpo148065d04a1
aagcggcgccctttttttttattttacatatttttttacaggaggaaaaacgctgagtggcggtgttacactttatataacaggccacaccataaaaattacaagcatacatcaaccttaactgaccgttttcacattcttctaaaaaccctttacactgtcatttgcaacggcttctatacaccggactcttggcgtacgcgtttttct

SEQ ID NO: 14169 - DNA, 167 bp, Zea mays
  unsure at all n locations
  Clone ID: cC-zmpo148065d04d1
cgcgtncggngtatagccgccgttgcaaatgacagtgttttgttttcttagccgcctgngcataccgncgggggggttgatgtctgcttgtaatttttcctttctcgcctcttctctacggtgtgtaacccttcctcagcgttaatcctcctgctgcattttgctgt

SEQ ID NO: 14170 - DNA, 423 bp, Zea mays
  Clone ID: cC-zmpo148065d05a1
aagcggtcgcccttttttaaaatttttatagcttattcattcaccattcccatttatcgggcgtgtatcacattgttaaacatatcacatccattctttattattacatttcatgcacccgacaatttttgaaaaaaaaaaaataattttttccccttccaaacaaacaaaaaaaaatggaaaactaatttcgtaatcttagtatacaacacacaatcatgtttccctttccttgatcctcttttcttcccccagaaaacgaaagaagcccactcatcgcctgaagagcttgtggataacttgctctcgggcctgacccgatcacctgttgacaatttcctccaacttctactggcacctccaaaagccggtgccgtataacctctaccacaccttctttttcagctccccctttttctccaa

SEQ ID NO: 14171 - DNA, 494 bp, Zea mays
  unsure at all n locations
  Clone ID: cC-zmpo148065d05d1
cccgccacgcgnncgccgacgcgtccgcccacgcgtccgccgatttttttttggcgggcgccgcgcgtcgagggcgggcgggagcttgccatggcagccgtccggcccgacagggtccaccaccaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcaaggagcaccgctcctgcagcgaggtggccggcggcaccgcggcgggctgcgccgctgtgtgctgctgcttcccctgcgtcatggtggaggtcgcggtgcttgccacggtgcgcgcgcc

SEQ ID NO: 14172 - DNA, 642 bp, Zea mays
  unsure at all n locations
  Clone ID: cC-zmpo148065d06d1
gcccgagaaactgaagacaagcgtgaagaagagatccgngaaccctttattgtatgaggagctaactctgaccgncagagaggccagccaaccactgaagctggaggcgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccacgtgtgctggaggaacggcaagttcgcgcaagacatgatcctccggctcaggaacgtcgagagcggggagatacagctgcagctgcagtgggtgaacttccctcctggtcctgctcctgctgctgcaacaaccaggtgacctgatgatcgatggtagctgcttgtcctgtcgccattgcctcctgctggcaggaacaggaactctcttgaacacggggtcagggtagttcatgttgcttcgaatccatcgtaggggaaataatgccggatggctttggtaagtttggcgaggacatgcatcataattgaagtcaagtgatacgatcctcgtttttaagtacacgatacacaccaatttaccat

SEQ ID NO: 14173 - DNA, 247 bp, Zea mays
  Clone ID: cC-zmpo148065d07a1
ttcaactaaacatgtcaatccacccacaggtgcttttcttcctccattaccaatttaccaagtgaacccttgatacaaaaacccaatgcatgcatgcatgcatgcgtgtgtggactccgcacctccctcctttttttctagtggtggatggcggcgccaattgaaaggaggtttcctggctgagcttatgtagctcccggtcctggtcagtcatgaccgactgggctccccatctcctgaaaccctc

SEQ ID NO: 14174 - DNA, 553 bp, Zea mays
  unsure at all n locations
  Clone ID: cC-zmpo148065d07d1
cgggcgaagnctgcagcgtctggcaaaaaagaaaaggacaagtttttcttctcatcttccaagaaagaaaagggggggggagccgccgattccgatgcatctgcgtatttcgacaaggaagagcagaaatccggcgattctgacgccgccacgtctgttgagaagcaaaagaagcagaagaaggagaaatccggtgattatttcgacaaggaaaaggaggagaaccccgaggaggacgctgcgcccgtcgacgtctccgcggacggcgtgtatgtgcctcccaaggaggagaaatccggcgaagacgccacgccggtcgacgtctccaccaccaccggcaaatacgtatcttcttcttccaaggcaaacggcaagcccacgggaggtcagcccgcagagagctccaccaccgtcaccgccaccgcggatgcgtacgcgtctccaaagcaaaaggtcgtcagcagccagcccatggccagcgccgctcctgacgagctttcgctggcggtcaagagttccaccaccttcgacgcgtacccatcttcaaggcagc

SEQ ID NO: 14175 - DNA, 313 bp, Zea mays
  Clone ID: cC-zmpo148065d08a1
gattaacaacatcgtcccacccacactccttatattttcacaatacatcattaatgcttcattccctttcacctttaatttttaaagaaaaaataatctacgtgttccaccctccattatcaccagatgttcaaaccattaaactcccaaaaaaaaatgaactctgtttgagtcattgaacaaccccttgcattgtactgtatagagttcaacttacttccaattccaaatcaccaaagcctccattttatatttccagcaataccagtcaatgttaaaaatatcttattagaagcgccactattcccaaacc

SEQ ID NO: 14176 - DNA, 540 bp, Zea mays
  Clone ID: cC-zmpo148065d08d1
gcggacgcgtgggccaatggcttctcgttcgcccaccattgcttttggtttctcatccttgcctgcttctcctcgccggggggggccttcaacatcaccaggctactcggacaattctccgacttcacaacctttaacaacctcctgtctcagacgaagctcgcggaggatatcaaccgccggcagaccatcaccgtgctcgccgtggacaacggcgccgccggtggcatctcctccctcccatcagacgtccagcggaaggtgctctccatgcacgttgtcctcgactactacgacaccgccaagctggaggccatcaagaaccactccgccctgctgacgactatgttccagtcctccggccaggccaccgaccgcatgggcttcctcaacttcaccaagcgctccgacggtgtcatggtgttcggctccgctcagcccggagcgcagatgacctcccatatggtcaagtccgtcacttcccgcccgtacaacatctcagtgctgcaggtcagcgcccccatcgtgccgcccggtgtc

SEQ ID NO: 14177 - DNA, 267 bp, Zea mays
  unsure at all n locations
  Clone ID: cC-zmpo148065d09d1
accggaaggccagcatgcccncattttttacagncagcgaccccggggggtgtaaagcgcggaacctcaccgccacgggccaccacctgcggtacaacaactgccgaggacaccgcttttccgcgacaacggggtgagcaccagacgcactcttctgtcgggactccaagctgctgagcacggcacccatctgcgggcgccactcggttcgcgcgcccccggaggactcgtgaaggggcgcatcaatgcactaggcagcgtcccacc

SEQ ID NO: 14178 - DNA, 358 bp, Zea mays
  unsure at all n locations
  Clone ID: cC-zmpo148065d10d1
ggggaanaaacaggacacaatcaacaaccccgccaagcataaaatatttcagaaagaccacacaccgaagagaggggggttaatctaaaagacagaggaaacccacccccaaaagataaataaatatataggagacaactagaaccagcaaaaaaccaaacagataccaccgcaacaataaaccacaatcaaatagccaaacaaatccaattaaaaaaaaacatggacgaaacaggaacaaacaacacaatggaaaccaacaactaaaaactaccgaaagcccttaaacaaaaagataacgcaaccgaaacagcaaaggcaaacaaactgaaatatgttaataaacaaaacctaaaac

SEQ ID NO: 14179 - DNA, 228 bp, Zea mays
  Clone ID: cC-zmpo148065d12d1
acctatccagccagggcggccactacagccagtcactttcattatgccggcgcctcaactgcccggagcgggaagtgctagtgcgtgcgcagctctccgctccagcttttatcattggcgatcgatcgtcacaatgcaaggttgtgttgtatataactcttgtgtatggaatgccgcccgtaattaatggtcaactctaacactgcttgcctttgcctgccggccagc

SEQ ID NO: 14180 - DNA, 300 bp, Zea mays
  Clone ID: cC-zmpo148065e01a1
aatcaagccgcttgcactgtcatatctatccatctgaaccagagggatcagatggtgcttaatattcttgcttgattggccctagtagtatatacacgaacactacacacacatgtccacacaggccatgcacgcttggaagcgcaagcgcgttattgcttgcggtggtggttgttggctggttttagggccgtcgaggtcggcggcggtggtctttaaatggtgcgtgggcgattgcgtttgaatgagtgcgagcgcgcgctctaactgtgcccagcgcttttttagcgtgccgttgta

SEQ ID NO: 14181 - DNA, 489 bp, Zea mays
  Clone ID: cC-zmpo148065e01d1
cgtccgcccaggcaggcccgacctcctgcccttgtacaacgcattctattttccccgtcccaatggcccagactgggtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggagacatgtacatctacagccggcacttcaacccgacggtgctggcgctggggcggcagatggcggcgctggagggcacggaggcgggctactgcacggcgtccgggatgtccgccatctcgttcgtgctgatgcaactggtgggcg

SEQ ID NO: 14182 - DNA, 505 bp, Zea mays
  unsure at all n locations
  Clone ID: cC-zmpo148065e02d1
gggacggcagcggcgacttcaggaccatcaacgcggcgttggttttaggngccgctgaagagcgccaccaggtgggttatgtacgtgaaggccggcaagtacagggagtacgtgtccgtggcccggaacgtgacgaacctggtgatggtcggcgacggcgccaccaagacggtgatcacgggccacaagagcttcatgatgaacatcaccaccaaggacacggccacgatggaggcgatcgggaacgggttcctgatgcgcggcatcggcgtgaagaacacggcgggagccaagaaccaccaggcggtggcgctgcgggtgcagagcgacatgtcggcgttctacgagtgccggttcgacgggtaccaggacacgctgtacacgcacacgagccgccagtactaccgcgactgcgtcatcacgggcaccatcgacttcatctttggcaacgcgcaggtggtgtttcagaactgcctcattcaggtgcgcaagtgcatggacaacc

SEQ ID NO: 14183 - DNA, 518 bp, Zea mays
  unsure at all n locations
  Clone ID: cC-zmpo148065e03d1
ccgcaaagatctggcttcaagatcgtgttgctactaagttttggttttttacttccgnncaacatgtngaagtacgggttatctgtcactcctgttggtgtccgacaatacatgctggcttcttggtttggaatgatgccaatcactcttgctttggtgtacgttggaacaacactgaaagatctatcagatgtgacacatgggtggagtgagatctcgactactcgatggattctgataatatctggctttgtattatctgtggtcttgatcatctgcgtcacaaaaattgcaaaatcatctctggagaaagcattggccgagaatggagagctggatgtaggaacatcgcagcttcctgtggtagcctctccctccgatctgcaacaacctcttgtaatcaagattgacacgtcaaatgaagatcaccagaagtaaaagtgttgtgttcacaatctcggatgtacattctttgtctgttgagtctgtagactatatatacccatagctcttgtgag

SEQ ID NO: 14184 - DNA, 611 bp, Zea mays
  unsure at all n locations
  Clone ID: cC-zmpo148065e04d1
aatgctgggtctgngccacccatngcaactttttgtttttaaaacagcaaggagagcggggggaggggcttcaaacccaaaccttgtaacaacattttccaaaatggctcttcaaagcctgaaagggaaccgggcaattcgtcaaacaaaagaacagctggtaaaacggcggaggaccttggtcacaaggatagttcacctgaagtgtcctaccagtactgtgtaagggtggtcaggtggctggagtgcgagggctacatcgagacaaacttcagggtgaagtttctcacatggtttagcctgcgtgccaccccgcaggagagaaagatagtcggtgtctatgtggatacccttattgaggaccctgtcagcctttctggccagctcgttgacagcttcttggaggcggtatatagcaaaaagcggaccccttctggtttctgcatggacctgtggcattgaagcaccacaagcacctaaccgttgctttgtagggagcacacattcgggcccattctttgttgcagacggtgcattgatctttattgaaatttcctgaagatttgacttgccatcttatgaaactaactttcatgacagagtttagttat

SEQ ID NO: 14185 - DNA, 418 bp, Zea mays
  unsure at all n locations
  Clone ID: cC-zmpo148065e06a1
atactanttgcaanccagaaaaaccacttggattggtttttacaacagcctttttgagtttacatatctcaatcagggaagtaattaatgacaattacaaactcgtttatttcattcacacccatccaggaccaagcgttcgctatgccgatagatcctcctcccatgttttattacacattatagaatcatgtgctcacccccatccatgaaccaattcttccccaaagcatttgttcaactacgttaggcaaccgtaccaggtgaactgccacatatatcccatggacagcatctttgcagcggggcattgtggcactgttacccacccacccactcacaacaagttgcagggtagtgttccataaaacctatccatcttttttcctgcaattgcccggtagaaggtattctaaac

SEQ ID NO: 14186 - DNA, 481 bp, Zea mays
  unsure at all n locations
  Clone ID: cC-zmpo148065e06d1
gagttgtncctggacgacaagagctggagggtttcgtttcacaagtaccaagctggaaagacggggggcgcgcactttcggcaggcagacgagctcctcgccgattcagggtggcattgcagcttctgcttccgctacataagcgatttcgcattcaagatgcaagcgtatagccacgtcgaccggatcaggttcaagtacttcctgaaccctgagaggatccaagatgtcatctgcagaggggcggaccttttcgatatgctttcagaagagtacacgttccaagagatcatcgccaagctggggccgatcccgagcacgtattctggcgttcatcttcctagctatctgctaaggaatgtcgaccggtttagataccttctaccgggcaactgcaggagagaaagtggctaggttttatggcccactaccctgcaacctgttgtgcgtgggtgggtgggtgccagtgccacactgcccc

SEQ ID NO: 14187 - DNA, 352 bp, Zea mays
  Clone ID: cC-zmpo148065e07d1
aaaaaaaaaaaagagaggaaacccaccaccaaaaaaaaaaaaaaaccgaaacccagaaaaaaaaaaaaaaaaaaaacaaaaaaaaaaaaaaaaaaaaaaacaaacaaagaaaaaaaagaaaaaaaaccaacagaaaaaaaaaaccaaaaaaaaaaaaaaaaaaaccaaaaaaaaaaaaaaacacaacaaacaaaaaaaaacacacaaaaaaaaacaaaaaaaaaaaaaacaaaaaaacacgaaaaaacacaaaaaaaaaaagaaaaacacaaaaaaagaaaaacaaaaaaaaaacgaccaaaaaaaaaaaaaaaacagagacaaaaaacaaaaaaaccacaacaaccaaaaa

SEQ ID NO: 14188 - DNA, 376 bp, Zea mays
  unsure at all n locations
  Clone ID: cC-zmpo148065e08a1
attatattaaaaaaaggcttgaatccaaacgcancgttattttatgataggacgcactacaccaaatggaatgcaaagctctttgtgccctaatagttgccaccaaatttccagtgtatgaagccactgttcctcaacaagatcagtggcaaattaccagcttctgtcagtctagtttcgctccgcattgtattaccattcagtatactgccaaccaacttgcatatgtgaagctggtgaaagtttaaatcccattgtgaaagttataagaattatattaatatataacgtattttcatgagaacatcctctacagctctgaaaacgttgcatcattttttttttgtcaggttggtggcggtcactgcagcaatct

SEQ ID NO: 14189 - DNA, 644 bp, Zea mays
  unsure at all n locations
  Clone ID: cC-zmpo148065e08d1
gtccgctctacccaagttcggcgagtgggacgtgaacaacctttcgtttttcggacgggttcacggncatcttcggcggggccagtgacgagaagaaagctcccccgacccaaggccacatcaggaacaacaggtcggtgtcggctgacagcaaggactccagggccgagaagatgacctcctacaacgccaggaccaacgcgtcgaagaaatggttctgctgtgtctcgcccagccccacacaatcttgaggaagctaacgacagagaaatggtccattgcatcgctgcggctggcagaccggccgcgagtgaactctccggatacttgccagtgacagtgtatagccgccgttgcaaatgacagtgtatagcgttcttagctgcctgtgcataccgtcagttcaggttgatgtctgcttgtaatttttcttttctcgcctcttctctacggtgtgtaacccttcctcagcgttaatcctcctgctgcattttgctgtaacttgggcgagggtggatttgtttcggctctgaccaaaaccaggtcacagcgaattctcagattgctgcagtgaccgtcaccaacctgacaaacaaaaatgctgcgacgttttcagagctgtagaggatgttctcatggaatac

SEQ ID NO: 14190 - DNA, 254 bp, Zea mays
  unsure at all n locations
  Clone ID: cC-zmpo148065e10d1
aaaaaacaggacgggctggngaagcngcagttgncttatcaagggaggaaggggcagcncgcgancagcgccgagancnacgaggggacaccggccccccacgncgncgaggagaagaagncggcaggcgacaccccggagaacgagaagacccgcagcaagggccnaagaccnacacncagcgacaacngcnggagcagccgancngaggagaacacggcaccgncaggggngcagccancaaaacngaagcc

SEQ ID NO: 14191 - DNA, 407 bp, Zea mays
  unsure at all n locations
  Clone ID: cC-zmpo148065e11d1
cgggggccgngcgagacgcgggagggatnggcgccggaggcttttcgtgatgancnccggcgacaggacgccggggaggggcagctgctgcaccaagaaacacgccagcctcgngcagancccaaggagggngnncngcaagaaggggggcaacgcggacggcgacaccngggacgagngcanaggaaaangcacngaaanacgccacaaagaaccggngcnagaagaacgccagnggagcgcgaacacngaccgancnccagggcaggaaagnnaccccnnggaaagccccaaagcacgggngaccggcagcggaancagaacngacaccccaacggagaagggcgaaaaaaacaagcccaanaggccacccaaaccaacagcncctgaacccgaagngaaacaaa

SEQ ID NO: 14192 - DNA, 280 bp, Zea mays
  unsure at all n locations
  Clone ID: cC-zmpo148065e12a1
aanaaaaaatttttttttttttacgccacaaactccaccacaagggaacggttttaattatatacatacttaaaaccaaaaccccccaactattctttttaattaacaccccttcctattaaaaaaaaaaaaactatttctcctcaacaaaaactctttcactcccactccactttattttaataaaaaaaaaaacttcctttaaaaaaacccccaataaaaacaaacccattttttttctccccaaaaaaaaaaattaaaataaattacttccctccca

SEQ ID NO: 14193 - DNA, 562 bp, Zea mays
  Clone ID: cC-zmpo148065e12d1
cgagaaacctgagtcatgtcctccatcaccaccaccaagtttacatcagccagctcgcgaaaataatgaagagccggagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaaccccttgaatgaatgaaccatgcatgcatgcatgtatgcat

SEQ ID NO: 14194 - DNA, 410 bp, Zea mays
  Clone ID: cC-zmpo148065f01a1
atcacggaaataagataattaactgtgggtgacaagaaccaagtgaacaacaacatatttccattccagcaaacaacatgtgagcctaaaactcggaaaaagatcaatacaatgtgcagggaaaacaacggcatgcagctaattcccagcagaatcctcggtggcggtgcgccttcttagcttggcgcgcgttacacggatcgactcctccatcggcgtctcctcgagcgcagggtcaagctctttcgcgccctctgcagcatcaccactgacctcatcgattgccatgttgtctacttcttcggactcagaaagaggtggggcactaggctcggattttggtgaatctgcacttgtggctggagtttgaactgggtcaacagcaagttttacctcacctttttttgggc

SEQ ID NO: 14195 - DNA, 491 bp, Zea mays
  Clone ID: cC-zmpo148065f01d1
gtccgcccacgcgtccgcccacgcgtccgggcatccacaaagttctgttttagctgcatccacaccaaaacctggggggggcccaaagaaaggtgaggtcaaacctgctgtcgacccagttcaaactccagccacaagtgcagattcaccaaaatccgagcctagtgccccaccactttctgagaccgaagaagtagacaacatggcaatcgatgaggtcagtggtgatgctgcagagggcgcggaagagcttgaccctgcgctcgaggagacgccgatggaggagacgatccgtgtgacgcgcgccaagctaaggaggcgcaccgccaccgaggattctgctgggaattagctgcatgccgttgttttccctgcacattgtattgatctttttccgagttttaggctcacatgttgtttgctggaatggagatatgttgttgttcacttggttcttgtgacacagagttaattatcttatttccgtgctt

SEQ ID NO: 14196 - DNA, 549 bp, Zea mays
  unsure at all n locations
  Clone ID: cC-zmpo148065f02d1
ggccgcggacgcgtgggttgatttctcctagaaggtagaatgtcgnatattagaagaaggcgagacgngcaggggggggggcaccgatcgagaacagggaagcacgaggctgctagagatcgagctcatcaaccaaccaagtcgtacgtcgtcagcatcacgaccggatggcgcgtgccgcgtccagctatgtatccaggagggggctctccgcagcgatgacggtggcggaggagtccgtgaagaaggtggaggacaaggcggtgaagctgggaactgtggccaaggacatcgccagcgccatggccaccacgacggaggagaagacggcgttctgggaacctgaccccgagaccggatactaccgtccggtcaccggcacgaaagaggtggacgccgccgacctgcgcgccgagatgctcaagcggaggattctgcaggacgactgatgcatgcagcatgcactaactgcccctgttcgatcgccaagatcacaccacgacgaagatactgtacctagtagtacgtacgtacgtgtacacctgatta

SEQ ID NO: 14197 - DNA, 272 bp, Zea mays
  Clone ID: cC-zmpo148065f03a1
aacccccgacaccaaaaaagcgcgccgcagtaataatttataagcttttaaccaacaacaaccaaaattggtgtgttttaaaaaaaaaaaatattacccccaaaaatttacagtgtcaccaacttaaaaaaaaaaataaattgaagaggttccacaatcaaaagtacctgggaaccaacgaaaaataacaaatctgaaatttaccgttcgaaaaaaaatttttactttaaaaagtgtttcttctcaggagggttcaaaaaaaatataatttt

SEQ ID NO: 14198 - DNA, 576 bp, Zea mays
  unsure at all n locations
  Clone ID: cC-zmpo148065f03d1
cgcgtccgatgcgacaagatggcatgcacaattttttttttgagagcctngntcctcctggggcgctgctgtattgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagctgtgtggagcaagaactcctgcaccaagaagtacgactgcaagatccttcccaactcgctggtgatggacttcgtgaacaacggggaggtgtccggngtcacgctgcttaactccaagtttttcaca

SEQ ID NO: 14199 - DNA, 358 bp, Zea mays
  Clone ID: cC-zmpo148065f04a1
ggaacaaatcaatatgtaaggtgtgatttatgtatggatgttccaccctacactgtctggtaatgaaaacattaatattgccacttttaaagttttgaattgctgatataaattttcttcaaaaattatgagaaatacgccgcagccattggctttatgttacaatgagcctgacacgatttttatctgtcacaaaaataatgtgcgtctatgacatgataaatcatctgtttccaaaaatatcttgtctaacaaatttcgcccatctccaggtcacaacaacggataatcattcaatttataccacaactcaattcttcgaagtaaactatcattccctctagtggaatctttttgc

SEQ ID NO: 14200 - DNA, 549 bp, Zea mays
  unsure at all n locations
  Clone ID: cC-zmpo148065f04d1
cgggcgatatatgggggcgaaancggnagaagaggtttttgttttcgccgccggagtccattgctctggggtcgggctggacggtcccaacgtccagttttccgcctcctccgaggaagaaccaacgacgtctggcctggagaatggccatcaggagccctttgttattggcgttgctgggggtgcatcgtcaggcaaaagtaccgtgtgcaagatgatcattgatcagctccgtgaccagcgcgttgtggctgttacacaggagtccttttattatggattgacggatgaagaattagtccatgttcatgattataattttgatcatccagatgcatttcatacagagctacttctctcttgtatgcaaaacttgaaacatggcaaagctgtcgacatccctaattacaacttcaagacatacaagagtgtaccaaatgcaaggaaggttaatccttcagatgttattattttggaaggaattctagtttttcatgattcacgcctcacggatttgatgaacatgaagatcttcgttgatacagatgc

SEQ ID NO: 14201 - DNA, 376 bp, Zea mays
  unsure at all n locations
  Clone ID: cC-zmpo148065f05a1
agctggatcctgagagggccgcccttannnaaacaaatttttttttttgaaggaaaacgaaatataccccggacaggcttcttttatggtcggagcctgaaacctgacaaaacaattttgtcctccccttcctgctttccctcccggtttgggtcacaatacaatcttatctacgccggagctgcactgtactgcactgcactgcactgcacgagaaactgctcgctggctctcgactgcgctccctcgctctccacccaaaggaaaacccaacaagaacccgagctcccttccaagttccaacccctgtatgtacagtcgatcgtaggctttcgttccgtcccgtcccgtcccggccggtcagctccgcaacgcg

SEQ ID NO: 14202 - DNA, 529 bp, Zea mays
  Clone ID: cC-zmpo148065f05d1
gcgtccgcccacgcgtccgcggagagcaacggtaccttttagttcccaggcatcggcgccttgggggggaacgacaggtacatgcgtagccgcctgaaggcggcagcggaggcggccggcaagcctgagtggggccacggtgggccgaccgacgctggcggctacaacaactggccggaggacaccgtcttcttccgcggcgacaacggtgggtggagcaccgagtacggcgacttctttctgtcgtggtactcgcagatgctgctggagcacggcgaccgcatcctgtcgggcgccacgtccgtgttcggcgcggcgcccgtggaggtctccgtgaaggtggtcggcatccactggcactacggcagccggtcccacgcccccgagctcaccgcgggctactacaacacgcggtgccacgacgggtaccttaccatcgtgcgcctcctggcgcgccacggggccgtgctcaactttacctgggtggagatgcgggaccacgagcaatctcatgaggcgcggtgcatgc

SEQ ID NO: 14203 - DNA, 422 bp, Zea mays
  unsure at all n locations
  Clone ID: cC-zmpo148065f06a1
aaanaannaccattttatttttagcagggccaggacaataaaggggggcagaatacttttactacatgatatgacacaccaccaggtcctttttttacaaccaggtgagaacattttgtagtttgtacaggtacattctacaaagccacagccaccggtgtacactcaacagcacaagctcacagcatcacaaaagcaggtgcccaaaaaacataccacccactgggaccagagcagcgtgtcaccggccttatctccaccctggtggcactatgacgcgcaaggcattctggtgccaactacctccttggacattttcaggaacaggtccaggttgaggtggtaccggctctttatgccatcatctataactgccccactcccatggatgcttctccagggctggcgagttcttggttttg

SEQ ID NO: 14204 - DNA, 545 bp, Zea mays
  Clone ID: cC-zmpo148065f06d1
gtccgcccacgcgtccgcccacgcgtccgcccacgcgtccgttttattttttcgaagatcaacaataccaatggggacgggagtgtggctgctatacatgcaacagtcttcagctgtcttcgcaggcgagcagccggggagcaactgtatgacctcaacacaaacactgttgctgtagtggatgaggaatacaggaaccagcgtgcagctaacaccttgggttctaagggcatgtttcagttgatccaaaggaaggggtcttcaaggaatctgatggcacttcttaacaccgacggttcagtcaccaaagcttggcatgtaagtgcaagtgatggcaatgggaatcttaatggtatcacaaacaacaagaagtctcctgaaaatcctatgctggatccctcacaaatcgggaaggcagaagccgtcaatctccagtttggtccttttgggatcagtgcctggatgagtgacacgggtggaaccagccatactgggagtgtggaagacctgaggcctgatagtgtggagactggtggtagaaatta

SEQ ID NO: 14205 - DNA, 620 bp, Zea mays
  Clone ID: cC-zmpo148065f07d1
gtccggaataaactatggggcaagcctacccacggcttgtttttcttttcctcgtggcgttgttgtctgccgggctgtggccgcaggcgttagggaacggcaagggcaaggtgcatggcggcggtgccgtcaacccgctggttgccggcatctgctctcgcgccccattcccagaggtttgcacggccacagccgggcgccatgcattcaagtacccggtcatcgacaatttggccgtgctgaacatgcaggtggccgcgttcgccaagcgcacagcgcaggcgcggaagcacgtcgcggtggcggcccgcactattccaccgccgcaggcacaggccctcaggacctgcgacacgatgtacatgaacacgcaggacgccatctgcgcggcgcagcgagccatcgcgttcaaggacacgggcaccgcgaagatcatgctgcagctcgccgtccaggactttgactcgtgtgaccgttccttcacccatgccggcggtgtccccaaccccatgggtaagttcgataaggagctcagccagatggccaacaactgcatggcgctttgcaacatgatatgaatcatatatatgcggcccgggacagtttggatgtgcttacac

SEQ ID NO: 14206 - DNA, 514 bp, Zea mays
  unsure at all n locations
  Clone ID: cC-zmpo148065f09d1
cgggggatcgngcccaggtcctaccgcagggnggcgtgctttatttatggcggcatncggnacaccatcggcgggaacaagtacttcaacatggtgacgatcaccaacgtgggcggcgccggcgacatcgcggcagtgtcggtgaaggggagcaagcgcgttaagtggacggagatgaagcgcaactgggggcaagtgtggcagaccggggaggacctcacatgcgagtcgctgacgttccgggtgatgaccagcgaccaccgcaaggccacctcatggcacgttctccctgctgactggaagttcggcgtcacgtaccaggcgtccaagaacttctaagtagccactttccctcctcttcttcaacctgcatgcccgcaagcagccatgcagatgataacatgcatcatgcatgcatattcattctttcgctcatgcactccgatacggngccggagttaaaaaaatataaatcaatgtgcaaattcaaatgacatcttaaccagttgtgatc

SEQ ID NO: 14207 - DNA, 291 bp, Zea mays
  Clone ID: cC-zmpo148065f10a1
tttaacaaacatagatctccacacacccacaatcaataccatactatattgtttaatattaattacaaggaaaaatttgttacctgattgcaagcaattacatcaagattgatgaatgacaccgcccagctgttcgaatcaattaaactatgcggacatatgtggtcaaaaagggcccggtggtcaccataccgttcccggcggtcttcttcttcatgaggaaaaggtcgtcggtggtcctaatcgctgagtgcgcgccaaccatcgcgccccccaccatgactgatccca

SEQ ID NO: 14208 - DNA, 545 bp, Zea mays
  unsure at all n locations
  Clone ID: cC-zmpo148065f10d1
ccgcccacgcgtccggccctctactccctcctccgcccccgccttgtcctgttcaggccccgcttacgtggcgccgggctgtttcacccccgtcggcggcggatacacctacccggcgccggccttctccgggggcagcgccggctacgccaggatcccgacctaccccgcgcccccgtcggcgtaccccgccaccacccctcccacgccgcaggtctccaccaacgccccggtccaggaccccacggcgccgccgtccccgctggccaaggcgggcgagctcgtcgcgcggctccgcgagcagggccaggcgctgatggcggcgcgccggccctgggccgaggtcttccgcgcggcggccttctccaggccaccgtcgctctgggaggcgctcgcccggacgcgccgcaacgccgnctactttcgcgccaactacgcgctggccgtgctcggcgccgnggcggctcgctgcttggcaccccggcacgctgctcgcgcttcgtctcctttgcgccgnctgggtcttcctttacttcgcgcggggg

SEQ ID NO: 14209 - DNA, 356 bp, Zea mays
  Clone ID: cC-zmpo148065f11a1
tttaatattatattatttttaaccggccaacatattacaaggtgccgtttttttttcccctgccgattcataccacacccatatatattgtgatatcttaaattacttaatttttcaaaaccaaccccccagtaaatttaatttgctgtaccttacccttaatagtacctattgctcactaacaaacaccaattgcaacaagcatccctgtcttcttcatatataaagactggttaatccatccatccttcttggcgctctccaatcaaaaaactaactttttccctgtttcatgcacctttaattctaagtcgttccactcaattttccattctgtctaaacccttggtcatttt

SEQ ID NO: 14210 - DNA, 570 bp, Zea mays
  Clone ID: cC-zmpo148065f11d1
aactacacaaaaaaaacacaagggagcctcccgattttctctgttgcgatctcgaataagatccgggggtgcgcgatgatttgaatctctcgaactgatcatgacaggaatgccccctgcagtctgcagctgattgcaggggacgtctgctgcctacagctctcggtctcggatgccatagaagagttggtccccatggactgcggacaccacggcgttgttccacggcctgaacaccaggcgccgcccaattgctgcgccaccgaggtcccgcagagcccgacgctctcttccgaagaattcctccagttcaagaggaaggccaccacgatcgtggaggagtacttctccacggacgacgtcgccgcgacggcgaacgagctgcgggagctccgcgtcccgtgctaccacttctacttcgtcaagaagctggtctccgtggcaatggaccgccacgacagggagaaggagaaggcggcggtgctgctgtcctcgctctacggcgacgtcgtcgaccgcccgcagctctgcaaggccttctgcaagctcaccgagtcctgcgacgacctg

SEQ ID NO: 14211 - DNA, 381 bp, Zea mays
  unsure at all n locations
  Clone ID: cC-zmpo148065g01a1
nnnnnnnnntttttatttttcncnaaaaaacgaacaatgggggaggcaaccgctagcattcaatggccatctccctcatttcatgagcaacggaataaatgcaggccagggacaattacacagagtttgctcaacctaactcgtaatttcaatgaattcttaaatgaaaaccaagtgctcctcatgtccaagcattccctgcatgcggcgcgccgccacctcacgctggagtgtaagcacatgccaaactgtccccggccgcatatatatgattcatatcatgtttgcaagcgccatgcagttgttggccatctggctgagctccttatcgaacttacccatggggttggggacaccggcatgggtgaacggacggtcaca

SEQ ID NO: 14212 - DNA, 573 bp, Zea mays
  Clone ID: cC-zmpo148065g01d1
gtccgataaactatggggcaagccttcccacggcttgtccttttcgttcttgtggcgttgttgtctgccggcgggttgccgcatgcgttagggaacggcaagggcaacgtgcatggcggcggtgccgtcaacccgctggttgccggcatctgctctcgcgccccattcccagaggtttgcacggtcacagccgggcgccatgcatccaagtacccggtcatcgaccatttggccgtgctgaacatgcaggtggccgcgttcgccaagcgcacagcgcaggcgcggaagcacgtcgcggtggcggcccgcactattccaccgccgcaggcacaggccctcagaacctgcgacacgatgtacatgaacacgcaggacgccatcggcgcggcgcagcgagccatcgcgttcaaggacacgggcaccgcgaagatcatgctgcagctcgccgtccaggacttcgactcgtgtgaccgttcgttcacccatgccggtgtccccaaccccatgggtaagttcgataaggagctcagccagatggtcaacaactgcatggcgcttgcaaacatgatatga

SEQ ID NO: 14213 - DNA, 465 bp, Zea mays
  unsure at all n locations
  Clone ID: cC-zmpo148065g02a1
atccttagagcggccccctnnnnnnnnntttttactttaacaaganaangaaccttgagcgcggtaggagataattcatacatgaacaaaataataaatattgagttattcataacatacttaatacatgaacaagataatgaaccttgagcatacatgaacaagatacatgacagtcatcagaatatacatgacagttaccagaacatacatgacattcgtcataaataaaaaccagataatgaacgttattaaaaataggttgtctatgcatggcgaacgatcgagcgatcttgtttagcactgcctactgcatatgcaacggtggcggaaggtgctgtacctgccggccaaaaagccctcaccgcggcacacattggcgcagttgtttgcgatcatgcatgccccaacaaatcgctcactgtacttctcgcatatccctgcctgtgccatatcgggggacac

SEQ ID NO: 14214 - DNA, 584 bp, Zea mays
  Clone ID: cC-zmpo148065g02d1
gtccgcccacgcgtccgatttgaaataattgggaataaatagttcgttattccctgaagcgtgcatatatatagtccgggcaagataaaggtaatggagtcgtcacgcacgttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgttcgccatgcatcgacaacctattcttaataacgttcattatctcgttcttatttatgacgaatgtcatgtatgttctggtgactgtcatgtatattctgatgactgtcatgtatcttgttcatgtatgctcaaggttcattatctcgttcatgtattaagtatgttatgaataactcaatattcattattttggtcatgtatgaattatcttctaatgagctcaaggttcattattttgttcatgtaaaaa

SEQ ID NO: 14215 - DNA, 290 bp, Zea mays
  unsure at all n locations
  Clone ID: cC-zmpo148065g03a1
nnnnnnnnnttttttttttttaccctaaaagagaaacatggngggggggtatatgtcaaacgagccactctctgtacaatcaaagcatgcatttgaaacggatctcggtacacgtacgtacacgtcagcatgatctctccgtacaatcaaagcaacacaagtggccttaatttggcagtctttcaattcaccatgatctgaagaagagcacgtcttatataattaaccatgcacacgtttggttttttaacgaacaaaacagaacgatcggattgatggatcgtgcaacg

SEQ ID NO: 14216 - DNA, 274 bp, Zea mays
  Clone ID: cC-zmpo148065g03d1
gtccgcactgcacgatccatcaatccgatcgatctgtcttgtttgtttttaaaccaaacgtgtgcatggttaaggatggaagacgtgctcttcttcagatcatggtgaattgaaagactgccaaattaaggccacttgtgttgctttgattgtacggagagatcatgctgacgtgtacgtacgtgtaccgagatccgtttcaaatgcatgctttgattgtacagagagtggctcgtttggcatatagctccgctacatgattctctaatagggt

SEQ ID NO: 14217 - DNA, 388 bp, Zea mays
  unsure at all n locations
  Clone ID: cC-zmpo148065g04a1
atgattaagagngattcttgatagggttcgaaaaaattacctgtgtatacacaagtgttttccgttgcaatgcacgggcatatacctaatatataatattatgcatgttaatccaattggttcagatgcaggcgagcttctttgccaagccgatggacttgccgatggtgttcttgcagacggccatggtcttgttgccggatccattgtacttgatgtcgacgttgacgagctgcacgccctggcatggcaggttgttggcgcaattgaacgtgatggcctccggcgtgttggaagtgccgtgtgattttcttgaagacgacattgtttacggccaccttggaagcgccggactttacgcataatttgttggggcaatactttttgt

SEQ ID NO: 14218 - DNA, 551 bp, Zea mays
  Clone ID: cC-zmpo148065g04d1
gtccgcggcaccaatctgccatcctctccatcacgaagatggttttttttagcaatgtcgcagtgaaggcggggggcggggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgttcatcaacggccacggcaccatcgacgggcagggagccctggtgtggagcaagaaccagtgccagcattcttacaattgcaagatcctcccgaatagcttggtgctggatttt

SEQ ID NO: 14219 - DNA, 439 bp, Zea mays
  Clone ID: cC-zmpo148065g05a1
agatgttatttgaacccgcacattgatttgggtggggttaactccggcaccgtatcggagcgcatgagcgaaagaatgaatatgcatgcatgatgcatgttatcatcttgcatggctgcttgcgggcatgcaggttgaagaagaggagggaaagtggctacttagaagttcttggacgcctggtacgtgacgccgaactttcagtcagcagggagaacgtgccatgaggtggccttgcggtggtcgctggtcatcacccggaacgtcagcgactcgcatgtgaggtccttcccggtctgccacacttgcccccagttgcgctttattttcgttcacttaacgcgcttgctcccctttaccgacactgtcgcgatgtctcccgcgccgcccacgttggtgatcgtcaaccatgttgaagtacttgttcccggtgatggtg

SEQ ID NO: 14220 - DNA, 593 bp, Zea mays
  unsure at all n locations
  Clone ID: cC-zmpo148065g05d1
gtccggnggatggcggcgccacggcctctcctgctatcgctgtttgttgtcgngctagcggnggccgcggatggggggaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccgcccaacgaccagcagtccgcggacagcggcgggtggtgcaacccgccgcgggagcactttgaccttagcatgcccgcgttccttccgatcgcgcangagaaggccggcatcgtgcccatcttctaccgcanggtggcgtgcacgaaacaaggcggcattcggtacaccatcacccggaacaagtactttaacat

SEQ ID NO: 14221 - DNA, 427 bp, Zea mays
  Clone ID: cC-zmpo148065g06a1
gtataactgccgcatgccttttttggtttccattctttcgaagaaaaacacacatttgcctgacattacatttggagttccatcgactgtttattttatttgaacaaaaacaattagcttataaaatgccatatttatacgaatacaatatatagttccgtccatatcagatggttatcgcatgcgtggccagccggtgaccacgtacgtatagactcgctcatcgcctgagctgaacgccacttcaccccggcgcatgcatacatgcatgcatgcatgcatggttcattcatttcaaggggcttcgcttcaagaaagaggaggggtgcatgaccttttgcaattctcgctgaggcgcgggtttttctcctttgcgcatgtgacgcttcatgccctggtgacctctgccgtctttaccacgtactcc

SEQ ID NO: 14222 - DNA, 581 bp, Zea mays
  Clone ID: cC-zmpo148065g06d1
gggcggctcaacaacagccagctcgcgaaaataatgaagagtttcattttggcatcatcggccgcgctcttggggctggccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctcctttttgaagcgaagccccttgaatgaatgaaccatgcatgcatgcatgcatgtatgcatgcgccggggtgacgtggcgttcaactcatgcgctgagcgagtctat

SEQ ID NO: 14223 - DNA, 341 bp, Zea mays
  unsure at all n locations
  Clone ID: cC-zmpo148065g07a1
anatnnnttttatttgtgaagacaaaggcaangaaaggcggtctggctggnttcatgacatactattgaataaatactgcaggtcaggaacaaatacatagagttactcaatataataataactcaataatttcaatgaattcttaattaaatgaaaaatgaatgcaagcattccctgcatgcgatggcacctcacgctggggttgcatgcgtggttcatatcatgtttgcaagagccatgcagttgttggccatttggttgagctccttgtcaaacttccccatggggttggggacacccgcctgggtgaaggggcggtctcacaattcaaattcctgga

SEQ ID NO: 14224 - DNA, 586 bp, Zea mays
  unsure at all n locations
  Clone ID: cC-zmpo148065g07d1
gcttcctcgctggcccataaatatatatctatctatctttatctgttcaattataanctcacagaataagggacagtgatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgttcaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaagacaccatcggcgcggcgcagcgggccatcacgttcaaggacaccggcaccgccaagatcatgctgcagctcgccgttcaggacttcgactcgtgcgacccgccttcacccaggccggcgtcccaaccccatggggaagtttgacaagagc

SEQ ID NO: 14225 - DNA, 328 bp, Zea mays
  unsure at all n locations
  Clone ID: cC-zmpo148065g08d1
cgaccgagaggggaacgaggcanccnccaanaaaagccattttatttatanaaaaccgagagaccccagccggcaggcatgccgaccgccgacggaccaccccccccacccgagagaaagaaggagaagaacaagaggaaccccaccgccgcgccccacggagncgccgacgcggccaccgcagagcaggcccccaccgaggccgacgccgccggcgccccaaccgactccgagacgccggcgaccgccgaagcccccgctggcgccaccggcgccggcgcccgcaccggcaccgacgcggggcccnccgccagcggcgccgagcccg

SEQ ID NO: 14226 - DNA, 246 bp, Zea mays
  unsure at all n locations
  Clone ID: cC-zmpo148065g09a1
aattatatatngcagggacgacaaaccccaaggaatacagagatacaaaaattgtacaagatcccatgcttgcttcaaaacttgaagaagctatctggaaatcatgagttcagttggtggcgctcttcttcttcttcttgttcttcttcttgaggcccgtggcatagtatttgcatgataataagactcctcccttgaagcactctgctcgtgcgcatcccaccttgttgcttcatttgccaacca

SEQ ID NO: 14227 - DNA, 469 bp, Zea mays
  unsure at all n locations
  Clone ID: cC-zmpo148065g09d1
gtccgcccacgcgtccggacgttggcaagagaggagggccgttttttttttgcctagctcgancttgaaccagggctggccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtgtcaccgaccaacggcacggggtggtacaagggcatcgcccgggagttcgtggacgcccacaacgagctccgcgcgcgctacggcgtgc

SEQ ID NO: 14228 - DNA, 404 bp, Zea mays
  unsure at all n locations
  Clone ID: cC-zmpo148065g10a1
nnnnnnnntttttacttttaaagaaacggacaataaccgggggcgggaaaagttntnnnctatatnacagaaaaaaatacattcttacgcccaacaactggcatagccatgcacatatgctccaatataccgatccttacagaaaaaagaactgaagaatggtcacaagtaaaatgaacctggaatgaaatagtacatatataataattcacttaggaaataaatataaatatttgagaattgtatcgtacggaagagatcgagcatagtccacggatgatgaatctcttatggactaccgttagcagtgggcggggggtctgaaataaatgatgtaataataacgatgcatgcaatgtgaattgagtatatagtgtggatgtgtttgttgcttggtcgttgat

SEQ ID NO: 14229 - DNA, 578 bp, Zea mays
  Clone ID: cC-zmpo148065g10d1
cgcggacgcgtgggcggttcatcgtgttcaggatcgacgacttttacttggagatcaaggtggaccgcctcgggggacggaaccagggctacggcgacttcaccgacagcctccccgccaacgagtgccgctacgcgatctacgacctcgacttcaccaccatcgagaactgccagaagagcaagatcttcttcttctcctggtcccctgacactgcacgcaccaggagcaagatgctgtacgccagctccaaggacaggttcaggagggagctggacggcatccagtgcgagatccaggccaccgaccccagcgagatgagcctcgacatcgtcaggagccggaccaactgaccgtcatcgtccatcaacgaccaagcaacaacacatccacactatatactcaattcacattgcatgcatcgttattattacatcatttatttcagaccccccgcccactgctaaccgtagtccataagagattcatcatccgtggactatgctcgatctctttcgtacgatacaattctcaaatatttctatttatttcctaagtgaattattatatatgtacta

SEQ ID NO: 14230 - DNA, 382 bp, Zea mays
  unsure at all n locations
  Clone ID: cC-zmpo148065g11a1
ggccccctnaanaaanaaattttttttttagggccacggacaccccgggggangggatcaaatcaaccaaacaagagctctcaacgtacttgcacaagcctacacaggctatgcgcagtttgcatttgaactgagaaccagtctttcagcatccaacaaccaaacacattgtataactacagagatgggtcaatggggggtctagaagcatgcgagcgccttcaggcaaacccttggcgctgcccttagcgttcttgcatacagacatggtcttgttgttggcgccactgtaaatgatgttgacgtcttccattggtgacaccggtgcatgggatcttggcggaacaaaacaagttgaccgcccccggggtggaagaggtgc

SEQ ID NO: 14231 - DNA, 604 bp, Zea mays
  Clone ID: cC-zmpo148065g11d1
cggaacatgtacaagtgcaaggacatgctgatcaaggacgtttttgttacttcgcccggggacagccccaacacggacgggatccacatgggcgactcgtccggggccaccatcaccaacaccgtcatcggcgtcggcgatgactgcatctccatcggccccgggacctccaaggtgaacatcaccggcgtgacctgcggccccggccacggcatcagcattggcagcctagggcggtacaaggacgagaaggacgtcacggatatcaacgtcaaggactgcacgcttaagaagacggccaatggcgtccgcatcaaggcatatgaggacgctgcctccgtgctcaccgccttcaagatccactatgagaatatcaagatggaggactcgggctaccccatcatcatcgacatgaagtactgccccaacaagttatgcaccgccaatggtgcctccaaggtcaccgtcaaggacgtcaccttcaagaacatcaccggcacctccttcaccccggaggccgtcaacctgctctgctccgccaagatcccatgcaccggtgtcaccatggacgacgtcaacatcaactacagttggcaccacaaca

SEQ ID NO: 14232 - DNA, 349 bp, Zea mays
  unsure at all n locations
  Clone ID: cC-zmpo148065g12a1
aaanaaannttttttttttgcacaangcaccgcacaangaacggccccgattacctgggtgaatcgatcgccatcatcaagacgcatgcttcgatttgtatgaagcttgcagctaccgtacgcttctccagtccacgaatctcagctcactgcgctggcagtggcatggatactctccaccaaccactggaatggatacttatactagcctatgtacaacacggtccagtctgacttacttgttctccatgaccagcctggggccgccgccgatggcaatgaagcgctaggcaagcttctaggcggagaagatggcgccctttacaacaaacgctcgggcgactgctgt

SEQ ID NO: 14233 - DNA, 565 bp, Zea mays
  unsure at all n locations
  Clone ID: cC-zmpo148065g12d1
cgctccgcgccgcgcgtgggccgatccagcccggccctcggatgtnctcctctggcacgtacagcgacgacaccggcgagggtgggtgcgggtccatggagttctggcccccgttcctggcctccagcggcgggcgcgagttcgtggccggcggggtgggcggcatggcgggcgtgctggcgggccacccgctcgacacgctccgcatccgcctccagcagccgcccgccgcgggcgcaccacgccgccgcgacgcgcacccctcagccccgcgcctcctacgcggcatcctccgcgccgagggcccctgcgcgctctaccgcggcatggccgcgccgctcgcctccgtcgccttccagaacgcgatggtgttccaggtgtatgcggtcctgtcgcggtcgctgggccccgccaccttcgagccgccgtcctacgcgagcgtggcgctggccggcgtcagcacgggggcgctgcagacgctgatcctgtccccggtggagctggtccagatcccgctgcagctggaggcggcgttcggagcacggccccgtggagatggtccgtg

SEQ ID NO: 14234 - DNA, 339 bp, Zea mays
  Clone ID: cC-zmpo148065h01a1
aaccgaatctgaatatatatatagggatgtatagggaaaaacaagacaacattattgtcttcaactgttgattgtgattacaaattcaatgagggcaagcgtttgaattatgaactttcaatgaccgaaatggtactcattctataaaactatgaagcatgtattctggaaacaaggattattgataaccgttgaaatctgcagcctctggaaataaaaatctttgaagcacaaacaagatctttccgaacagagaggtacattcaatcacgccaatttttgatcaatgcataaattggcaatgcaccgccgagtgcatgccataattgttgcggaaaa

SEQ ID NO: 14235 - DNA, 618 bp, Zea mays
  unsure at all n locations
  Clone ID: cC-zmpo148065h01d1
cggcagcttgccatggggctgccggccccctccgccccttttttttttaccgcaagacggcgctgcggagggcggggggtgctcacgggttgttttggcgaccccgagatgaagcggcggcggcgggtggcgggctacaaggcgtacgcggtggggggcaaggtgaaggcgtccctccgccggggcctcaggtggttcaagcgcaaatgctcccgcatcttgaatatctgaccaccgtgcggcggcgcgcggcggcgttctcccactcttcttggaccgcaaggccgctcttttaccgcaacaattatggcatgcactcggcggtgcattgccaatttatgcattgatcaagaattcgcgtgattgaatgtacctctctgttcggaaagatcttgtttgtgcttccaagatttttatttccagaggctgcagatttcaacgggtatcaataatccttgttttcagactacatgctttctagtcttctagaatgcgtaccatttcggtcattgaagttcataattcaaacgcttgccctcattgaattngtaatcaccatcaacagttgaagacaantaatgntgcctggtttttcccttatatatatatatatataat

SEQ ID NO: 14236 - DNA, 320 bp, Zea mays
  unsure at all n locations
  Clone ID: cC-zmpo148065h02a1
ggaaacaagagagcggccgcccnaaanaannanntttttatttagaaggaacagccagcaagcccgggganggggacccaatcaatcgaggaaaaacacacacccgcgtgacattacaaatggagaaccaccgacgggaaaattggaaaaaaaacaattagcatagaaaacgccacaataataggaaaacaaaatataggcccgcccaaaaaaaaaggataacgcatgcgcggccagccggggacgaaccaacgaaagactcactcaacgcctgagctgaaccccacctcaccccggcgcaagcaaacaagcaagcaagc

SEQ ID NO: 14237 - DNA, 570 bp, Zea mays
  Clone ID: cC-zmpo148065h02d1
gggcgagcaaacctgcagtcatctcctccatcaccaccacctttttttttacagccagctcgcgaaaataaggaggaggcgcagtatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaaaggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatg

SEQ ID NO: 14238 - DNA, 493 bp, Zea mays
  unsure at all n locations
  Clone ID: cC-zmpo148065h03d1
gtccgggccgtgtccctcggcgtgcgcgccgccggcgccggctttcttttttgacatcaaggngtcgtgtgcagggagggcggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgctggaccacctggacgacaccgagggcggtctcgacgacggcaagctccacgacgtgaagctgttcctggacacggcggaggaggacacgtggtcctgcgacgtctgctgcaagcacgccccatccacgcccgtcaaaaccacgctgctcgccaagaacaaggactttgaggcgctcatgcgcgtcgcccacgcgctcatcaagcgggccacc

SEQ ID NO: 14239 - DNA, 347 bp, Zea mays
  Clone ID: cC-zmpo148065h05a1
atataaccaaacttttttttttttttgaaaaaaaacaccacaccgggctcggtaaataatttacaaatcggtcatgccctccacggagaagccaaaaatatttttgcttcaaaatttcaccccattctttcctgaacaaattacccataaaagaaaagcacacattacccctaggagttccagcgctccgatgcaacaaatttttctagcatgcttaatccggtggatactgcctctatccttttacagcgagaatgaaatggcacaccaatcaaagctttttttggcccgcaaacatttttggatattggtgcgccggctctcgaattgtccataagaaaatggtt

SEQ ID NO: 14240 - DNA, 500 bp, Zea mays
  unsure at all n locations
  Clone ID: cC-zmpo148065h05d1
cgcgtgcgccacgcgtccgccgccagncgcgtttctttttatggccgcgcggcgcgggcccggggtggtcaagctccacgatcccaacccgcccctcctcggccgggcgccggggaccgcaccggccgccatccccgcgccgtcgcgcgatgagggcatcctcgcgcagcaccctcgcgccgccccctcgagcgcatccgcctcgcacccggccttcgcccttatcgaggagcgcctcgtcgcccgggaccaggacatccaggagctcctcgtcgacaaccagcggttcgccgccacgcacgtcgcgcttcagcagcagcttatcgcggcgcagcacgagctccgggcggtctccgtcgctgccaccagggcgcgcgccgagcgggaggtcgaggtgcgagcgctggccgaccaggcggcccacatagaggccgaggcgcgggccgtcgccgctgcgcgcgcggaggtcgaccagttcacgccgacgtcaagtgctcgtc

SEQ ID NO: 14241 - DNA, 432 bp, Zea mays
  Clone ID: cC-zmpo148065h06a1
cttgcacgcaacaacagcgcccgggggctgtgaaattttatcacacagtgaaagtcatgcccagcccatattacatacaaaagaatcaagggtgtacaatcctaccaaaatactctgagtatgcacacccgcactttctttttttttggctcgttcgcagtggcgaaagcctctctgctttgccactacgctctccagggagggggattcctccgtcgagcagccgatcgccaaacagcagtatgatacaaggtatgtattcttaaaccctttttaaatagtttggacaaacctacacaacggttgtgatatgccgtcactttttcccgccgcttgtaacccctactacaaacattgctcaccaattttcccttgtcatctactgcaattgtgttttcaacgacacacattacattccgcggttgattcctc

SEQ ID NO: 14242 - DNA, 104 bp, Zea mays
  unsure at all n locations
  Clone ID: cC-zmpo148065h06d1
gaggggtgggttgccgnctcacccgcagtttttgttacangcagagccaganagngngccaggggggcaggacccnacngnncgacccaagaggcgccccgagc

SEQ ID NO: 14243 - DNA, 422 bp, Zea mays
  Clone ID: cC-zmpo148065h07a1
cgtggatccttaaagcggccaaccataataaaaatttttttatattttaccaccaaacacacaatcggggtgcgccaattttttaattaaagtaccataccaaacccatatttataacataaaaatgacaatctaaaaaatccaaattccttttattaaatacatgaaaagagcgaaggctcattattgtatatttacaaattgaaacaacccttaaagaaccgttgactactattcaaagccatcaaaggccccccccttctaattatcgcccatgtcgtcaacctcctcctcctcttttgaagaaaaagatacaccctcaactgcagcctgtagcaactaaatcaagtaattctattttgtcctcattgtcctctgaaaaacctctttcaactgactgttgcctattttcccataccaaa

SEQ ID NO: 14244 - DNA, 619 bp, Zea mays
  unsure at all n locations
  Clone ID: cC-zmpo148065h07d1
ggccggaaacggngaagcgtgtgtctttcattgggccaaatgtttattttgttgccagtgggtcagactgtgggcggatctttatttggagaaagggagatgggaagtttctacgagccatggagggtgatgagtgcattgtgaattgcattgagcctcatcctcatgctatggcaatcgcgagctgtggaattgataatgatgtaaaagtttggactccctctgcgattgagcgggcacctatgatacatgttgatgagctccagttgagacctcgcaagagaagagccaagctctggcgctttggcatacgagacctgttgatccaacagatactggtatcggaaaataggcaacagtcagctgaagaaggctcatcagaggaccatgaggacaacatagaattacttgatctagtgctacaggctgcagttgaaggtgtatcatcatcatcagacgaggaggaggaggacgacgaccactgcgataatgaggaggcggcggcctctgatggctctgaatagtagtcaaccgatctttcagggttgtttcaattgtaaatatacaataatagccatcactcttttcatgttttatataatagaactatgaattatta

SEQ ID NO: 14245 - DNA, 347 bp, Zea mays
  unsure at all n locations
  Clone ID: cC-zmpo148065h08a1
aagcggccgaccaaacaaaacatttttttttttacaaagcagcccaaacacanaaggggnnggttcaggtttacaaatcggaacgacaaccaaacctgctttggggtcaaatcacaaaattatttgccaaaaccataccaataaaattatataaacaaggggggaaaaaatgcccaacgaaggatgggtggtgatcaacggagcggccacacacaatcccagggcatggagactactaattaattaatgttggcgttggcgtcgttgattggatgcattcacaggccttgctctacaaggtattcaccgagcctactaaccaccatgttgcacttgtccaagggtca

SEQ ID NO: 14246 - DNA, 560 bp, Zea mays
  unsure at all n locations
  Clone ID: cC-zmpo148065h08d1
gcactgctcgttatcctcctcttgcattgcattgcatgtcgttttttagcagcagcaaccactgcacagggtggggtggcatacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaagctcggtgactacctcgtaaagcaaggcctgtgaatgcatccaaacaacgacaccaacgccaacattaattaattagtagtctccatgccctgngattgtgcgtggccgctccgttgaacaccaccca

SEQ ID NO: 14247 - DNA, 418 bp, Zea mays
  Clone ID: cC-zmpo148065h09d1
cgggcgcgcaacctgtgggtcacattgttcattctgactgtctttgttttcgcgacggcggcaccgaccggctgggcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaaccccttctttaaaagcgcacctccatctggtagcgaagacggcctacccattgaccccactccagaaggcagcatgaactaaattaaataccaattacgagaccgaccagatatgcatggagcatgcaagaatgttgtcgaacgaatatatgctatgaatggttacatgt

SEQ ID NO: 14248 - DNA, 370 bp, Zea mays
  Clone ID: cC-zmpo148065h10a1
tttatttttagcaaggaacaaaaaaacaagggaaccgaagcatttacagacacgaacgacgcaacgccccacgagggaggaaagcaagagcaccaaaaaaaaaaggcgaacaacacgaaaggggacaacaccaggcaacacattaaacagccccccctcacaagccataaactggctccttctttatactaatactcggcctccttatatttatcagcattctcatcctggtactgctggtattccgacacgaggtcattaattttgctctctgcctttggtgaacttcattttttccattcccttgcccgtgtatcaatgcaaaaaagcctttctactgaacatgtcagtgaactgtttcgttaccctt

SEQ ID NO: 14249 - DNA, 568 bp, Zea mays
  Clone ID: cC-zmpo148065h10d1
cgccacgcgtccgcccgatcccgctcgctcgccgccagttgttccgtagttcggatcgtctcatacctcggcggggaggagagagatcttgcacatccagggagggcaaccccggcaaccagatcggtgccaagttctgggaggtcgtgtgtgacgaacacggcattgacactacaggtcggtacactggcacttctgaccttcagttggagcgcgtcaatgtctactacaatgaggcctcctgtggccgctttgtgccccgtgctgttctcatggacctagagcctgggacaatggacagtgtccgcactggaccctatgggcagatcttccgccctgacaactttgtgtttgggcaatctggtgctggcaacaactgggcgaaggggcattatactgagggcgctgagctcattgactctgttctcgatgttgtgaggaaggaagccgagaactgtgactgcttgcaaggattccaagtatgccactcccttggtggcggtactggatctggtatgggtacgctgttgatctcaaagatcagggaggagtaccctgaccgcatgat

SEQ ID NO: 14250 - DNA, 238 bp, Zea mays
  Clone ID: cC-zmpo148065h11a1
ccccccaaaaaagggaaaaaaaaaaaaaacaccccccccctcaacaaaggaaaaaaaaataaaaaaaaaacccccacaaaacacaaaaacgagtctattttattaacgaactctacataaaaaaaaaaacaactccaactcaacaaaccaaccaaacatatgaaaaaaaacatacaaaaccactaacaaaaaccaaaaacaccctaaaaataaaaactacccccctccccaccaaaaa

SEQ ID NO: 14251 - DNA, 612 bp, Zea mays
  unsure at all n locations
  Clone ID: cC-zmpo148065h11d1
agcccttctggagacctacgccaagacggagaatttcnttagtggaaccatcgcctccggggacacggccaggagcattctggggatcacggacgccgcgctccagctgaggctcgccaccgacgccaacatcaacaaggcctacgcggagggggacaaggacaagatcgcaaaaatccttgctgcatacggccaggcggccgacgcggtcgctgcggccccgcctcccgagaagctcaaagtcatggagaagaccttctcggcggtcgccgccgccgctcatcaggaggcggcggcggctgctgctgctgctgcagtgattaaggtttaagggagagctcctgcatgaaattaaccacacgtccacacgtatacactacggaacaagtgtttccatcagacgaccatcagtgaaaaaaaaccatccttctctgtgtgtgtgccgtgtttttgacatttcttctttccattgctagagaaacgggttatctttttttttcccacatttataagcggcaatacatgcgtgcacctgtagtagtgtgaccatatgtactgtggctttcgtttgtatatcgatagtagcatataaagctactactcccgatttgt

SEQ ID NO: 14252 - DNA, 412 bp, Zea mays
  Clone ID: cC-zmpo148065h12a1
caaaaacctaacttttaattttctccgcgccacaagaaccaaggggacaggggcatattttcattccagcaaacaacatgtccccctaaaactcggaaaaagatcaatacaatgtgctgggataaacaacggcatgcagctaattcccagcagaatcctttgtggcggagcgccttcttagcttggcgcgcgttacacggatcgtttcctccatcagcgtttcctcgagcgcagggtcaagctcttccgcgccctctgcagcatcaccactgacctcatctattgccatgttgtctacttcttccgtctcagaaaggggtggggcactaggctcggatttaggtgaatcctcacttgtggctggagtttgaactgggtccacagcaaggttgacctcacctttctttgggct

SEQ ID NO: 14253 - DNA, 531 bp, Zea mays
  unsure at all n locations
  Clone ID: cC-zmpo148065h12d1
ccgcgcacgcgtncgcccgttccatcttcacccaagatcaagcttaatttatagggagacctggttcggtggcagccacgaagcctgtagcagctgcatccacaccaaaacccggcggtagcccaaagaaaggtgaggtcaaacctgctgtcgacccagttcaaactccagccacaagtgcagattcaccaaaatccgagcctagtgccccaccactttctgagaccgaagaagtagacaacatggcaatcgatgaggtcagtggtgatgctgcagagggcgcggaagagcttgaccctgcgctcgaggagacgctgatggaggagacgatccgtgtgacgcgcgccaagctaaggaggcgcaccgccaccgaggattctgctgggaattagctgcatgccgttgttttccctgcacattgtattgatctttttccgagttttaggctcacatgttgtttgctggaatggagatatgttgttgttcactcggttcttgtgacacaaaattaattaaaaaaaaaaataaaag

SEQ ID NO: 14254 - DNA, 443 bp, Zea mays
  Clone ID: cC-zmpo148066a01a1
aataaattctgaatcatgcatatatatatagagggctcgtgttacttaatggtagtaggaattacccaaaaggatgagtggatcgatgtatgaaaacgaagacctgcaacaaagagataatgtagtagaaggagaagattcaatgggccgggtcgagagatcatgcatgggctgacgtgaacgacggagctagcaaacgattgtatatgatgatatcgagctgagcccgcgcgccgataaagcccgggtcgatcaagccggcgcgccggcggcggcgcccttgtcggtgctgccgcacgcctggttgcacatcttggtgcaagcggggtcgtccttcttgccgttggcgcaccgctcgtagcagtcgtcgtaacagccgtacgcggtggcccggggcaacaaccccgttgccacaccaggaggaccaccagggccagcgccac

SEQ ID NO: 14255 - DNA, 546 bp, Zea mays
  unsure at all n locations
  Clone ID: cC-zmpo148066a01d1
tagccagcttagagcaagaacaaaaaacaccatcatctcattcgcttttctcaacgccaccctagccctgtgattggattggcggcccanagcacgaggacggtggcgctggccctggtggtcctcctggtggtggcgacggcgttggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggctttatcggcgcgcgggctcagctcgatatcatcatatacaatcgtttgctagctccgtcgttcacgtcagcccatgcatgatctctcgacccggcccattgaatcttctccttctactacattatctctttgttgcaggtcttcgttctcatacatcgatccactcatccttttttgtaatttctactaccattaagtgagatgacctctctatatatatatgcatgattcagtttttttt

SEQ ID NO: 14256 - DNA, 373 bp, Zea mays
  Clone ID: cC-zmpo148066a02a1
gcggccgccctttttttttttttttttttcatcctttttaatcttaaataagcagtgtatttcaattgatttaataaaatcaaccaacacaacaccccacaggaagagatggtgttgtgccacaaaataaccataaaaaaaatttaaatattgtctcgttggcacgtggactagatgagctctttcgaaatattattcgtcatcacttatcagaggctgattatatgctgagagtggtcttgtaggtggtgccagccttgaaatcggtggggatgacatcatcggcgatacggtagccgccagacttggtagcaaagcggatgcaaaggggttacttgagcggggccttgttgtccagcgttcaattgccatc

SEQ ID NO: 14257 - DNA, 486 bp, Zea mays
  unsure at all n locations
  Clone ID: cC-zmpo148066a02d1
caccaccccactcagcttccaggncggcaagggctccaattttggtttcctggntctcacccctaacattagcaccgtgtctgacgtggagatcaaggagcctggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttcaaggctggcaccacctacaagaccactctcagcatctaatcagcctctgataagtgatgacgaataatatttcgaaagagctcatctagtccacgtgccaacgagccaatatttaaattttttctatggttattttgtggcacaacaccatctcttcctgtgccttgttgtgttggttgattttattacatgaattgaaatacactgcttatttaagattcttttgggtg

SEQ ID NO: 14258 - DNA, 506 bp, Zea mays
  Clone ID: cC-zmpo148066a03a1
agcccgtgattttatattatcacaaatgttatgctacgggtggagtgtccctatgacagtgacaaatcatttgccagccacccttaatagtaacaatatgtttaacatcatgtttttagtgaaccataagtgccaaaattccactgcaaatttttttatgcagaggaaatcatggacgttggttggttgcctgcctcagcgccggcggcagcaagggagtaggaggcgaattactgccctgccacgaccatacaatgtcacctaacgatggcttcagttcctgcctgtagaactctcggaactcgggcgagtcaccgccaatctttctcatctccaccacgcgcaccgatggcgccacctagaagatctctgcctcgatgacaagcgtgcctcttcgacagtactgaccgccctacatctcgaccctgccccttttgtttagcttgatgtcgagattccgcgtcttaacgatctccttcaacttggacatgatcgcccccgtggat

SEQ ID NO: 14259 - DNA, 469 bp, Zea mays
  unsure at all n locations
  Clone ID: cC-zmpo148066a03d1
accaccgacaaggccctcgacttgggggagacctccgattttgcttgcaaggaaaaagcctgcaggggcggccgggaccagcgcgacgacgccgacgcccacgccgacgccgacgacgaggagaacaccaggaagaggaagcggncgaaggggacggngncttcaccaccgaccgttgccgtgaggccttcgagcatgaacgcctttgacatcatctcccgatcgagcgggctggacctgtccaagatgtttgacgaggagcacaggtcagaggcacggttctcttccagagaatccacggcggcgaacatgtccaagctggaggagatcgctgagacgcggaatctcgacatcaagctaaacaagaggggcagggtcgagatggagggcggtcagtactgtcggagaggcacgcttgtcatcgaggcagagatcttcgaggtggcgccatccgtgcgcgtggtggaga

SEQ ID NO: 14260 - DNA, 440 bp, Zea mays
  Clone ID: cC-zmpo148066a04a1
ggggattaatttttaaatgggtccgcacggaaacagaggaggggttaccctaacaaacatctctaagaccgctaaccttgtcttgaaaatgaaggttcacccagtgacaacaaaatgaaatgaggaagcccaagctcgggcattacttgctcccttcctcaagtctgttgccttattgctcaacctaagcttgctccaaagcctgcttacatcaagaacattcaaggctcgttccaggagctggtttgatcccctaccgatccctaagtttaagtttctggacccgaacaactaagaaagctcttataagagacatgacaacaggtatgaagtgcgctacaacctttacgataataaaaagaaccgcaactaacaaatacatctcatttttggccatttcaccaatagaaccaatccatggcataactgaactcaagctt

SEQ ID NO: 14261 - DNA, 335 bp, Zea mays
  Clone ID: cC-zmpo148066a05a1
ctccttaatacgtttttttattccttcatatatttctgcaacagggtttcatgtacagtctccgatagacccccctgctcccccccaatccctttactcgttgcattggcaaaaacagcatcagcatctgcagcaaagagccaacctatacatatatacagctatacataaagaatgggtgtcgaatccggttgagtctctagctaagacctcatacacggacataccttttccttgatttcctgcggaatggaaagttcgtggctatcttgaaactgccatcgtccatgtaaatgatgttttggctgctgcaagctggacctttaacagccatc

SEQ ID NO: 14262 - DNA, 415 bp, Zea mays
  unsure at all n locations
  Clone ID: cC-zmpo148066a07a1
nnctnnnnannttataaaataaaaaaaaaaaaacacaacccgaaagaaaggaagaaaacaaanacccgaagacaccccacccacaaaaaatgaaacaaaacaaaaacacacacaacaacaaaaaaaaacacaaaaaaaaaacaaaccaaaaaacaacaaaccccaaaaaaaaaaaaacaagaaaccaacacacccaaaccccaccgaaccaccacatcacataacaaaaacaaaaacacaaaaagaatacaaccaaccaaacacaaaaacaacaccaaaaaaaacaaaaaaaaaaaaacacaaaaaaaaaaaccaaacaaaaataaacaaacaaaaagaaaaaacccaaaacacaaccaaaacaaaaaacaaaacaaaaccaaaacataaaaagaaaaaacggccaaaacaaaaa

SEQ ID NO: 14263 - DNA, 251 bp, Zea mays
  unsure at all n locations
  Clone ID: cC-zmpo148066a08a1
nnnnnnnnnnnattatattttattaaaaaagaaagcacgccngcaagaaagttttaattaaananacgaaaaaacccacaccccgggacanaaaagaaaaaaaaacaacaaaggcacaaacaaaaaaaaaaaaaacccaaaaaaaaacaccgaaaaaaaaaaatacaatataatgatctgtacatataaaatttttattacaacccaaaaacatacgataacaaccaaaaaattaaattcctcataacttt

SEQ ID NO: 14264 - DNA, 591 bp, Zea mays
  unsure at all n locations
  Clone ID: cC-zmpo148066a09a1
nnnnnnnnnnnttatttatataaaaaaaaaaaacccnacccaaagaaaagaggtaattaaaaaaacgaaaaacccccacccaagggaaaaaaaaaaaggaaaaacacaaaaacacaacccccaaaaaaaaaaaaaaaaacacaaaaaaacagaaaaaaaagaaaacaccaaaaagaaccgaacaaaaaaaaacaaaatcgaaagcaaaaaaaaaacgaaaaaaaaccaaaaaaaagaaaaacaacgccagaacagaacaccaaccaaaccaaggcccaaaaaacaaacaaacaaaaaaaggcaaggccaaaaaagcgcaacaaaaaaaccacaacaaaaaagacaaaaaacaaaaacaaacccaaacaaaaaatacaaaaaagagccccaaaagaaaaaaagaaacaacaacaaaaccaccccaagagaaaaaacaaaacaaaacaaaccaaacaaaaaaccccaaaagaaaaaaaacaaaccaaggccccaaaaaaaaaaacaaacaaaagaagaagaacacaaaacccaaaaacaacaggaaaacaaaaacccacccaaaaaaaaaaaaaaaaaccgcaaaaaaggaaa

SEQ ID NO: 14265 - DNA, 357 bp, Zea mays
  unsure at all n locations
  Clone ID: cC-zmpo148066a12a1
nnnntnnnnnntttttttaattttaagacaaanngccanaaaaccagaacggtttttattaaaaacaacaccaccccccacccaanggactttaaaataaaaaacacatttactttctaataaaatattgctcaaaaaaattaataaaaaaacattctttccattaaccaaaactccaaaaccatcttcatttaatacacatttgcttaacaactcgtaattaacaaatattcttaaaaatataaactatacctcttcaaaaattacataaaacctatcttaaggataaacccaaaaacttattagtaaaataaactcttcgaattttacattaacatcactaactctataaaattt

SEQ ID NO: 14266 - DNA, 405 bp, Zea mays
  Clone ID: cC-zmpo148066b01a1
gaatgttaattcatagctttcattagctcgtctatatggataggtaacctaaacatctcatcagtaaagacattccacattcgcgtctctcgcttttgcttcgtactcaaatagatatatcgtgtggcatgcatcactacttgggcggtggctggatccacgtgtctcccaagacgtagtgtgtgccaacaaatgtcttggcctgctcctcggtgaggtccagcccccaccccaccctcttcttcttcttgccgtcagcaccggggccaaagcacttgaactcgccatagcagatgccgctgctctccggcttggcgatctgccacccgtcccaccccacggggaccacctcctcccccatctttgtgtaccagtagacgacccgggaggagtccccccaagcgc

SEQ ID NO: 14267 - DNA, 485 bp, Zea mays
  unsure at all n locations
  Clone ID: cC-zmpo148066b01d1
caccatggcgcancgagcggnggccacgatttcgatttataagcccctcctcctcctcggcgtggggtgcgcgctccttggtgcggcgcccgccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggca

SEQ ID NO: 14268 - DNA, 432 bp, Zea mays
  Clone ID: cC-zmpo148066b02a1
aatgctaaagtgtgcacaagatgctaatcttccaaagactggcctccaacaagagaaattggagttctcaacatccaaacctacaaataaaacttactttcctatatcaaaaacccaaccaaaggtgtgttacttcaacaacttttgccatgccgggaataaaaaaaggtttagccagagtatacatagaagccgttggatgtatatacaatacttggccgatccaagaagaacgccttaaaattcccttcccacagcaggtaatctaataatatccttttgctcctctggattgatacagctccaatctgatctttgcttctagcaacaagttgtctattactgggtcttgcaccatgtaagcttgcttggaagcccatttcagcaccgtgaggattttctcctgtaccaacttcttgttgtacggaacat

SEQ ID NO: 14269 - DNA, 506 bp, Zea mays
  unsure at all n locations
  Clone ID: cC-zmpo148066b02d1
ccacgcgnncgnccgcgcggncgaacgctggngncgcggcttcgaatgtatcacaacgcgncactgncaggagcgagggcaaggggcaaggagttcgaggaccctgagacgaaagcatacatgaaagctaacgcagccaaggcgctgtggcagcttgccaagggaaacgccgctatctgtaagaacatcacggagtcaagggctctgctctgcttcgccgttctcctcgagaaaggtgaaggtgacgtgcagtataattccgcaatggctctcatggagatctgctgcgtggccgagcagaattccgacctccgacgatcggcgttcaaaccaacttctccggctgcccgggctgttgttgaccagttcctacgtgtcgttgagaaggccgagtacgacgatctcctgaatccctgcattatctcgctgggttgcttgtccaaaaccttccgtgctacaaagacccggatcatcgggccactggtgaagcttcttgatgagaggga

SEQ ID NO: 14270 - DNA, 406 bp, Zea mays
  unsure at all n locations
  Clone ID: cC-zmpo148066b03a1
tttnttttttttttttgtttattataaacataagggcattcaaataatggcctggttttattatcgttacatagtcaagaccaaacatagtcaagaagaaacggattgcaagaatgcattggaaagaagggatccctcttttacaataaaagggatcgtattttgagtggcaccggttacccaaacccgcgttatcgggcaggctcaagctgacccattgtcgtcggaatcagaatcgtctccggacgatggtgctggggcgctggaagtgccatcaaaagatgggcctggtgcggcggaggactcaaaccaccacgatggcgctggtgcgctagagggaccggatgaggcctccgccgcctgatcatcaacagccgacgcccttgcaccagcaccggacgccggc

SEQ ID NO: 14271 - DNA, 409 bp, Zea mays
  unsure at all n locations
  Clone ID: cC-zmpo148066b03d1
ccaagagagaaaccagcaccacgacgctttttttcgncaggcncgncccgccccggcgcgggccccctctcctccttccctcctcagctccgccgcggccagtgcgcggacccggggcgacaccgtgcatgacgcgtgcagcaagacccagttccccaagatctgcgtggacagcctcgccgccaagccggagagccataaagcgaccccgcgcaagctggcggagctgttcgtgaacatcgcggccgagaaaggatccgggatggccaccttcgtgcaccgcaagtacagcgacaaggaggacagcgacatattcaagtgctacgacagctgctccgacgacgtggaggaggccgtcccccacctcaacggtctcgtccgggagcccaccgacgccaagttcctcgag

SEQ ID NO: 14272 - DNA, 174 bp, Zea mays
  Clone ID: cC-zmpo148066b04a1
tttttttttataaataatattttttaaaacaaaacaacattcaataaaggataggttttaaaataaaaaaccaagaaacacccacacctataaaatacattaaaacactcaaataaaataaacaataaattatatacaaaaaaccataaaaaaacatacttttttaactttaat

SEQ ID NO: 14273 - DNA, 579 bp, Zea mays
  Clone ID: cC-zmpo148066b05a1
atatattttttcaaaaaaaataaaattaaaacaaggccaacaaacaccaaaaaaaaggttaaaaactaaaaaaccaaaaaacaccccccaataaaaataataaaaaatacataaaaacaacacaaaaaacaaaaaccacaaaaaaacaaaaaaaaaaaaacctaaaaaaaaaaaaaaataaaccaaaaaaaaaaaaacaaaacgatacaaaaataaataaaaaaacccacaaaaaatataaacactaaaaaaaactaaaaaacatcaacaaaaacaaaaaagaaaaaaaacaaaaaaaaaaaaaatacaaaataaataaacaaaaacaaaaaggtaaacaaaaacaaaacaaaaaaacaaactaaacaccaaaaataaaactaaaacaatgacatccataaaaaaaaacaaaaaaacacattaaaaaaaaaaaacacaccccaacaaaacaaaaaaaaaaaaccaaaaacttaaatacaataaaaaaataaacaaaaaaaaaaatcacacacaataaaacacaaaacaaataaaataaaaacctcaaaaaaccacaaaaaaaaacaaaaaaataacaaa

SEQ ID NO: 14274 - DNA, 271 bp, Zea mays
  Clone ID: cC-zmpo148066b06a1
aaataataatatatttaaaaagcaaaaaaaaaatcaaaaaaaagttttaaaataaatataaaaaaaaatccccaaaattaaaataaaaaaaaattataaatattattattaaaaaatataaataataaaataatattataaaaataaaataaataaaatataataaataaaaaaaaaaaaaacatattatatatttaaataaaaaaaaaaaaaaaaacaaaatttatattataaaaataattaaacaatcctaattacatatattataata

SEQ ID NO: 14275 - DNA, 322 bp, Zea mays
  unsure at all n locations
  Clone ID: cC-zmpo148066b08a1
acccccaacacggcaagaacagcnccaacaaagcccacaggcagccgncaagaccgacacagaaaaccccaacaaccncccggaggcgaaccacaaccaaaagagcagaaccaaacagnccggactccggggcatatatatacgtctgctcgtccaaaatcggattaaagctgtacgttaatcacttccacttgcgaccgaacatattcttgtgcttgccaaacatcttcttgtgcttgccaaacttgccgtgcttgaacttgccatgctttaacttgccgcgaccgtggccgtggacgtacatcccgtgggaatgggacac

SEQ ID NO: 14276 - DNA, 252 bp, Zea mays
  Clone ID: cC-zmpo148066b10a1
tatgttattagttggcacccccccaagaagaaacattgtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcaaaatcgtctccggacgatggtgctggggcgctggaggtgccatcagaagatgggcctggtgcggcggaagac

SEQ ID NO: 14277 - DNA, 345 bp, Zea mays
  Clone ID: cC-zmpo148066b11a1
aacgctacatgacccaaaccgacacactgaaaaaaaggctacaaattttcatgcccgcatgctcctgctcttcctatgtacattggcaccaatgggctcaagcagcaacaatcatccatccttatattgcattattgctcaattctcccaatgatgccaactgccgctgacgctaccggaggactgcaccgatggccaaaacaggctgttgagccactgcaaggatggccgcaaccggctgccgttctcttcggcttcggctggctccgcattgcctggaatacttgccctaccattaccgccggcgttagtattgccttcaccatccgcatcgacactgacaaa

SEQ ID NO: 14278 - DNA, 505 bp, Zea mays
  Clone ID: cC-zmpo148066c01a1
gttgtaaaacatttccctcaaagtagaatagatttaaattttctggattatactggccattcatattctccataatatcatggaacctgtttgaatatacaggaaaaaaacacgaaaaatgatccgccacttggcgaagtgagcctccttgctgattcgctgattcttatctaaaggtcctcagggccactgatatccttattcccaatcactgctccgtctgggatttctagcttgacgccaggttttgcagtgatggtcactttccccttcaatacaattccagaaccgaaccaaacatcaccggaaaccttcaagctgtcaagctcaacaatgctaggtatcgacttgaagcgaccaaggaagctcccaaccttcttgaactcaagactaagttcaattgagggatttgatggaattgttctggctgaattacgtgtaaccaaaccatcaaccaaggtatatagatcagactgtactacctgcaatttgatgtcgctttaac

SEQ ID NO: 14279 - DNA, 538 bp, Zea mays
  unsure at all n locations
  Clone ID: cC-zmpo148066c01d1
ccacgcgtccgcccacgcgtccgcccagatccgnctcccgttttctttcgcgcatcttccagcaatggcggaggaagagcttgtcaagctgcgcgaagccaccgccggcctcacgcagatcagcgagaacgagaagtccggcttcctcagcctcgtcggccgatacctcagtggcgacgaggagcacatcgagtgggccaagatccacacgcccaccgacgaggtggtggtgccgtacgacaccctggagtccccgccagaaggcactgaggcgaccaagaagctgctcgacaagctcgccgtgctcaagctcaacggcggcctggggaccaccatgggatgcaccggacccaaatcggtcatcgaagtgcgcaacggatttactttcctcgacctgattgtcatccagatcgagtcactcaacaagaagtacggcagcaatgtgccgctgcttctgatgaactccttcaacacccatgacgacacctttgaaattgttgagaaatacaccgaattcgagcattgaaatccacacatt

SEQ ID NO: 14280 - DNA, 351 bp, Zea mays
  Clone ID: cC-zmpo148066c02a1
attctcaataacccggtagcaatgcagaggtattaacaacttttacaacatcagcccttccaaaccacacaatacttcagaacagacacacattacacgatagcacgagcaactcacggcatatcactggataagggcagcacactggcctgatgctgcgtcatcagcaaacttctctagtactcgtcaccctcttcgccatcctcgccctcatcgaactcagcgccgacctcctcgtagtccttctcgagcgccgccaggtcctcacgggcctcaaagaactcaccttcctccataccctcaccgacgtaccagtgcacgaaagcacgcttggcgtacatgatgtccaac

SEQ ID NO: 14281 - DNA, 302 bp, Zea mays
  Clone ID: cC-zmpo148066c03a1
ataaaaaacgaacaaaaaaagaaggcaaagtgttaatataaaaaaacagaaaagcccctccccctaaattaacacataatataaaaaaaaaaaaaaaaaaatatcaactaaaaaaaaacaacataaacaacacaaaaaaataacctataaaaaaaacaaacctacaaataataataaaaattaactaaataaaaaatttaaaataaccatcaaaaaataaataactatttcaataatacaacacacatacattaaaaaaaatataacatattataatataaaaaaaaaatactaaaaataat

SEQ ID NO: 14282 - DNA, 306 bp, Zea mays
  Clone ID: cC-zmpo148066c10a1
cccccccccggggccggcccttgggcccccccgggaaaaaacaaacccgaaacaaaagagaaaaaaaataccacaaaaaagaacagcaaaaaaaccgggccaaaaaaaagaaaaaaccactacccagaaaaaaatgcaaaccctccaaaaacccaaaaaaaaaacgaaccggaaaaaaaaagacaaaaaccaggggacccaaaaaaggcaaccaaccaaacaaaatggcggtgcaaaaaaaccccccccaaaaaaaaaaaaaacaccggccccccaccaaaaaaaaaaaaaccccaaccccccgag

SEQ ID NO: 14283 - DNA, 399 bp, Zea mays
  Clone ID: cC-zmpo148066d01a1
aaatctgtatgcgcgcgatatcgcagttagctttgtgtacatatatagatctttacacacccacaaccaataccagacatcatcgtgatggttaattacaaggaaaaattgctactgtctgcaagcaataacatcaagattgatgaatgacaccgcccagctgcgcgaatcaatcaaacgatgcggacataggtgggcaagatgggcccggtggccaccagcccgtccccggcggccttctgctccgtgaggaagaggtcgtctgtggtcctgagcgcggtgtgcgcgccgaccagcgcgcccccgaccatgacggatcccacgacgttccagccgacgctggtgaagagcaaggcgactacggtgaccccgcaaagcgcggcgagcacggtcccgtcg

SEQ ID NO: 14284 - DNA, 464 bp, Zea mays
  unsure at all n locations
  Clone ID: cC-zmpo148066d02a1
tttttttntcnnnttttttatttatttttccaccncaaatttatttttggtttagtaaaaatttccaaaaaacaatcttacacacccccattatttctaacaggaacaacaaccactaaaaagactccttcttttaaaaatgcccttcatgcaataaaaaactttttaaacccaacccgttgtttcaacctgtaccaactcacattaaacaatcaatttaacatattttacattccaaccctttccaacaacccaatctcacaaaattcaaaaaaaacatttgggtaatgcttaacaattattaacattaaaaacccccccgcaaaaacaggttttaaatttttttcacggtctttcaggccccaaaaaaccacacgggaaaatcacctcactaaattttttatgccatgttccttaccaacaatggggtttttttcttctttgaacaaagaaaaaggaccgct

SEQ ID NO: 14285 - DNA, 351 bp, Zea mays
  Clone ID: cC-zmpo148066d02d1
ttcaagaccgacagcccacctttcacgactgcagccgcttgacctgcagcacgaggatcatccatcccaccatgtaaatgtcgaaggtccactgttacatatcgccttctcgccggcgaagttataggcagccggaataaggagagctggctgttggatcgaagcctacaggattccaacgttcggatcggcgccccgtccagattgcaggcatttctttgccgtccctcttctttgttcaaacgagaacacacacccattgctggtacagaacatgacataaaagattcagtgacgtgatttgaccgtgtggctttgtggtgcctgcaaggccgtgtagcgaatctcaaa

SEQ ID NO: 14286 - DNA, 484 bp, Zea mays
  unsure at all n locations
  Clone ID: cC-zmpo148066d03a1
atttntttcttaaatttttaattttaaaaccaaccaacaaaaaacgaaagcggagagttaatttnaaaaanacaacacaaccacccccccccaaaaagaaaatacaaaaaaatgaaccatcaacacaaaacgcccaaaacacaaaaaaaatcatcaaaagcaaaacaaaaacaaaaacaaaaaaaaaacaacaaacaaaaatcataaacaaagaaaataaaccaatacacccacccaaaacgaaaaacataaacaaacaaaacaaaaacaacccacaaaaacaacactgcccaaaacccaaaaaaaaccgcaaacaaacaaaatattcaaaaacaaccaaccgtaccacacaataacaaaaaagaaagaaaaaccattaaaagaaaacacaaaacaaaacaaaacaaacacgaaccccgacaaaaaacaaactaacaaaaaaaatacaaaacaaaacacaatggaacaaccaaatatcaaaacc

SEQ ID NO: 14287 - DNA, 606 bp, Zea mays
  unsure at all n locations
  Clone ID: cC-zmpo148066d06a1
taaaaaaaaaaagggaggaggacccaccanaaaaanaanaaaaaaaacaaacaaaaaaaaaaaaaaaaaaaaaaacagaaaaaaaaaaaacagaaaacacaaaaagaaaaaaaaaaaaaaacaaacaaaaaaaaagaagaaaaaaaaaaaaaaagaaaaaaaaaaaacaaaaaaaacaaaagaaaaaaaaaaaagaaaaaaagaaaaaaaaaaaaaaaaaaaaaaaaaaaaaagaaaaaaaaaaaaaagacaaaaaaaaaaaaaaaacaaaagaaaagacaaagaaagaaacaaaaagaacaaaaaaaaaaaaaaaacaaaaaaaaaaaaaaaaaaaaaaaaaaaaaaaaaaaaaaaaaaaagaaaaaaaaagaaacaaaaaaaaaaaaaaaacaagaaaaaaagaacaaaaaaacaaaaagaaaaaacgaaagaaagaaaaaaaaaaaaaccaaaaaaagaaganagagaccaacaaaaaaaaaaaaacaacaacgacaaaaaaaaaaaaaaaaaaaaaaaaaccaacaagaaaaaaaaaacaaaaaaacacaaaaaaaaaaaaaacgaaaacaaacaaaaaacaaaaaaangcaaaaacgaaaa

SEQ ID NO: 14288 - DNA, 355 bp, Zea mays
  unsure at all n locations
  Clone ID: cC-zmpo148066d07a1
nnnnnnnnnnnttataaattttaaaaaacaaaaacaaccacgaagacaagtttaaaaaaaaaacaccaacaaccccaacccacaaaaccaaaaatcaaacacaataaaaacacccacaaaaaataaactccacacaaatacaaacaccaatcaacaccaacaaaaaacaaacccaaaaaaaaacgcacaaaaacttaaaaccccgccaccacaacaaatacacacctaaacaccaccaacaaaaaaaaagatttaaacaaaacacaaaaaaaaaaaaaaaccccaccacaaatcaaaaccaaaacaacaaaataaacaaacccaatcaaaaaaaaaacctgaacccaaacacaaa

SEQ ID NO: 14289 - DNA, 440 bp, Zea mays
  unsure at all n locations
  Clone ID: cC-zmpo148066d10a1
cagcacacnagcaaccagcgcgggaagggtcattctgacngctgacataaaacaaacccccaatcaacttgagttgaccaccatgatacacaaaatccattacataaaatgcacacacaacaacatatactcctgtataaatggatcaaccacgaactcgccaaaaaaatcggcataggtggttagtgatcattctgcttaaataactaataactagtgccagcttctgtgacgaacaattacaacaagttgaaggagcgttgcaacttttgggtcaagaacaggcatggaactacacaagaacctgcgacttggccgcacgacgtgagcatttggtgcgagcattcttattcaagctggaagcccaacctttcaacagctcgaagtctttatctcatactaatatggatgccatctcccgacagtccaataacatctta

SEQ ID NO: 14290 - DNA, 406 bp, Zea mays
  Clone ID: cC-zmpo148066e01a1
gatattgtctcgaagcaagattttgtaggttcgacatgatatctaatgtcttgctgatgaatcacagctgcttgaaagaatattttagatgacaattacattggtgtcagcgaaagctggacctcaccagggactgataatactaaggtctctagccataaattaaggctagctcgaacggggaagaattgatgtaagcgcctagttctaattcaaaaacagtgccatagctatttgtcagaactctataaaaagatcgtcgcaacaatggaccttagaatgtacaagccatatcattttggcatcgttaatctttcaacctgtatgtgccatcaaggtcaaagggctgagtaaagctgcctacattcctgggcaaggaccttgctgaagacaaggcatactcctc

SEQ ID NO: 14291 - DNA, 479 bp, Zea mays
  unsure at all n locations
  Clone ID: cC-zmpo148066e01d1
ggcaaccaaggatgtctgacatgaagatatcttattttttgagctngcgtcgctgggatggggcatgggtttgccagagctgtcaggaaaagacagaaccaatggagggaaagcgtcgttcacgagattcatcaagaaacagtgggtaagtgaatagttgacatgtgtagagtgatcaggtaactactgaccagcaacaccccagcaccaccattttgcagcatttcttctgttggcacttccttgatcacattcacatgtaatatctgggagttctgatctagaactagattgaagtattgaattgctactgtggaggtggctgctgcttatagctctcatcccaagtgaggagtatgccttgtcctcagcaaggtccttgcccaggaatgtaagcagctttactcagccctttgaccttgatggcacatacaggttgaaagattaacgatgcccaaatgatatggcttgtacattct

SEQ ID NO: 14292 - DNA, 420 bp, Zea mays
  Clone ID: cC-zmpo148066e05a1
aaaaaaaaaaagaaaggtaaaaaaaaaaaaacaagaaaacccccaaaacaacaaaaaaaaaaaaaaaaacacaaaaaaaaaaaacaaacaaaaaacaaacaaaccacaaaaaaaaacaaaaaaaaaaaaacaaaagaaaaacaaaaagaaccaaaaaaaaaaacaaacaaaaacaaaaaaaaaaaaaaaaaaaaaaaaaaacaaaaacaaaaacaacaaaaaacaaaacaaaacaaaaaaaccaacaacaaaaaaaacaaaaaaacaaaaacaaaaaaaaacaaaaaaaaaaaaaaaacaaacaaaacacaccaacacacaaaaaccacacaacacaaaacaacaaacaaacaccaaaaacacaaaaaaaacaaacaaaaaaaaaacaaaaaaacacaaaaaaaacaacaaacacaacac

SEQ ID NO: 14293 - DNA, 354 bp, Zea mays
  unsure at all n locations
  Clone ID: cC-zmpo148066e11a1
nnnnnnnnnttttttttttaaaaaaacacaaaaaaaaanggcgcnacgattncctttgcacaaccaccaggcccccccacgcannnnccgaactacagcacaccgcaccaaccacaggccccncaggccacacaacgccgaacccaacccacacggancaaacangacccaagggggcngcggcacccccttaccaggtcggcgaccnctgcagaaagagcatcacctacaactcaacaggcaaacaatccccattcacctgcctgctttccttagtcccttccttcctcatcgacgaccaaggacatcgctccttctacttgcacaccgcacgagcagaaacaaagcaattca

SEQ ID NO: 14294 - DNA, 81 bp, Zea mays
  Clone ID: cC-zmpo148066e12a1
aaaaaaaaaaacaaagacaaaaaaaaacaaaccaaaaaacgaaacaaaaaaaaaaaacccacaaaaaaaagaaggcacaaa

SEQ ID NO: 14295 - DNA, 307 bp, Zea mays
  unsure at all n locations
  Clone ID: cC-zmpo148066f01a1
nntatatattttttctataatatacaaacggaaaaccaaaccatagatcagattgcattattacaaaacgacttgacccaaccccataaattaaattacctctatgtaattaacacaacccctcaccattcatttatattcatatcagatcacatcaataataatttatggaaacagcggtgcaggtgactttttacaaattgaccacctcatcaacagtcaccaaaaactagctatgcaactgcaatggcaactgtggacttatccattttcttccataccctcttacttaaccacgcccaccctt

SEQ ID NO: 14296 - DNA, 389 bp, Zea mays
  Clone ID: cC-zmpo148066f02a1
atgttataaagcaacacaagcaaggaaaaggggcgggtttaaattaaaggaaaactaaacacaccctaccaccattttttgacgacccatgccaccatctaataaaacaaattacaagagataataaaacaatgacctcctccaaaaaaaatgttacaaaaattctcctacataaatcattaatttcttcgaaatgaaaagcaaaaacttgaccagatccttactggtctggacccagagcgaactgctcttgatcatcatcatttttctccatttaaacacctactgacccgtacttcttttctaaaaaaaggaactggaaccggttctaaccataaagcacaccaactccatcaattgtacgaataaatttaacaccatacaccctt

SEQ ID NO: 14297 - DNA, 474 bp, Zea mays
  unsure at all n locations
  Clone ID: cC-zmpo148066f03a1
caattaactntnatnnaaccaccactatatggcatggcatcacatccatgatccagcagactcccacaataacagtcgatcattacagtagcatcacacacgacacctgaaccttacaagtcacaacacggaggatcgagcagttcagtccatacgcgcatcgtcattacgtcttcactgactgactccgactccgagtacatacaactagtgcagttccagattatttatgcaataacagtttcgaattttaggatcttttgtaataaggttataaacttataatggagggtagatggatcttgctgtctctagtctcaaatggcgaggacgaagcccggcagcgacttgtgcgcgctgtcggcgcggctgctcttccacaagcacttggacccttcagctgcagacgacgacacaatccgagggggtttgatgatgaattacgtttaaaaatatgccaccctctcttttctt

SEQ ID NO: 14298 - DNA, 443 bp, Zea mays
  Clone ID: cC-zmpo148066f03d1
tcaaaaccacagcctttatttttcgggggagaggacggcagagccggcgcgggtggagctggcggaggcggcgctcccccccgagacggcggagcaacgcaaccgcaccccggagccgccgatgtacgaggcgctcggctcctgcgacgcgcgccgggcgcggaagctgctggcgcccgacctcgagtggtggttccacggaccccccacgcgccagcacatgatgcgcctcctcaccggcgcggaccaccagcgccacatgagcggcggcggcggcggcgggttcgccttctccccgcgctccgtcgacgccttcgggtccaccgtcgttcccgaaggcggcgctgacgacgcgcgccaactctactgggtgcacgcctggaccgtggggcccgacggggtcattacccagctcatgaagtacttcaacaccgacctcaccg

SEQ ID NO: 14299 - DNA, 83 bp, Zea mays
  Clone ID: cC-zmpo148066f04a1
atttttttttattaaatattaaaaaaaaaaagctataccgaaagaaaggtttaaattaaaactcccaaacaaaccccccctct

SEQ ID NO: 14300 - DNA, 241 bp, Zea mays
  unsure at all n locations
  Clone ID: cC-zmpo148066f06a1
natatnnnttcatataaaatattaaaaaacaaaacctaccaattaagaaaagtttaaataaaaataaaaaaacaaacccacccccctcaataaaataaaacaaaaaaccaaaataaccaacaaataaaaaaacaccaaaaacaataaaaacaatactacaaaataaataaaaaaaaaacacaccaaaaaaaaaacacaataataacacaaaaataacgaaaaaaaccaaaaaaataaaatc

SEQ ID NO: 14301 - DNA, 279 bp, Zea mays
  unsure at all n locations
  Clone ID: cC-zmpo148066f08a1
nnnnnnttttttttttttaaacaaaacaaaaancncaaacagacagattgagtaaacggacggcatgatccccaaacagctnaatgtacctacgtacccattattcgcacagtacgtagtaacatcctttattatcattacacattgtgaggagtaaactgacggccaatttgtaattttaagaaaagatcctcctctctgaatatacaccaaatgacccaaactacgcgttatcattcactctcaaactgatccctcatcccacggacaattagcgcc

SEQ ID NO: 14302 - DNA, 259 bp, Zea mays
  unsure at all n locations
  Clone ID: cC-zmpo148066f11a1
agagcggccgcccnnnnnnnnntttttntaattaaaaacgagaaagaaaacaaacgcaaggaatgcctanaaacaaccacagggccacccccggganaaggcaaaaaacaacacacagaagcagccacaggccacaaacaacgacaaaaaggggaacacaaaaaacacgaacaaacgagaccaaaggaaaaaacaagcccacccaaccaaacaaccgcacccaggaaacaaaccaccaccgacaacacaacaagaaaac

SEQ ID NO: 14303 - DNA, 334 bp, Zea mays
  Clone ID: cC-zmpo148066f12a1
aaaaaaaaaaaaacaggcacccacaccgggaccaaaaaaaaaaaacagaaacccacaaaaaaaaaaaaccaaacaggagacaaaaaaaaaaacacacgaaaaaaaagaaaagaaaaaccccgaaaaaccaaaacaaaaaaaaaaaaataaaacaaccacaacggaaccggaaacacaaaaaaccaaaccaaaaaaacaacacaccccaaaagagaaaaaccaagaaacaaaaaaagaagttaaaaaaaaccaaaacgacgagagcacagaaaagccaccaaacccaaacttagaaaaccaacacaacaagcccacaaaacggacctgtcgcaac

SEQ ID NO: 14304 - DNA, 449 bp, Zea mays
  Clone ID: cC-zmpo148066g01a1
ataataaaggtttcatgctgcatacggggggtatatattcagtacacaatctcgtcccaccactacaaaaaacgagtcaaatctacaaaaaaagaatagatagattgccttcgaaaagaagatatatccatgcttggtcttttctccttacacttctccttcctgtagcctcctgacatttcttcgttgggctcaaaggagtcactgattattcccacaccttcgcttgatccctcctttttccattcatcctatcttgtggtagttaattaagggacgtgaaactcttcacttgtgctcaagcatcatgttgttctcaggggcaaggccaatgcaggcccgcaagatgttttccagcatggccctttgcttggctagaacattcaccactggtgtgccaagaagtacaagaagaaccttgctgaggtagcttaaaataatggccacag

SEQ ID NO: 14305 - DNA, 533 bp, Zea mays
  Clone ID: cC-zmpo148066g01d1
gtccgtgacttggtgctcgtagctgagctcaacactcggtttcattttaaggccgaagggcaggataagggggcacggcttccaccctgtcgccactattctcagctacctcagcaaggctcctcttgtacctcctggcacaccagtggtgaatgctctagccaagcagagggccatgctggaaaacatcttgcgggcctgcattggccttgcccctgagaacaacatgatgcttgagcacaagtgaagagtttcacgtcccttaattaactaccacaagataggatgaatggaaaaaggagggatcaagcgaaagtgtgggaataatcagtgactcctctgagcccaacgaagaaatgtcaggaggctacaggaaggagaagtgtaaggagagaagaccaagcatggatatatcctcttttcgaagccatctatctattctttttttgtagatttgactcgttttttgtactcgtgggacgagattgtgtactggctatatatccactgtatgcagcatgaaacctttattt

SEQ ID NO: 14306 - DNA, 322 bp, Zea mays
  Clone ID: cC-zmpo148066g02a1
atattattaaacacaaaaaccaaacattaaagcaaaatttaaattaatataaaaacaacgcccccccccctaaaattaatttttatataaaaaaatatctaaaacaaaaaaacttaatataacacaatatctgacttcacttaataaaaactcaacacaaaaaaatctcacaaaaaaatcctcatttttctatgaaaatataacaaaaaaaccacttttattctataaaacttcaattaaaaatctacctacaaaaaacaactaccttttttaaaaactaaaaaataccccaatacctacattttattcaaaaaaattaaaa

SEQ ID NO: 14307 - DNA, 204 bp, Zea mays
  Clone ID: cC-zmpo148066g04a1
ttttttttttttttttattaaaaaacaaaaaccaacaaacggggaagagaaaattaaaacacccacaccgaccaccccccccaaagaaaccaaaacaaaaacccacaaccacaaacacaaacagcaaaaaacgcaaccccaaaacacaccacccaaaaaccaagcaaaaacacaacacaccaccaaaaaccaaaatactaaccc

SEQ ID NO: 14308 - DNA, 497 bp, Zea mays
  unsure at all n locations
  Clone ID: cC-zmpo148066g05a1
ntnttttttttttttttatatataanaaangaataaggcttttagggatggtgttttttctcttcatgcatgtaacaaggccgcaaccggaaaccctagaacatatatatatacgtacgtattcaacagcagcacatacatatacatgtaaggaaattaaaataatttgatatagtacgtacgccttggaaagacctgcatgcggcgtggcatcaatataatataaattataatatgcatgcagatcgatgcaagaaggtcgagaagcgatcgatcatagtagatagcatgcatatatatatataaaaattaatccattcatgcggcggcggcggccacagcggcgtggtgtgtgaatcctaaagcgatgtgccgccatccgaccgtactccctgtcgtgcgcagcgaccgggacattcttcttcttgcccttccacgccttcttgcaattttcggaggcgcccattgcggcggtcacctgctccatgggcttgccg

SEQ ID NO: 14309 - DNA, 516 bp, Zea mays
  unsure at all n locations
  Clone ID: cC-zmpo148066g06a1
nnnnnnnnnnnntttttttttttttnanannnnnnnnnnnnnggagagaagggacgcattccaagcaaaaagcaagggcccaccaaaacattggccaaaggactttttgagtttcaccaagaaaaacaacccaaaggaatgcaaatggtgaaggtacaaatgtcaccccttctgttctccgacccctttgtttgcaagtttcaatcattgtacatacacacaaacatgtgtgccccccccccccaacgtttttgccacctcactatatatgatgtgatgtatgccatgccatgcggcctttaaaacttgaaaccaattttttgcggcgccccggtgtacttgaaccacatggcgccgtctattaacagcccggaggagaacaggttggccttcttccgtcccaagaagtggaaaccgggccaatgaccctttttttgtgcccgcccccggcccccggttttttactccgcgaaaaaaaccttttgagggccaaaatcccgtcccagggttatcccc

SEQ ID NO: 14310 - DNA, 355 bp, Zea mays
  unsure at all n locations
  Clone ID: cC-zmpo148066g07a1
nnnnnnnnttttttttttttcanaaaanaannnnnnnnagagaaaagatttatttttttttttttttttaaaaaaacccccaaaccaaaaacccctttcaaggaaacccccataaatatagttttcccaaaaaaacccacattcaaattattttaaaacctaccaaatcccaaggccggaatttttgaggggggctacaaaaatgtgccccccgcactttaattcccaaaaacaaaaatgtttccccaaacaattaaaaaaaaagcccggggggcaaagcaaaaattccccaaaaaaaaatacccgggtttaaaatttttcttatacccaaccctaaggaaccccccctaaaatt

SEQ ID NO: 14311 - DNA, 302 bp, Zea mays
  unsure at all n locations
  Clone ID: cC-zmpo148066g09a1
nnnnnnnttttttttttttaaccacgcaaccacanncaggagacccgtttctttctcagntacatatctgccacccacctgaataggatttgtggtttaatgccacccaatctgcgaccactgcagtcggacgtctaccacttgctataacatatagatcgtcgtaaacgatgtgctattactgatcgtcgtacacacccgaatccaactgtttgagcaaccacgcgcaaatgggcagcggtacgttcttaaagtacccaagcgggttggcggtgcgcaagatttctcttatgcccacgttc

SEQ ID NO: 14312 - DNA, 206 bp, Zea mays
  unsure at all n locations
  Clone ID: cC-zmpo148066g11a1
nnnnnnnttttttttttaaaaaggagaaagaaaccaacgaaacgtgtgccttgaaacaacccacaggacacccccacncncaagcgaacaacaacacagccaaacaccaacaccggcaaaccaaggaaaaaaagggaaccccaaaaaacaggacacaaggcggagcgaagaaaaaaacaggcccacccaaccaaagacccgcaccc

SEQ ID NO: 14313 - DNA, 228 bp, Zea mays
  Clone ID: cC-zmpo148066g12a1
aaaacaaaaaacccccgggagagagggtttaaaaaaacaccccaccccccccccgacgcccccccaaaaaaaaaaaaacaccgaaccgcgaaaacaaaaaaaaaacccgggcccccccaccccaccaaacaaaagcgaaaacaacacaaccaaaaaccaggccacccaaaagacacacccccacaccaccctccaaaggaagcacagaacaaaaaaaacaagggaaca

SEQ ID NO: 14314 - DNA, 490 bp, Zea mays
  unsure at all n locations
  Clone ID: cC-zmpo148066h01a1
aataataattaactctgngtcacaagaacgaagggaacaacaacatatctccattccagccaacaccatgtgagcctaaaactcggaaaaagatcaatacaatgtgcagggaaaacaacggcatgcagctaattcccagcagaatcctcggtggcggtgcgcctccttagcttggcgcgcgtcacacggatcgtctcctccatcagcgtctcctcgagcgcagggtcaagctcttccgcgccctctgcagcatcaccactgacctcatcgattgccatgttgtctacttcttcggtctcagaaagtggtggggcactaggctcggattttggtgaatctgcacttgtggctggagttttgaactgggtcgacagcaggtttgacctcacctttctttgggctaccgccaggttttggtgtggatgcagctgctgcaggctttgtggatgccaccgaaccaggtctcccttgatgttgacgcttgatcttg

SEQ ID NO: 14315 - DNA, 452 bp, Zea mays
  unsure at all n locations
  Clone ID: cC-zmpo148066h01d1
gtccgctagaagcaaaggtgttgntctttgnatatttgtgtttcctttagacaaagggaactacgtatgtgggtgggactttctttaagccatatatttctcaccatgagaatgaaatcgaccgaaatcttcttgagctcagagctcgagccaccgatatggttgtcctttacttccataaggctgcttcggtagggcaaaatactttctttgacgttttaaaatatgttgctgcccagtccccttctcggaaatcaaggctgcaccctcatcaggaaccacagcagcagcaaccacaagtgcaggtggagctgcagcagccgcaaccacaaaaacaagcagcacctgttatgcgcagaggagcatctattgctgctcggcaagcagcaatggcacagcaatctctggagactatacccgttccatcttcacccaagatcaagcgtcaaaca

SEQ ID NO: 14316 - DNA, 372 bp, Zea mays
  unsure at all n locations
  Clone ID: cC-zmpo148066h02a1
nnnnnnnnnnnctttttaattatacggcacacaccccnnannnaggcgaggggcaagcttaggcaccccnnnacaagacacacccccngcnncnccccgcaaaaaaaangnagagggcaccaaacagacagacagaccagagcggaccaggnnccccccccccctgnggccacgacangagacgncaaaccccagnncagcacgcactanaacaaaanaccaancctagagaaaacncgccgctagccatcatagttcgaggaaaacgaactcctcgatcgccggaatggccccgatcttctccagcgtgtccttgtcgggctcctcgtcaacgccaatggccatgatcgcctgcttgcccctgaacgtccg

SEQ ID NO: 14317 - DNA, 360 bp, Zea mays
  unsure at all n locations
  Clone ID: cC-zmpo148066h02d1
cggggacgnncaggggcaagcaggcgaacaaggccatttttgtttatgaggagcccgacaaggacacgcgggaggagagcggggccatnccggcgagcgacgaccccgnnnncctcgaactatganggctagcagcgagnannctctaggacaganattttgttatagtacgtactgaactggggtttgacgtctcatgtcatggccacagggaggagaggaacctgatccgctctggtctgtctgtctgtttggtgacctctacattttttatgcggggagaagcaagcaatatatattgtaaaagggtgccttggcttgccccctgcctaaataagaggtgtgtgccgtttgtttatc

SEQ ID NO: 14318 - DNA, 428 bp, Zea mays
  unsure at all n locations
  Clone ID: cC-zmpo148066h04a1
nnnnnnnnnnctttttttttataacacccgaaancggccggnatggggaaagaaaactttatacccaaaaacacggggcgacccccccnaaaacaaaaaaaaccgggcagaagagaggcaccaaaacaggggcgccccaccaaaagaagaccgcgaaagcgcgcaacgcagacacgagaaaaaaaacaccaccagagagagggcacaccccacagggggcaaaaaaacacacaacccccgagaggcaaccnggggcgccccccggggccgacgcacaaagacacagggacggggagggggccccgaaacaccacacggacaccacacacagggacacccccgcacaagacaccgggacagcacaaaacaagaaaaccccccacggggaaaaagacgcccccgaaaaccncaaaaaagacacccccaac

SEQ ID NO: 14319 - DNA, 379 bp, Zea mays
  unsure at all n locations
  Clone ID: cC-zmpo148066h05a1
cccggcaggctgacancacggnncattttttttcccagcgagcggaggcgggcaancagggcagggggcgacaaggaccccnccacagagaaacaaccgccccgaagggccangaccacgccagnngnacggacaccaacncancagggccagccagcagcancagcggggccgaccgaaacaaggngaacncacgcgccggancgccggnggncacccagnnnnacgggnaacgggcagaggcgncaaagcccncgcgccgagcgaccgcancccngcagggcacaggcccgncgacaaanccgaaacaaggacaaagcncgcccccgagggaaaanggnanccgcccacaaccccacacaacaaacgagccggaagc

SEQ ID NO: 14320 - DNA, 335 bp, Zea mays
  unsure at all n locations
  Clone ID: cC-zmpo148066h07a1
nnnnnnnnnttttttttttttaaaaaaaaaaaaanacacacaagcaaagatgcattaaaanacgcggcacaccacaaccaaaaaaccaaaaacccagnccaaaaaaaacccaaacaaaagagggcacaccaaaaacaacccaagcaaaccaaacaaaaaccaaaccaaaaaaacagccaggaaactaagaacccgaccaaaaaaaaaaaaacccgccaacgcaaagcccaaaaacaaaaagggaaaacccaacaaaacaaaaaaaacccccggcaacaacccaaaaccccccaaaaaaaaacaaccccgcaccaaaaaaagacccaaacccaaaa

SEQ ID NO: 14321 - DNA, 226 bp, Zea mays
  unsure at all n locations
  Clone ID: cC-zmpo148066h11a1
nnnnnanntttttttttttaaaaacaaaaaaaaaaccaaaagaaaagagggactaaaaanaaacaaaaggacaaccccacaaaaaaaaaaaaaaaaacacacccaaacacaaacacagcaaaccaaacacaaaaagaacaccccaaccaacaacacaaaaagacaaacaaaaaaaaaaacaagcccacccaacaaaagacccaaacccaagacaaacacccccccc

SEQ ID NO: 14322 - DNA, 531 bp, Zea mays
  unsure at all n locations
  Clone ID: cC-zmpo148066h12a1
nnntnnttttttattattcaaaaaacncanncncccccggggaaagatggtttttaaaaaanaacaaagcacccccccccccgnaaaancccaaaaagaaaaaaagaaaaacaccaaangacaaaaaaaaaaaaaaaaagggcgcccccccaacaaaaaaaaaaaaaagccagaccacaaaaaaaaaanaacaaaccaacaaaaaggaacacccaaaaaacaccacaacacgggaaggacaaaaaaaaaaaaaccagacaacgacaaaccagccacaccccgcaaaggcaaaaaccaacccaaggaccacaccaccaggaaacacaaccaaaaccagaaacaaaaacccaaaaaaaaacccaggcccccccaaccctttgggaaaaaaaacaaaccgatccccttacacttaacaaacttctaacccacaaaaaacaaaaacttctcaaagaaaaacaaatatccctaaaaaaagttgaaaaaaaaaaaagccaaaaatataaaaacccctcccaaaaaaaaaataccccc

SEQ ID NO: 14323 - DNA, 528 bp, Zea mays
  Clone ID: cC-zmpo148067a02d1
ccggtcgatagatcgatccacgtacgcgcatacccatgcactttctctttctagtttcggtttgatttcattcgatttggggtttccatccatccacccaatccaatcaaattagtaatgagcaaaggtgctatcatcggcgcgtcgaccgtccttgtggtggcggtggtcgcggccgtgtgcgtggtgtccttcaagggcaactccggcaagggcgatggcgacgagaacctgtccatgtcggtgaagtcggtgaaggccttctgccagcccgcggactacaaggagacgtgcgaggcggagctgtccaaggcggcgggcaacgccagctcgccgtcggacctggccaaggtcatcttcaaggtcaccaccgacaagatccacaaggccatcagcgagtcggcgacgctggaagagctcaagaacgacccgcgcacgtcgggcgcgctccacgactgcaaggagatgctggggtacgccatcgacgagctcaagtcgtccttcgacaagctgggcggcttcgagatg

SEQ ID NO: 14324 - DNA, 647 bp, Zea mays
  Clone ID: cC-zmpo148067a03d1
gtggtccaccccatcgtcaccctcgaggccgatggctcatttttcatttttggcgatggtcgtcgcctgatcaggtccagcaaccaagatgaacttggagcgttatgccaacagatgcactacaagacgttgtgctccacgatgacgacactgcctggggtgactacgccagagcaactcttagatgcatccctgcggattacagcggtgaaggcagcgatggcggagatgaagctagacaatgcaataaaatcaggcagtgctcagggtaacccgatgatgtcgtcgctaaagacatgcaaggagagctacgcgtcgctggtagactccatcaataccacgcggaacacgctcaaaagcggcggcagcaatgcagacctcatgtcggagctatccgcggcggacaccttcgccaccgactgcggggacaccttcgacgagcgaccagacctcaactcacccatactcggtgcgcagcgccacgtcaaccgcctcatcagcaactgccttgacctagcagccaccattaaggaacaaccctagatgcctatgatgtggacactaaaaaaaattatctacaactggcttgagaagaaacagtcccacaacctacttcaaatttacgacatgtcttgacataccaatga

SEQ ID NO: 14325 - DNA, 503 bp, Zea mays
  Clone ID: cC-zmpo148067a04d1
ggacgcgtggatagcatcaatcatgtctggtcgttcgtggactttaattttgcctctcctagcgtcgatgctgcgcgtcgggctcgccgcgggctccgaggaggaggaggacggcggcggcaaaaagaagccccacgtcaaccacggcaagtttaaggcggagccgtggacggacgggcacgcgacgtactacggcgggcgcgacgggttaactgacaccacggacagcggcgcgtgcggctacaagggcgagctggggaaagactacggcaccctgacggcggccgtgggcccgtcgctgtacaccaacggcaccgggtgcggcgcgtgctacgagctcaagggccccaagggcaccgtggtggtgacggccaccaacgaggccccgccgccggtgagcgggcagaagggcgagcactttgacctcaccataccggcgttcctcaagatcgccgaggagaaggccggcatcgtgcccatcacctaccgcaaggtggcgtgcg

SEQ ID NO: 14326 - DNA, 554 bp, Zea mays
  Clone ID: cC-zmpo148067a05d1
cgtctgcctgcccatccaccgcggcgccggccggccgtccttcttttttccacatccctcctcctctcctgcagggtgcctgtgccgtatgaggggtcggagtcggagtcggagaagatgatgggcgggttcctctccagggtcctcctgttggcttttggctatgcctatcctgcctacgaatgctacaagactgttgaactgaacaaaccagagattgcgcagctcatattttggtgtcagtattggattttagttgccttgttgacagttttggagagattcggagatttcacaatatcatggttaccgttttactcggaagcaaagctgatgttctttgtatacttgtggtaccctaagacaaagggaactacgtatgtttatggaactttctttaaaccatatatttctcagcatgagaatgaaatcgaccggaatctccttgagctgagagctcgagccaccgacacggttgtcctttattttcagaaggctgcttcggcaggacaaagaatcacagcagccgccacaacaacagcaaccacaagtgc

SEQ ID NO: 14327 - DNA, 608 bp, Zea mays
  unsure at all n locations
  Clone ID: cC-zmpo148067a07d1
ggcatgatcgaccagatcaagcgcgagatctccgtcatgcgctttgtcctccaccccaacgtcgtgcagctgcacggggtgagggccagcatgagcaagatatacttcgccatggagtacgtccggggcggcgagctcttcgcccgcggtcgcccgcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggagtgccagaagcaggacggcctgctgcacaccacctgcggcacccccgcgtacgtcgcgccggagatcatcaacaagaagggctacgacggggccaaggccgacattctggtcctgcggcgtcatcctcttcgtgctcctcgccggctaccttccgttccacgacgcccacctggtggagatgtaccgcaagatcagcagagccgacgtcaagtactcgcagtggttctcccctgagctccnngcgttgatgcccaagctcctcgaaccgaacccaaacaac

SEQ ID NO: 14328 - DNA, 586 bp, Zea mays
  unsure at all n locations
  Clone ID: cC-zmpo148067a08d1
gggcgngccaaacaatgcgatgagagccttgnncctccttttcctctattgcatcgngcatggngagaaggaagagtcgagtggcatttatgcgaaagcgtccgggcctgaccggtccttcgacatcaccaaattgggcgccttcggtcattggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaagtggatggcaatctgctggcgaccacggacctaagccagtacaaggaccatggtaattggatcgagattctacgcgtggataacctggtcatcaccggcaagggaaaccttgacgggcagggcccaaccgtgtggagcaagaactcctgcaccaagaagtacgactgcaagatccttcccacttgctggtgatggacttcgtgaacaacggggaggtgtccggtgtcacgctgctcaacttcaagttcttccacatgaacatgtaccggtgcaaggacatgcta

SEQ ID NO: 14329 - DNA, 541 bp, Zea mays
  Clone ID: cC-zmpo148067a09d1
gggctggaggacagcctatccacgtcgtgcagagcttctcggttttcaccatctccaactgccacttcacgggccaggaggacgttatgctcttcggcgccagcgactcctgcccgcaggaccagatcatgcatatcacccgcgccttcaaccacttcggcaggggcctggtgcagcggatgccaacgtgccgctggggcttcttacacgttgtcaacaacgactacacgcactggctcatgtacgccattggcggcggcgacacgccaaccatcatcagccagggcaaccgctacatagcaccaccaaacatcgccgccaaagtgatcaccaagcactactccgaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttcttcggcacactgtcctgctgcacgggcaaaccgtgctg

SEQ ID NO: 14330 - DNA, 349 bp, Zea mays
  unsure at all n locations
  Clone ID: cC-zmpo148067a10a1
aaaaaaannnncgntncctgaagattttggcaagagaaacaaccaaaggaatcaaaaagaaaagaaaaaaagggtaaaggtacaaactttagcccttctgttctgcgacaccttaagtacaaacatgtatgtaccacctccctagcgtgtgctgtatataccatgccatgcatgcggtctttaaaacttgaacccgaggatttgcggcgtgccggtgaacttgaaccacaacccgccgtcgatgaacggcccggcggttaactgttcggctttctttcggccgatgacgtggaacccaggccaggtgacccttttgcttgtgccggcgccggggccgtggtttttgtac

SEQ ID NO: 14331 - DNA, 621 bp, Zea mays
  unsure at all n locations
  Clone ID: cC-zmpo148067a10d1
cgagcgttcaggacacgctgacntgcacgcccggncctgttcttttctactgcgncatctccggcaccattgacttgatcttcttcaactcggcggcggtgtcccagaactgcctcatcgtcacgcggcggcccatggacaaccagcaaaactcggtgaccgcgcacggtcgcacggaccccaacatgaagtcggggctcgtcatccagaactgccgcctggtgcccgaccagaagctcttccccgaccgcttcaagatcccctcgtacctgggccgaccctggaaggagttctcgcgcctcgtcatcatggagagcaccatcgccgacttcatcaagcccgagggctacatgccctggaacggcgacttcagcatcaagacgctctactacgccgagtacaacaaccgcggccccggcgccggcaccagcaagagggtcacctggcctgggttccacgttatcggccggaaggacgccgagcagttcaccgccgggccgttcatcgacngcgtgttgtggctcaagttcacccgcacgccgcacatcctcgggttcaagttctaaagaccgcatgcatggcatggtatatacagcacacgctagggaggtggtacataca

SEQ ID NO: 14332 - DNA, 287 bp, Zea mays
  Clone ID: cC-zmpo148067a11a1
acagggattgacaaatcggcaccacaccgcacgaggcaaggcacaattagatgcaacaagggaacaaaaaagaagaatgaaagaacatccctatgcgggacactcagaaacgcagcttgctggcatacgcaagcaccagctcgcttccatcacacgcaaaaccttttttctcgggggcgcgaacaattcactgctggttgcttctaccaacgaaagaaacgcgtgcttttcttcttcctcacaatggatgcaacgagctccaactgacgctcaagagtcccctgcaa

SEQ ID NO: 14333 - DNA, 521 bp, Zea mays
  unsure at all n locations
  Clone ID: cC-zmpo148067a11d1
tccgcactaaggctctcctctcggaggtctgataggcaacctttntaattcatgaagtcctatcaggatctcatgagcgaccngggaagctctgccttagatggacactacgacgagaagaggaaatccaatgtggaatacacagaggaccagaaagacagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgcggatgccttccgccagcttcttgtacttgaagagctgctaccatcgcagcatgatgactaccacatgatgctaagatttctcaaggcaagaaagtttgatatcgagaaggcaaagcaaatgtggtctgatatgctgaagtggagaaaggagttcggtgcacataccattctcgaggaattccaattcgaagaagctgataaggtggcagaatgctaccctc

SEQ ID NO: 14334 - DNA, 334 bp, Zea mays
  unsure at all n locations
  Clone ID: cC-zmpo148067a12a1
nnnnnnnnnnnnnnnntttttttttttttnnannnnnnnnnnnnnnnnnngnnnnngtttttttttttttttttgaaaacccccaaacccttttttaaaaaaattttcaaacacagtgccaaaatttaaattttacttccaacacaaatctacttaaaaaaccctttttttggccccctacccccaaacaaggaaaggggttaaaaaacccccccaaatttctaaaaaaaaaaattttggccccatccccccctcctctttaaaccccttaaacctttgaataaccctacccccaaaaataacctacccttgcccccccccccctccccgaacc

SEQ ID NO: 14335 - DNA, 245 bp, Zea mays
  Clone ID: cC-zmpo148067a12d1
gtgggtgcgcaagcgtacgtaaatgttgcggagaaggtgattcatagttttaaggagttagcagaggagcgacgggtgggggcagaaatcttactttgagaaattcacgctgcttttctcacacctttccctgtttgacgctacggcgccaaaacaatgtactgataagtagattgctgttggaagtaaactttaaatttcgtcactctgtctgaaaatttactcaaacaaacttctgctgcttc

SEQ ID NO: 14336 - DNA, 193 bp, Zea mays
  Clone ID: cC-zmpo148067b01d1
atgatatataaatatgtgcatgaaatgcgtgcggcaaacgctttgattttgcttgcctagctagctaattgggggttggtttttctttacttttcttcatatctgcctctctctctctctctcggttgtttaatttttcttcatgcatgtaatataatgtgatatacctaatatatacaacgcgctttaattc

SEQ ID NO: 14337 - DNA, 541 bp, Zea mays
  unsure at all n locations
  Clone ID: cC-zmpo148067b02d1
ggacgcgtgggcggggtgggcaggaagagcaagtcggcgcgtgtgtcgttgctgagccggaagcccgcgagctggggcgggagctcctccgccgccgcgtggggcaagtcctactccttcgtcggcacggaggagtacgtggcgccagagatggtgcgcggcgagggccacggcttcgccgtcgactggtgggccgtcggcgtgctcgcctacgagatggcgttcgggcggacgccgttcaagggccagaaccgcaaggagacgttccggaacgtgctgcagcaggagctcgagttcccgggggacacccggtggcggacgccggagctcgcggatctcatctcgggcctgctggagcgggacccgaggaggaagctcgggtacgccggcggcgccgacgaggtccgggcccacccgttcttcgccggcgtcgcgtgggacatgctcacggaggtgtccaggccgncttacatnccgccgncggccgacgaggacctcgcggacgtcgaaaggttcgacgtgaggggccactttaaggacc

SEQ ID NO: 14338 - DNA, 354 bp, Zea mays
  Clone ID: cC-zmpo148067b03d1
acgaggaaacggttctgctgcagtttggtaaggtcgacgatgttatttttacaatggattaccggcaaccgctgtctgcgttccaagcttttgccatcagccttagcagctttgggaacaagctagcctgtgaatagcgatacggttcgatgctcgtcgcgtggctatatggtttgcggtggtgggtgcttgctcgccgttgttacaatgtgatctgttctttttttttagttgagtatcgacgtactatttgtaccatgctgttgtacaagagatgcactatactgcattactgctgtcttgtcaaaaggacttgttcaagaaggaaatactgtgtcataaactttttgctct

SEQ ID NO: 14339 - DNA, 547 bp, Zea mays
  Clone ID: cC-zmpo148067b04d1
ccgcagcgatctcctctccctctccctctccgatccattctccagcttttcgttgtaaacatgtctgaccgggcaaaggggtcggggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgactttcaataatagtaacaaca

SEQ ID NO: 14340 - DNA, 508 bp, Zea mays
  Clone ID: cC-zmpo148067b05d1
tcgaggcttattccgctacgatgtcactgcctgtgagaccaagtttatttttggcaaccttgggtttgttgcaggggtcggtgaagggcgccaccttaagaagcgccctactgagtttcgtgtggaccgtgtgctccagccgtttgaccctgccaagttcaatttcacaaaagttggccaggaagaggttctcttccaatttgagaatagtggtggtgatgacagctatttcctgaacaacgctccaatcattgctgttgatcgggctccaaatgttattgctatcaatgtaagcccaattgaatatggacatgtgcttctcattcctcgtgttctggaccgcctgcctcagaggattgatccagagagcttcttgcttgcactgcaaatggcagccgagggaggtagcccatacttcaggcttggttacaatagcttgggtgcgtttgccaccatcaatcaccttcactttcaggcgtactacttgtcagtgcctttccctgttgag

SEQ ID NO: 14341 - DNA, 510 bp, Zea mays
  Clone ID: cC-zmpo148067b06d1
tcactcaccccgccttcacgcctccctcaccaaatttggtttttcccttttccgacattcacaggggggacaggaaatcatcggccatggcctcgattcccgcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacagggtgaccgacgggaacggcacgtacacgatcgagctcaaggacagccacgaggaggacatctgcgaggtggtcttggtggagagcccgcccaaggactgcgaccagatgcacgcggacagggaccgcgcctgcgtactgctcaccaagaacgtcggcatcagcgacaacctgcgccccgacaaccccctcg

SEQ ID NO: 14342 - DNA, 582 bp, Zea mays
  unsure at all n locations
  Clone ID: cC-zmpo148067b07d1
ttataacaatgcattggggaggccaaacaagaagaattttattgtgctatcaaaagcatatcatggatctagattggtgtcagcgatcctaactggtcttcctgccctacaccagaagtttgatctaccagcaccttttgttctgcacacttgactgccctcactactggcgatatcatcttcctggtgagacagaagaagattttgcgactagacttgccaccaatttagagaatctcattctcaaagaaggaccagaaacaattgctgctttcattgctgaacctgtgatgggtgctggtggtgtcatccctcctccaaagacctattttgacaaggtccaagcaatcgtcaagaagtatgacattcttttcatagcagatgaggtgatcactgcatttggaaggctgggaactatgtttggatgcgattactataacatcaagccagatctagtttcactggccaaggctctttcaaacgcctacgtacccatcggngcaactcttgttagcccagagatatcagatgtgatccattccagagcaataagnctggttcatttgctcatggattcacgta

SEQ ID NO: 14343 - DNA, 511 bp, Zea mays
  unsure at all n locations
  Clone ID: cC-zmpo148067b09d1
ccctncctacctcacacaaataataaggaaaggacccttctcttttctaccgacatccacaaggggggaggggagggcacgggcattcacccggcggcaataatggcctcggctccggctccggcgacgacgaccgtcagcgtcattctatgcctatgcgtcgtactctcctgtgccgcggctgacgacccgaacctccccgactacgtaatccagggccgcgtgtactgcgacacctgccgtgccgggttcgtgaccaacgtcaccgagtacattgcatgctccaaggtgaggctggagtgcaagcactttggaaccggcaagctcgaacgcgccatccacggtgtcaccgactcgaccggcacctacacgatcgaactcaatgacagccacgaggaggacatctgccaggtggtgctggtggccatcccgcgcaaggactagaacaaggtccatgctctcagggacacgcccggcgtgctgctcaccaggaacgttggcatctccgaca

SEQ ID NO: 14344 - DNA, 471 bp, Zea mays
  unsure at all n locations
  Clone ID: cC-zmpo148067b10a1
nnnnnnnnnnnnnntttttttttttttatacgnnnnnatagcacgtatgcaacagatgtgacatccttttgaacaatactcacaattgtgaggttttcaacagttatatcatagaagctcgagaaatgtcaatcttaggtcctgtttggatccatggtctcttagaaagtgggttttaaaagctagaaggtctcggaacaggtgagttttttttatgctgtttctaaaaactagtttatgagtttcttaaaaatcaagaagctagtctccttagctaaaactagtttctaagaaactaggtcgatccaaacaccttctcttgttttttttattctaaaagccagtttgtagagaccaaatctaaaaactagtttttaaaaaaactggtatggatccaaacactgccttaagtatgttagagcaaaacaagaactagtttacgtaaatagggtcccgaaaggtcgacacatg

SEQ ID NO: 14345 - DNA, 565 bp, Zea mays
  unsure at all n locations
  Clone ID: cC-zmpo148067b10d1
cggagggaaagaaaaagccgggggcacgcgcccggccctttttcttctcttcacgtcgcacttggcgtggggcgtggcggcgcggccctttccggcaccggcacacaggagtcacggacacccctgggagccggagagaggcaactggcccagaacacggctaccgcctgccgctgccgggctgcgcgcgcgcggtgcggacggagacgtggggcggtagcaggctgcgcgctgcacctggaccccggcatggcccgcacgtacgcaaccgtcgacacgcgccccacctcgccgcgctccaaacgccgctgtccctgtcgtagtgtcctgggtcctggccgcctgctatttttctccgctccacccagacaagcgtccacgaccaacatctgactgctaccgctgactcaatcgtttccaataatcctctcgacgccacgctttacgattgattaagcaagagcatgtgtcgacctttcgggaccctatntacgtaaactagttcttgttttgctctaacatacttaaggcagtgtttggatccataccagtttttttaaaaact

SEQ ID NO: 14346 - DNA, 372 bp, Zea mays
  unsure at all n locations
  Clone ID: cC-zmpo148067b11a1
gagcggccgccctnnnnnnnnnnnnnnnaattttaattttgaatcatagaggtcattacacttgaaagggcaggaattacaaaacgatgagtccatcctcgatcgatgtatgagatgacatcaacgcgacaaacagataatagtagtatagtagaagaatagaaaggaaaaaaattcgacggggtcgagaaattagaggaggaagattgatcgaatcatatgtgggttgctgacggagcagcgattatatcgagctgaagcgatgaatgcgctgggcgatcaagccggcgcggcgccggcggcaccggcgccctggtccgtggagccgcacgcctggttgcacatcttggtgcaggcggggtctttcttgcc

SEQ ID NO: 14347 - DNA, 340 bp, Zea mays
  unsure at all n locations
  Clone ID: cC-zmpo148067b11d1
aagaccccgcctgcaccaagatgtgcaaccaggcgtgcgtgttccacgttctcagggcgccggngccgccggcgccgggccgggttgatcttccagcgcattcatcgcttcagctcgatataatcgctgctccgacagcaacccacatatgattcgatcaatcttcctcctctaatttctcgaccccgtcgaatttttttcctttctattcttctactatactactattatctgtttgtagcgttgatgtcatctcatacatcgatcgaagatcgactcatcgttttgtaattcctgcaatttgtaagtgtaatgacctctatgattcagtcttcctttt

SEQ ID NO: 14348 - DNA, 355 bp, Zea mays
  unsure at all n locations
  Clone ID: cC-zmpo148067b12a1
ctgacaatgnatataagcgatcatatccaacattaatagtaaagtacgtatgtcttaattgtaatttaaacggggatgggatcccgttggggatttatccccgcgaggaacgggaatgaggaaaaaatattctctgcaaagcgttcatgggatccctgcaaagaagttttttcgtcgcggggacgggagacggtgatctatttccggcggggaactccccgttgccatcagttgaggagccacacccccccggctggtgcaacatactcggagaggagctcgcctaccgctacggcggcgtgctagctgcgctctttcaactccggccgcgtccttaccaccttcgccgatggca

SEQ ID NO: 14349 - DNA, 546 bp, Zea mays
  unsure at all n locations
  Clone ID: cC-zmpo148067b12d1
ggccttctgccgccgccgccgncacacgccaccgcagattttgcttttttcgaagacaaggcgggcaatggccggggcgcgcctgccgtttccgtcgctgctcgtcctcgccgccttcttcttccaccacccctgctgcacggcgcaaggcccggcccgaaaacatctcggaggtcgaggccgcggtccgcgcccgcgcgtccgagctgctccgcgacgccaccagccagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgcctcgccatcgtcttcgagctcttcgtgggaaactcgacggccgcgttcgccgcgccgcgcggctacgtgctggccacgcccgtggccggccttctcgcgtacgacgcgtcggcagggcccgacgcgcgcgtntcgcttcgggcgctcggcgcgccggtgcgcg

SEQ ID NO: 14350 - DNA, 391 bp, Zea mays
  unsure at all n locations
  Clone ID: cC-zmpo148067c01d1
cgcgtacgggttcgggttcgggntcgngaggctctccttttttctttttcgngggngggcggaccgagagcgcggggggggatgttgagtaccggtgcttcgccggcggcctcgcctgggccacggacgaccactccctacacaacgccttcagcacctacagcgaggtcctcgagtccaagatcatcctccatcgggagacgcagacgtcccgcggcttcggcttcgtcaccttctccacggaggaggcgatgcggaacgccatctagggcatgaacggcaaggagctggacggccgcaacattaccgtcaacgaggcccagtcccgcggcggccgtggaggcggtggcggcggctactgtggtggccgtggaagctgaagttacggctg

SEQ ID NO: 14351 - DNA, 582 bp, Zea mays
  unsure at all n locations
  Clone ID: cC-zmpo148067c02d1
gcgtccggngccccgtgctgtttttgttgaccttgaaccttttgtcttttatgaggngaggactggcacctggcgccggctctttcaccctgagcagctcatcagtgggaaggaggatgccgccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaagtccaagcttgggttcactgtgtacccttccccccaagtttctacttcggtagttgagccatacaacagtgtactgtccacccactccctcctcgagcacactgatgtggctatactgctggacaatgaggccatctacgacatttgccgccgatcccttgacattgagcgcccaacctacaccaacctcaacaggcttgtgtcccaggttatctcatcccttactgcctccctgaggttcgatggtgctctgaacgtggatgttac

SEQ ID NO: 14352 - DNA, 350 bp, Zea mays
  unsure at all n locations
  Clone ID: cC-zmpo148067c03d1
gcggacttcgggctggccaagctcacgacggacaccaacattttactttttcacgcgcgtcatgggcaccttgggctacggggcgccggagtacgcgtccagcggcaagctcacggacaggtcggacgtcttctccttcggcgtcatgctgctggagctgctcacggggcgccgccccatcgataccaccaactacatggaggacagcctcgtggactgggcgcgcccgctgctgagcgccgcgctggcgggggagacgggcttcgccgagctcgtcgacccccgtctgggaagcgagtacttcgtcgtccaagtggagcgctttggcggctgcgccgncgccagcaccc

SEQ ID NO: 14353 - DNA, 344 bp, Zea mays
  Clone ID: cC-zmpo148067c04d1
aaccactgcacccaggaatcctgccgtgtgcatttcgccggcgggcaagaacgagggactccgtgtcgcacctgagcccggccggacaatcacagcggacggacacggcccgcgaccaccccgcgacgccaagactttcacacttaagaccggccgtgtcgggccgcgcctcttcggcccgcagtcgcggtcacgttccctggccaaaaccccgccgtcgcggcttcacgcgcagcgcgtcacaacggagctactcaaggttcagaccaaaacaacacacggagagtgacagacagaacactcgcgcacgcactaacgcgcccatacagtgggaacagaggatc

SEQ ID NO: 14354 - DNA, 500 bp, Zea mays
  unsure at all n locations
  Clone ID: cC-zmpo148067c05d1
cctcctcctcgtcggggccgccctctcggcgcgcgccttttcgttgtaggtgccgccggngggcggcagggctctggagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgccccggggtggtgtcctgcgccgacatcctcgcgctggcgtcgggggtgctggtcaccatgaccggcgggccccggtacccgattccgctggggcgcaaggactcgctgtcgtcgtcgcccacagcgcccgacgttgagctgtcgcacgccaact

SEQ ID NO: 14355 - DNA, 494 bp, Zea mays
  unsure at all n locations
  Clone ID: cC-zmpo148067c06d1
tcggcgnggccgccctctcggcgcgcgccgtggcgcttcaggngccgccggngggcggcagggctcggaagccggactactacagccagncgngcccgcgcgcggagcggatcatcgcggaggggatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgccccggggtggtgtcctgcgccgacattctcgcgctggcgtcgggggtgctgggcaccatgaccggcgggccccggtacccgatttcgctggggcgcaaggactcgctgtcgtcgtcgcccacagcgcccgacgtcgagctgccgacgccaacttta

SEQ ID NO: 14356 - DNA, 367 bp, Zea mays
  Clone ID: cC-zmpo148067c07d1
gggcacccacacacccacccaccgacattagttctttcaccagcacccaccacaactgctcggcgtgcgactagattatccactccatggacctcctaaccgcccaattctccatctaccataacacatgcttaaaaagccggaacctgcaaaggcatactggtaatgtgcatgtactcctctatcgacagtatgctgaactccaagacccacttacagcagatatataaggaaacaaagcaccttcaacaagaacttcacaccacttatcaactcatcaccacaatcatgaacttacaattgaacccaaacaaactgtccgatgcattcattaatacccagtataattgcgcagcatgccagaaaa

SEQ ID NO: 14357 - DNA, 534 bp, Zea mays
  Clone ID: cC-zmpo148067c08d1
acccgaacaaagttaagctgcactttactgatggtgcacttagattgttagcttttaaggcgatagctaaaagcactgggggtcgggggtaagagccatcttggaaactgttcttttgcaggccatgtatgaggttccagacgaaaaaacacgaaatgagcgagttgactctgttgtggtggatgaggaggcgattggttccgttgataggccaggttgtggggctaaaattctccgaggggatggtgcattggaccagtacataacaagaaccaatgtgatgaatttacaggaaactaacgatggtttggccggggagctcgaggaagcgtacatgctgtctagaattgttagcttgtaatttgaaaggctggggaggaagcgtatatgctgagttttgaccaacttcgtacatcgtgtaacatgtctaccccaacacaggccggctactttttgctcacaaaatcacctgtactctgtctccattcctgttaagctctaacgagcagatagatccggggcaccttttccatg

SEQ ID NO: 14358 - DNA, 611 bp, Zea mays
  unsure at all n locations
  Clone ID: cC-zmpo148067c09d1
catctccaaggaccgcgtcaagccgtcgcccacccccgactttggaagtttaacgagatcttcgccaccggcatcgggctcgggacctacatggccatcatcaccgccgtcttcttctacctcgcccacgacaccgacttcttcacggacgtgttcggcgtgaattcgatcaaggagaacgacagggagctgatggcggcgctgtacctccaagtaagcatcatcagccaggcgctcatcttcgtgacgcggtcccggagctggtcgttcgtggagcggccgggcttcctcctgctcttcgccttcttcgccgcccagctggtggcgacgtgcatcgcggtgtacgccgactgggacttctgccgcatccaggggatcggctgggcgtggggcggcgccatctggatgttcagcatcgtcacctacatcccgctcgacgtgctcaagttcatgatccgtgccgcgctcaaagacaaggccacaggcaacaacgttcacaacatgtgatacgtttctctgggtgcttgtcgcggacggcgtttatgaacaaggactgctgcaagggccgcgatcgctagcacagtgngcgtagagcataacactcacggcct

SEQ ID NO: 14359 - DNA, 406 bp, Zea mays
  unsure at all n locations
  Clone ID: cC-zmpo148067c10a1
nnttnnnnnnnnnnntttttagattattagaaccaagcatatngcaggggagngacacctcatcattcccgtacccttgcatagtgtatagctgtacaatgcaaaattaaaaacacaacatgtaggtacatattcacttgatccgatacaccagagttcacaaaaaaaaactctcttgccaccccaaaacccacataagtacacctaaggaaacgaagaacacaggactcctccggccaccgctggacgccgtcggtctccggagaccagcgagatcagccgcatcagcggcgctagagatggtgggctagtcgccagagaagactgtacctacgtatatcttgcgacctttgcgggccttctcggggagctcggactgcatgctagtccttgctgcctaaaaagt

SEQ ID NO: 14360 - DNA, 582 bp, Zea mays
  unsure at all n locations
  Clone ID: cC-zmpo148067c10d1
atctccaaggaccgcgtcaagccgtcgcccacccccgactttggaagtttaacgagatcttcgccaccggcatcgggctcgggacctacatggccatcatcaccgccgtcttcttctacctcgcccacgacaccgacttcttcacggacgtgttccgcgtgaattcgatcaaggagaacgacagggagctgatggcggcgctgtacctccaagtaagcatcatcagccaggcgctcatcttcgtgacgcggtcccggagctggtcgttcgtggagcggccgggcttcctcctgctcttcgccttcttcgccgcccagctggtggcgacgtgcatcgcggtgtacgccgactgggacttctgccgcatccaggggatcggctgggcgtggggcggcgccatctggatgttcagcatcgtcacctacatcccgctcgacgtgctcaagttcatgatccgcgccgcgctcaaagacaaggccacgggcaacaacgtgcacaacaagtgatacgtttctctgggtgcttgtcgcggacggcgtttangaacaagggactgcggcagggccggcgatcgcgaagcac

SEQ ID NO: 14361 - DNA, 309 bp, Zea mays
  unsure at all n locations
  Clone ID: cC-zmpo148067c11a1
ggggggggggggacaaaaacaggggggggtgaacaaaaaaacccacaacccgccccaaccccnaaaaaaaaacaaaacaccaaccaccacgccacaaganncgcccacacccacacaaaaaaaagcacaaccaagactcaaaccgcccaaaaaaaaaaacccacaaacaccgcggnataaaaaaacaaaaaaaaagcggcgaacaaaacaagccatgccaacgatcatttccaaagcttgagccaatccctccaacccccatgcctgaccaaatgaacccatatcttgtccacccggataatgaactcc

SEQ ID NO: 14362 - DNA, 445 bp, Zea mays
  Clone ID: cC-zmpo148067c11d1
tcccggggctctccgtcgcactttctcgtgcctctgtgtcccttatccgccaccgcgcgaccgatcgtccgggatgcgcgggccgtacccgacggctgctgctgctgctgcttcttcttcggacgacatggcggcgaacggcatgaaagtggccgctgcaccggcaggtctcggggggctcgatgaagcagaacgcggagctccggcgccaggcgtcgctcgagtccccgcggacggggcgggccaccagccggttcctgttcgggcggcagtcgtccatggacccgaaccggaggcgcggccggagccagagccccgtgcgcgcgccggaggacctgggcgtgccggacaacctggacgccaccatgcagctgctcttcttcgcgtgccacggcgacgcgctggggatcgaaggcctgctgcgcagcggcgtcgacgtcaacag

SEQ ID NO: 14363 - DNA, 432 bp, Zea mays
  unsure at all n locations
  Clone ID: cC-zmpo148067c12a1
ggcantcagataattntctcgggttagtttcgttacatagncaagaagaaacatagtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcagaatcgtcgccggacgatggtgctggggcgctggaggtgccatcagaagatgggcctggtgcggcggaggactcanacgacgaccatggcgctggtgcgctagagggaccggatgaggccgccgccgccggagcattagcagccgacgcgctggcaccagcaccggacgccggcgcgtcttcaccagacaggccgctggcgctcgcaaggccctcggaggccccggcgggggca

SEQ ID NO: 14364 - DNA, 438 bp, Zea mays
  unsure at all n locations
  Clone ID: cC-zmpo148067c12d1
acccgagcaaccagcgatcgccccatggccgccatggctcgttccgtttccctttttgtggcgcccctgctcctcctctcgctcctcgtctccgccgcggccagcgcgcggaccgtgggcgacaccgtgcaggacgcgtgcagcaagacccagttcccccagatctgcgtggacagcctcgccgccaagccggagagccagaaggcgacgccgcgcaagctggcggagctgttcgtgaacatcgcggccgagaaggggtccgggatggccaccttcgtgcaccgcaagtacagcgacaaggaggacagcgacatgttcaggtgctacgacagctgctccgacgacgtggaggaggccgtcgcccacctcaacggcctcgtccgggagcccaccgacgccaaggntctcgagctcaagtcgtggctcttcttcacgctc

SEQ ID NO: 14365 - DNA, 461 bp, Zea mays
  unsure at all n locations
  Clone ID: cC-zmpo148067d02d1
aggacagccagatcacggcgaangcgaacgccgacgttctcttttcccgggcggcgctggcgtgcccgcgcaaagagctcatccagcaggtggtgttcgcgagctacggaaaccccgcgggcatctgcggcaactacaccgtcggcagctgccacacgccgcgcgccaaggaggtggtggagaaggcgtgcctcggcaagcgcgtctgcacgctgcccgtggccgccgacgtctacggcggcgacgccaactgctccggcaccaccgccacgctcgccgtgcaggccaagtgctccaagaggtcgcccagcgcggcgcagtaattcagtcgctcgtcgggacatcctattcgtggctgggcggggaacacattgtcggtactgtcattgtaagcttaaaaaaccctatattgtactcgtggctgggcggggagcatctaacaatatatttatagatggttc

SEQ ID NO: 14366 - DNA, 422 bp, Zea mays
  Clone ID: cC-zmpo148067d03d1
tctctgaaaggatgttgccaccttgctgaactgcaatacatttataattttgcttgcagcagtagaaattcaaggggggcgtaccatctatttcacacttcctgccttttacactggactattctgtgccaatacgagatgctgaacgatgaaatagctaggaaggggaagagcaaccgaggaaggaaggcaaagaatgcacctaggagaagcaaaataacgtccatagtttgcccagaatgtcagggtactggaattcacgtcaacggagatgaacttgagaagccaagcatttctttatcagagatgtttcgcttcaagatgaaagcaatcgaagctcacaaagcatggctgaagagacctgaagtgcttgaaaactgttccactgggctttatttcccctcagaacatgtggagaactc

SEQ ID NO: 14367 - DNA, 433 bp, Zea mays
  unsure at all n locations
  Clone ID: cC-zmpo148067d04d1
tggntcgnggatgccggcgccacagcctctcctgctgncgcttctggtttccgngctagcggnggccgccgagggcggggcgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtgcccgcccaacgaccagcagttcgcggacagccgcgggt

SEQ ID NO: 14368 - DNA, 419 bp, Zea mays
  Clone ID: cC-zmpo148067d07d1
tgcgatccatcaacaatcgccgatagcgatcgagagattaatatatattaacaaagtggcatcatcgtcaggggatctggtggagctatccctgacgctagtttgtgcccccctgatagcaaaggcaaagaaaaagagagtcgccgcccgcctccgttgaagagaataaggtgcaggacaacttctgctccacgctgtgcgagggcaggaaggggattgacctggtggtgtgcaaggagtcctgcgacctctcacagcgctccaacctggtgctgtacagccggatccagtgcaagggcaagtgcaccgagcagaaaggcatcaccgcgcctcagatgaaggtgtcccaagaagcctgcgacaaggactacgtcgccaaagccgctgatgtcaccaaggcctgcaacaccacctgctcc

SEQ ID NO: 14369 - DNA, 496 bp, Zea mays
  Clone ID: cC-zmpo148067d09d1
ctggatcatcgccacccagttgctgaacgccccgccgggctctttcgcttttgccggcgccgcaccaaggagcgcggacgggagggcgatgaggaggaggggcttattcgtcgtcatcgtggccaccgctcgctgcgccatggtggaccaccgaagcatgcacctaccgaacccacgcgtgcgcaaatctgtacagtcgaagccggagaacgcgaccgagacctgcatctatcatggcgagggcatctacggggtgatggatgggaaacagatctacattggaaacgaaaggatcatagcaaggtcctcgtgtcgtcatcatcaacatgctggccaccaagaaacagacggtctcaaaggcgtgttcatcggacacgtgatctgcgacagcgatctggtgcagaagttctaaatgtccgacacctgcatgacacttgcggtcgaggcgatcctgcagctgatgtcgatggggatcaagtaggtgatgctgaccggt

SEQ ID NO: 14370 - DNA, 419 bp, Zea mays
  unsure at all n locations
  Clone ID: cC-zmpo148067d10a1
nnnnnnnnnnnnnnacattttaatttttgangaactgngcaggaacccggtcattgtctacagaaagtaaaggaaattccttctgaaattggccccgatcgaagatagccaatggttaataatcggctggccatcttcttcggataatcaggtgtacacgtacgtacgtactactaggtacagtatcttcgtcgtggtgtgatcttggcgatcgaacaggggcagctagtgcatgctgcatgcatcagtcgtcctgcagaatcctccgcttgagcatctcggcgcgcaggtcggcggcgtccacctccttcgtgccggtgaccggacggtagtatccggtctcggggtcaggttcccagaaacgccgtcttctccttcgtcgtggtggccatggcgctggcgatgtccttggccacagt

SEQ ID NO: 14371 - DNA, 515 bp, Zea mays
  unsure at all n locations
  Clone ID: cC-zmpo148067d10d1
cgtgggttcatttctcctagaaggtataaggtcgagaggagtataatgtgtgacgtgcagnccgtcgggcaccgggcgagaagagggaatcaagaggctgctagagatcgagctcatcaaccaaccaagtcgtacgtcgtcagcatcacgaaccgatggcgcgtgccgcgtccagctatgtatccaggagggggctctccgcagcgatgacggtggcggaggagtccgtgaagaatgtggaggacaaggcggtgaagctgggaactgtggccaaggacatcgtcagcgccatggccaccacgacggaggagaagacagcgttctgggaacctgaccccgagaccggatactaccgtacggtcaccggcacgaaggaggtggacgccgtctacctgcgcgccgagatgctcaaacagaggattctgcaggacgactgatgcatgcagcatgcactagctgcccctgttcgatcgcctagatcacaccacgacgaagatactgtacctagtagtacg

SEQ ID NO: 14372 - DNA, 325 bp, Zea mays
  unsure at all n locations
  Clone ID: cC-zmpo148067d11a1
aacaggcaaannaaaacgaagcgggaatgtatccatatgacgcagggaggacaccgaccacacgacgggaaacaaattgattaaggcgtacaacggaggattagtggttcatcacccacaggttcatgacgggcatgagaaggctgtaaagcatctggcgcctgttgagctcgtcctcgatcgtcggcattagcttcctctcccccgccgacgtccccgagctagtgaggaactccgtgatggggtgggaagagataatgttgaaaccggcgccgtttgctatgccctctatcttctggcggaagttctcctacctgaccacagg

SEQ ID NO: 14373 - DNA, 477 bp, Zea mays
  Clone ID: cC-zmpo148067d11d1
caagcaagccggcaagggacggcaccaacaagagcgcgttcgaccttctcaagctagctagcgaattaacctggcctcggtggctccgacgacggccacggcggccgcggcggggacgaaggcgacggcgctgggggtggcggcgtgcgagcgccacttggagaagctggagttcatcgaggacaagaccaggaacttcgacgcggagcaggtccgcgtgctcgcggagatcctggcccgcaacaacggcgccgagtacctgcggcggcacggcatggaggggcgcacggaccgcctggcgttcaaggcgtgcgtgcccgtggtcacgtacgaggacctccgcccggagatcgagcgcatcgccaacggcgaccgctccaacatcatctcctcccaccccatcaccgaagtcctcactagctcggggacgtccgcggggagaggaagcttatgccgacgatcgaagacgagctcaca

SEQ ID NO: 14374 - DNA, 477 bp, Zea mays
  unsure at all n locations
  Clone ID: cC-zmpo148067d12a1
nnnnnnnnnnnnnngattttatttttttaagangncannngaatcngcacggggagttacatttttttaactccggcaccgtatccgagtgcatgagcgaaagaatgaatatgcatgcatgatgcatgttatcatccgtatggctgcttgctggcatgcaggttgaagaagaggagggaaagtggctacttagaagttcttggacgcctggtacgtgacgccgaacttccagtcagcggggagaacgtgccatgaggtggccttgcggtggtcgctggtcatcacccggaacgtcagtgactcgcaggtgaggtcctccccggtctgccacacttgcccccagttgcgcttcatctccgtccacttaacgcgcttgctccccttcaccgacaccgccgcgatgtcgccggcgccgcctacgttggtgatcgtcaccatgttgaagtacttgttcccggtgatggtgtaccggatgcc

SEQ ID NO: 14375 - DNA, 457 bp, Zea mays
  unsure at all n locations
  Clone ID: cC-zmpo148067d12d1
cggnacaccatcaccgggaacaagtacttcaacatggngatgttcaccttcgtaggcggcgccggcgacatcgcgggggtgtgtgtgaattggagcaagcgcgttaagcggacccacatgaagcgcaactgggggcaagtgtggcagacccgggaggacctcacctgcgagtcactgacgttccgggtgatgaccagcgaccaccgcaaggccacctcatggcacgttctccccgctgactggaagttcggcgtcacgtaccaggcgtccaagaacttctaagtagccactttccctcctcttcttcaacctgcatgccagcaagcagccatacggatgataacatgcatcatgcatgcatattcattctttcgctcatgcactccgatacggtgccggagttaaaaaaatgtaaatcaatgtgcaaattcaaatgacatcttaaccagttgtgatc

SEQ ID NO: 14376 - DNA, 595 bp, Zea mays
  Clone ID: cC-zmpo148067e02d1
ccgagaacctcctcgcctcctccattgaccaacaattaagtttccttttccgccacatctattaggtgcagccatgggggcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaagagaagccatcagcagtccatgcagaggaaaatattgccaccaacaaggtggcagccgagcccacgacagaattgaagaaagacaccgaggaggagatatagatggagaaggagaagccatcgctaagctaattgactgcatgtcaattggctgatgcctgatgatcaatgtgcaagaaagagatcgaccacctattggcatacatgttt

SEQ ID NO: 14377 - DNA, 494 bp, Zea mays
  Clone ID: cC-zmpo148067e03d1
ccgcggacgcgtgggcggacgcgtgggcggacgcgtgggtttttggtttccggcgccacagcctctcctgctggcggtggtggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaacgacctgtgcccgcccaacgaccagcagtcccgggacagcggcgggtggtgcaacccgccgcgggagcact

SEQ ID NO: 14378 - DNA, 343 bp, Zea mays
  Clone ID: cC-zmpo148067e04d1
gcggaagaccagctcaagtacgcctgcgccgacgcttttttctttttcgaggacggccggaggctctacgagggcggctactagggtctagggttacggcatgctgtctggtttagcaatgccatgcgtgtcaggccggcgtatcagtattagcagacgtcgatggtcttcagtttgcgttgcagttgtgtcctctaattactctgcctaataagttgtactagctagtatcacgcgcgtgatctcttttgtgtgcgccaccactcgtcatgcatatggcatttcgacttcaaaatttgaatgctatcttgaagccccaaaaaaaaaaaaaaaaacaaaaagg

SEQ ID NO: 14379 - DNA, 513 bp, Zea mays
  unsure at all n locations
  Clone ID: cC-zmpo148067e06d1
cggctcccctccggccacccagacatcgnccgnnctttcgcctttagacaggaccggagaccatggggggccagctgaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagcttcgccacgtgatgaccaacctcggcgagaagctgaccgtcgaggaagtcgatgagatgatccgcgaggccgacgtcgatggcgatggtcagatcaacttcgaggagttcgtcaggtcatgatggccaagtgagt

SEQ ID NO: 14380 - DNA, 550 bp, Zea mays
  Clone ID: cC-zmpo148067e09d1
gacaattggcaaggagattgttgatctgtgccttgaccgtattcgcaattttgctgacaactgcaccggcctccagggcttcgtggtcttcaatgccgttggtggtggcactggctctggccttggttctctcctccttgagcgcctgtctgtggagtacgggaagaaatccaagctgggcttcactgtgtacccatctccccaggtgtcaacctctgttgtggagccttacaacagcgtgctctccactcactcactcctggagcacactgatgtctccatcctgctcgacaacgaggccatctatgacatctgcaggcgctccctcgacattgagaggcccaactactccaacttgaatcgccttgtgtctcaggtgatctcatcgctgactgcttctctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatc

SEQ ID NO: 14381 - DNA, 316 bp, Zea mays
  unsure at all n locations
  Clone ID: cC-zmpo148067e11a1
caagcaaaaaaancataaatatgggctggggtacacacgtccctctcaagactcaaccacccctttcatcccacggactcaatacatgtgccacgccgcaagaggcaacaccgaaaaaaaagacacgcgctaagtccgcatgaagtccgcatgcgtccagtctatcgactgacagacacacgcgaccagcattaaattacatatgttttaagccggacgacgacaacaacgaccacggtacccaacccagtacggggtcgggaaaaacaaacaaacaaatcaatggacatgtccccaagggatcaagttggagagc

SEQ ID NO: 14382 - DNA, 642 bp, Zea mays
  unsure at all n locations
  Clone ID: cC-zmpo148067e11d1
ccgtagcatggctgagcctggcactgtttatcgttccgcggctgccgtcgcggtcctgggcgcgcgggcggcgtctgcaggcgggggagccgcggcggccgcggagatctgcatgaagactccgtcccccgacctgtgcaccaggacggggggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcacgacacgcagaactgcgacgaggagttcaggaaggccgtctccaagaaccccatggaggaccacaacaggtcgctcatcgagatgtccgagatctgccggacgctcttcaacatgatcccttacgaacatgtccattgattngnnttgttcttttcccgacccctactacgttcggtacgttgtcgtcgtcgtcgacgttcggcctaaaacatatgtaatctgatgc

SEQ ID NO: 14383 - DNA, 574 bp, Zea mays
  unsure at all n locations
  Clone ID: cC-zmpo148067f01d1
ccggggcggncgacggaggccaattctccaacttcctccctttgtctttcatccagcaccagcaggagaatggggtcgggtccccctctcaaccaagggcgcgcgcgcgtgcgtatgcctcctccagatccaaagcaacagacagcgagggggcaccggggtccgccgcatgtttgcgatttatggaggatcatgctttcttgcttactacattagctcctgacgcgccgccctcccctcgcgttcattgatttctgttataattactaccgagctactatctccacattattattggtaaagaaagaaagggcgcctcctctaatttgatgggcattccgtttccttctcaacttcaacgccaacaacagttgatgctactatggttggaaatcgggcatggttcggagggcttttcagcggctcaggcaaaaggcgacaagtcagtgcagagaagatagtgcttgatctaacccctgtacaggaacagagactgcaaagtctgaaggaaaggctaaatgtaccttacgacgaaactcggacggatcatcaagattcgcttagggctctatgg

SEQ ID NO: 14384 - DNA, 589 bp, Zea mays
  Clone ID: cC-zmpo148067f02d1
ccgccttcatcgggatggaagctgccggcatccacgagactttctttttctccatcatgaagtgcgacgtgggtattaggaaggacctgtacggcaacatcgtcctctccggtggcaccaccatgttccctgggatcgctgacaggatgagcaaggagatcactgccttggctcccagcagcatgaagatcaaggtggtcgctcctccagagaggaagtacagtgtctggatcggaggatccatcctggcatccctcagcaccttccagcagatgtggatcgccaaggccgagtacgacgagtacggcccatccatcgtccacaggaaatgcttctaattctttgggcccgagaaatgcaagccgtgggggagccgttaccgccgccagcctctcctgcccccgttttcgttgccgtttcttcattagcgcgaacaaagatttgtgccggtctatcggccgccgctttcctcccctattcatcaagactgcaataactgtcgctacctatgcttttcacctgtgattttttggacacaatatgttaaggtccattcaattctaatgagacgcctgatgaggctactagc

SEQ ID NO: 14385 - DNA, 463 bp, Zea mays
  unsure at all n locations
  Clone ID: cC-zmpo148067f03d1
acgcgnccgcccacgcgnccgcggaggggctcggtttcgttttcctcggcgngtgctactgcgccgggctcaggacgggccactctgncgnggcgaagcggctcaaggagatgaaccgggtgggcaaggaggacttcgaggagcacatgcggcggctgggccggctcagccaccccaacctcctcccgctcgtcgcctactactaccgcaaggaggagaagctgctcatccacgactacgtccccaaccggagcttggcgaacctcctccatggcggcggcgacgagcgcgggatgaagaaagcggcgctgcattgggcggcgcggctgaagatcgtcaagggcgtggcgcgggcgctcagctacctgtacgacgagctgtgcatgctaacggtgccgcacggccacctcaagtcgtccaacatcctgctcgacggtcaactacagccgctgctgacggacta

SEQ ID NO: 14386 - DNA, 545 bp, Zea mays
  Clone ID: cC-zmpo148067f04d1
ccgctggccatcgattgcattctggagaagctgcggccggtttagtttctgagcatggccgccgtctgccgcgcgcatgcgcgagcgctgccgcggcgaccacctctgggagcggcacatgacaaacaggtggggccgtgtcctgggccgcgccgccagggacgaatggaggacgcacctggcttccgccagcgagtcccgcgccgcgggtggcggcggcaagcgccggaagtggctcgccgcgctgtcctgcgtttgcccggtggtgtcctggatgcggcccagggccgacggtggcaagtcgtccgcccccgttttggacgattccatcatgtcgtggtacctgtccgtggagagcggcaagttctggttcccggctcaggtctacaaccgcgagcacgggcatgttgggttcatgatgtcatgctatgatgcagcgctcagttacgattttcataccgacacatttcgtgccaggtacccaccacacggtcgacgaaccgtggtgttggaggatggcgtgcaatggacaaggtgagggcacc

SEQ ID NO: 14387 - DNA, 515 bp, Zea mays
  unsure at all n locations
  Clone ID: cC-zmpo148067f05d1
cgcaaaananggctgngaatgngagcaccatgnggncgtttttgttttctcaagtngcganggntgnggcgggggccgtcttggtgagcggtgcatggtgcggtcctcccaaagtcccccctggcaagaacatcacggccacctatggcaaggactggttagacgctaaagcaacatggtatggcaagccgacgggtgccggtcccgacgacaatggtggcggctgcgggtacaaggacgtgaacaagccccccttcaatagcatgggcgcgtgcggcaacatccccatcttcaaggatggtctgggttgtgggtcctgcttcgagatcaagtgcgataagcctgtggagtgctccggcaagcccgtggtggtgcacatcacagacatgaactatgagcctatcgcggcgtaccacttcgatttggcaggcacggcgttcggcgccatggccaaaaaaggtgaggaggagaagctgcgcaaggcgggcatcatcgacatgcagttccgaagggtc

SEQ ID NO: 14388 - DNA, 487 bp, Zea mays
  unsure at all n locations
  Clone ID: cC-zmpo148067f06d1
ccatgcgatgagagccttgttcctcctggncctcttctgttttgtttttggngagaaggaagagtcaaagggggtcggggcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttccaactcgctggtgattgact

SEQ ID NO: 14389 - DNA, 547 bp, Zea mays
  unsure at all n locations
  Clone ID: cC-zmpo148067f07d1
ggcaaccaataatagcaagggggatcatccgntgatccatctttttatttagtctgcgggcccttcggtcttcctcgagtcgggcccgactactctccgttcggctccggcaaaccacatcaagtcgcgatggagatgaagaaggtcgcctgcgccggacctcactaccgacggcttcgccaccgtgagccttgccgacgaggccccggcgcccgcccccaccagcgcctcctcagacgcattcccggccgtctgcgccgcgctgggcgcctccgtgctctccttcttcgcctactacctgcactaaaattaaaggaggatcggagggagaggctgctggctgccattgcctgtattcggttggattccgtatatatatatatttaagtactttaattagggtctgaacatgtcgattgatccattcattctatctgcttagccattactcccttgtctgataatttcgatatgtaaagacgggagaatgggagacactattcgtttggacatgacaattgaaattaatcaatacccattgatagtt

SEQ ID NO: 14390 - DNA, 180 bp, Zea mays
  unsure at all n locations
  Clone ID: cC-zmpo148067f08d1
gctcgttcccccgtacgtacgtgacctgttttaattttatcatcaggcgtctagagcgtgttctttctttgattccgtatattgattaatatataatgacctgcaattatgcacatacatactgttctaatcatttatttagacccttgagcttactagctttnaaaaaaagcctgttgc

SEQ ID NO: 14391 - DNA, 484 bp, Zea mays
  Clone ID: cC-zmpo148067f09d1
gaaagacgggaatggttttattgaaatgtccgagttaatggtatattcttagtgatggtgaactaaagcctgatgagggattggttaacgacattattcaagaggttgacaaggataaggatggtcgcatcagttacccagagtttgaattgatgatgaaaaggtggattcggactggaggaacgcctctagacgttactcaacagagaatttcagcagcctcagtcaaaaactgtgcaaagatactttatgaaacaagaaagtagtttccaagcagcaattactgactgaagtaccacaccctcaactaaacagcatcagaagacaacgcaaaagcaggattactggatctggtggaaataagggttgaaggagatcacatataccagttgcatgcttgacaaacttcgtcaactagcaagccctctggcattgtcctttgctctggaagtaaaatttactattccaatagaatacatgactt

SEQ ID NO: 14392 - DNA, 288 bp, Zea mays
  unsure at all n locations
  Clone ID: cC-zmpo148067f10a1
gcacaaacaggacccccaacacacaggaacacaacagcaaaacaacaaacccagcgcccgccaggctcggagcaaacgccaaaacccccaacgcggcaccaacggaccgcaccccagncacccaccccacaccctaccttgctcgcagacgcaacttccgctgaacgcacactactgcgcggagcacgcaccgaccacaccgcggtacaaattatgtatgagtaagtatagggactcaccatacaagtagttattgcagcgtgccaccccatctagcgatcgaacaca

SEQ ID NO: 14393 - DNA, 543 bp, Zea mays
  unsure at all n locations
  Clone ID: cC-zmpo148067f10d1
ccggacgcgtggcccggcgtgaagatctcggngaagggggcctgtatcctcttgcactacggcacccggtcccacggggcggagctgactgtggggtactacaacacccggtcgcacgacgggtacgcgcccatcgcgcgcatgctggcgcgccacggggccgtgctcaacttcacgtgcgtggagatgcgcgaccacgagcagccgcaggacgcgcagtgccgacccgaggcgctggtgcagcaggtggccgccgcggcgcgggaggccggcgtgggcctggccggcgagaacgcgctgccgcgctacgacgacacggcgcacgaccaggtggtggccacggccgccgacagggccgccgaggaccgcatggtggccttcacgtacctgcgcatggggcccgacctgttccagcccgacaactggcgccgcttcgccgcgttcgtcaagcgcatgacggagcctggcgcgcgggatgcgtgccgggagcatgtggagcgggaggccgaaggcgtctcgcacgccacccagccccttgtgcac

SEQ ID NO: 14394 - DNA, 364 bp, Zea mays
  unsure at all n locations
  Clone ID: cC-zmpo148067f11a1
nnnnnnnnnnnttttttgttttgaaacngacaannaanngactgcggccacgcacccatgcaaagcaaggcaaggcatacattcatgcgtccaggtgatcacggagacgctgcggatgggcaacatcatcaacgggaacatgcggaaggcggtgcgagacgtggaggtgagaggccacctggtccccaagggctggcgcgttctcgtctacttccgcgccgtccacctcgacgccgccgtccacgacgacccgcacgccttcaacccctggaggtggaaagagaggcccgacgtcctggccatgagcggcttcaccccgttcggcggaggtcagaagctgtgccctgggctcgacctggcaagg

SEQ ID NO: 14395 - DNA, 350 bp, Zea mays
  Clone ID: cC-zmpo148067f11d1
gccttgccaggtcgagcccagggcacagcctctggccgccttctaacgttttgaagccgctcatggccacgacggggggcctgttcttccacctccaggggttgaaggcgtgcggctcgtcgtggacggcggcgtcgaggtggacggcgcggaagtagacgaggacgcgccagcccttggggaccaggtggcctctcacctccacgtctcgcaccgccttccgcatgatcccgttgatgatgttgcccatccgcagcgtctccgtgatcacctggacgcatgaatgtatgcattgcattgcattgcatgggtgggtggatgcagtcaattaattgtcaatttcaccgcct

SEQ ID NO: 14396 - DNA, 480 bp, Zea mays
  unsure at all n locations
  Clone ID: cC-zmpo148067f12a1
gagcggccgcccnnnnnnnnnnntttttttttttttnnnnnnnnnggaaccaaaaaagaggccgcgggatttaaccgccaacactttacactccaatgtcgatatccatcaaacccaatgtttacaatttacagacaatcatgaccaggaaacaaaaaagaattacccatattgagccctggggaaggacacccatattcagaggaaaaccagtgcatatatatcggctcagcgataaaaagaagaagaaaaaaaacccccaaaacaaaggaaaacacctgaatcaatcgggaacagaacacaagctctcaatactcccggaacaaagtagggacagcgacaactgaaacgtgtggctgacccaaaacaaaccagggtcgcgccaaggtttacaaaaatggcttcattcctctgactgggcataaatttccgagatgcggcggttcttgttatacccaaagtatctcttgccatcccaaa

SEQ ID NO: 14397 - DNA, 588 bp, Zea mays
  unsure at all n locations
  Clone ID: cC-zmpo148067f12d1
gctcaaagntgaagcatgtggcaggtcttgatgcgctgcattttctcttttttgactttcctccgnccaccgagacgttttagttcgaatagctagtaattttctggagcgttgccttcccacggtggctggagctactgattcagaagtgcaaaggcctgcgacgggtttgagttgcagtgtggtctgtcattgctcaggagctgcctcgacggtggcaagaactggcatctcgtgcagcagatccccgaggtgcgcatcataagctgcgatggcaagagatactttcggtataacaagagccgccgcatctacgaaactaatgcacagtcagaagaatgaagccatttctgaaaaccttggcacgacactggtttgttttgggtcagccacacgtttcagttgtcgctgtccctactttgttccgggagtattgagagcttgtgttctgttcacgattgattcangtgttttcctttgttttgcgtgntttttttcttcttctttttatcgctgagccgatatatatgcactggttcttctctgaatatgggtgtcctttaccaggactcaatatgtgtaattctt

SEQ ID NO: 14398 - DNA, 514 bp, Zea mays
  Clone ID: cC-zmpo148067g01d1
ccgcccacgcgtccgttcaagtcgcaggcggacaacttcgtttgcgttttgctgccggacacggcgttccaccaggtgtgcatcaccccgggcggcgtgatccacctccgcgacggcgccaactcgcagtacgtgaccagcacggcgttcctgctggtggtgtacgcggacctgctgctgcggacggggcagacggtgctgtgcgggaaccagccgctgcccccggcccggttgcacgagttcgcgcggcagcagatggactacctgctgggcgccaacccgcggcacagctcctacgtcgtgggcttcggcgccaacccgcccacgcagccgcaccaccgcggcgcattcacccccgtgctgccccccggcacggacgtcaactgcggcctcagcttcggggactggatggcgcccgacaagcccaacccaaacgagctcaccggcgccatcgtcggcgggcccgacagaacgacggcttcgtggacaagcgcggaactccttctacaccgag

SEQ ID NO: 14399 - DNA, 514 bp, Zea mays
  Clone ID: cC-zmpo148067g03d1
acccgtccgacaagatggcgtgcacagacaatgcgatgagagccttgttccttttggtcctcttctgcatcgtgcatggggagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaagggaaaccttgacgggcagggccccaccgtgtggagcaagaactcctgcaccaagaagtatgactgcaagatccttcccactcgctggtgatggac

SEQ ID NO: 14400 - DNA, 465 bp, Zea mays
  Clone ID: cC-zmpo148067g05d1
ccgagcaattataatctcacagaataataaacatcatggggttagctttacggctcgtcctcctcgccgtcggggcgctggtgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcgcggcgcagcgggccatcacgttcaaggacaccggcaccgccaagatcatgctgcagctcg

SEQ ID NO: 14401 - DNA, 114 bp, Zea mays
  Clone ID: cC-zmpo148067g07d1
gcactccccctgcaactgcacattaaacacggccagtgtggtgcctacgcgcaacgtgaccgatacacttgccaacacccaaacgcccgctcctttcccttaattcccttcctt

SEQ ID NO: 14402 - DNA, 270 bp, Zea mays
  Clone ID: cC-zmpo148067g09d1
cgcgtccggatttactgaccagaagttccaacattttttctgttgatgacacctgacgcatttgatgcggaatgggcatcatacgtgcgagctattattaactgctgcaaggctagatccatgggattcagaggcgacacaagaactgatgactccacgccttggtttctgcctaatatgttcgccgatctgcctacttttaagcacgggctttttcttgtcttccctgtaactataatataataatgtatattatatacaagacgatac

SEQ ID NO: 14403 - DNA, 281 bp, Zea mays
  unsure at all n locations
  Clone ID: cC-zmpo148067g11a1
ggttataaagggangagtatctattatacgtgggaggtcagacccagtgccgggaatgagcactacaccaggctatctagtttaccagtgcatgcatgccagcaaagtttgacacagcagctgaaacaaaacccaaggactagtccttgacagtgaacctagtgttgttcacagacccattgatggaatggaacccagctggttcgtgtacaaaggcgacgaggccatcctccttttcctaaggcgctcggcgatgataaatgccatctccagagactgtg

SEQ ID NO: 14404 - DNA, 278 bp, Zea mays
  Clone ID: cC-zmpo148067g11d1
gacagtctctggagatggcatttatcatcccgagcgcctttgaatttgaggatggcctcgtcgcctttgtacgggaaccgtctgggttccattccatcaatgggtctgtgaacaacactaggttcactgtcaaggactagtccttgggttttgtttcagctgctgtgtcaaactttgctggcatgcatgcactggtaaactagatagcctgctgtactgctcattcccggcactgggtctgccctcaaagtataatagatactcatcactttttgacc

SEQ ID NO: 14405 - DNA, 262 bp, Zea mays
  Clone ID: cC-zmpo148067h01d1
tccgcccacgcgtccgcagatcgatcgattacagcaatggctttcattgtgttcctcctcctccgactcagcagggtcggcgtcgtcctggctgccatcgccacagtagtgctcgcggaggaagccgatccgcgggcactgccggcacagtggaccaccgcgaagaagtacaaggccacgatggacgccaagacgcggcaggctttcgacggggtgggggccgccgctacggaagaaaagcggtcccaggcggtggaggccg

SEQ ID NO: 14406 - DNA, 468 bp, Zea mays
  Clone ID: cC-zmpo148067h02d1
ccggagagagacgcaggaccgccggcgacgatcgaggaggtgttgatttctatacccggcggcggcgatcgatggctgggggcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccaagttcggcaagcctctgtggtacaaggggtcgacgttccacaggatcatcccggggttcatgatccagggaggcgactttaccaacggcaaccgcacggggggcgaagtcatctacggcagcaccatcttttccg

SEQ ID NO: 14407 - DNA, 506 bp, Zea mays
  Clone ID: cC-zmpo148067h03d1
cgcgtccgggccaagctcaggtctattgattgttttcacttttacttcggaaagggcacttgtccgggtgggagcagctgtttttacaagcatgcctacgatgatggccgtttggaagacgctttattgaatcatcatgatgccgacgatgcaagcgcagcgattgccaaacttatgaggttgtcgtacttactgactcggctgcatgtgtaaggaaactcaaacgtatctttgagcaaacattgctgagttcgattggagttcgttgaccgagcaggcaaccttggatttcgctttgtaatggatattataaaaaacatccaaaaaaaagagggcagtcatttctgaattttatcttttcgctgaatgttcaaatcatcagaaggaagcagtcccaatcgtgccacttccacttggaagctagcattttctatccgggttggtacctgattggtggttgtgaccaaacttaactatacccaatactggtgatcctcgtttgttgc

SEQ ID NO: 14408 - DNA, 564 bp, Zea mays
  unsure at all n locations
  Clone ID: cC-zmpo148067h04d1
ccgcccacgcgtccgcggacgcgtggggacgacggcaactgttttgtttttggcggcaaggagacctccacgcggtccggcctgcgcaagctgctgcagtccatcagcttcaacgagagggtgcagcagctaacgggcggcagccccgcgaagaagaagtccaccgtcattcgcctctcgtacaagacgacgtcgtcgtgcggcggggacgactacgaggacggcggcggcggcggaggcggcgaatgcggtagatctaagaagtacgttgttcgtccgaaggtagggcagacagtcccgtgcggaggagagaggccggcgacgggatgctggtcgcggatggacccgtccctcttcaagctcaggagcgacaccttcctaaaagacaagaagaaatgcgcggctccaaactacgctgcctactatccgataggcgttgacctgtttgcctgccccaagaaggtccatcacatcgcccagcacctcgaccttccgcagatcaagacgcaccccaagatcccgtcgctcctcatcgtgaacatncagatgcctacctaccccgct

SEQ ID NO: 14409 - DNA, 336 bp, Zea mays
  unsure at all n locations
  Clone ID: cC-zmpo148067h05d1
ccggaagccgngctgaaggccggccggngggcgtcagatgctgctttttctagctcatggcctggccatgcggggtggggatggctgcgtttcatttcatggaagaaagcaaggatggatcacaggttgtcgntctgctaattaatctacgtttgccttcaagtactgtgttgtggcattgttacacatcacagtacagtttggtcattttttttcccacagaggaagtagggattgatttaatcccacacgcgtgtatctacgtatacagtttgtataacatgaaccacctctgtttgcgattggtctaaaaataaatataatacttatatattg

SEQ ID NO: 14410 - DNA, 479 bp, Zea mays
  unsure at all n locations
  Clone ID: cC-zmpo148067h06d1
cgggatccacccggccgagagcacaacgtgtaccgnctctttccagtgtgcgcgcgcgcgtggtcggaggctggcgtgggtcgcgtcggccgcccccggcccccgccggccagcgagagcgagggacaacgaccgaccgaccgaccagctcgaggtgaatgaacagccgcataccgttcctccagaaaatgcaccgctggatcatccctagctgcggcgacatccgccagccgcgcccttcgtcccgccgtcgagatgcgttcccgaggccggcgtctgcgtcggcgtcggcgtcggcggccccgtcccctcagaagctgaggaaggtggggtcggaggggacgctggtgctgtccgtgcccaaggacgtagaggagatccggaccatgtcggcgtacggccgcctaaagctcttcacctaccacgagcctaggaaggccaccggcaacttcaacccggggcagatcgtcggcgagggc

SEQ ID NO: 14411 - DNA, 598 bp, Zea mays
  unsure at all n locations
  Clone ID: cC-zmpo148067h07d1
gccggccacccccctctgtccctctctctgcttccattcacttcactattgtagcccgcttccacgttggtctcggggagaccgtccatatgccgtagcatcagctcagttgaatcgccacgcccaaggcacacgtatgtctcgcgcgctcgcgcttgcgatcctcctcctggccgccgccgccgcggtggcgccgctggcctccgccggcaccgaggagttcaccagcgtcgggtccagcggcggcaagatgttcgacagggcggtcggagccgatcccgacccgtccccggccggcggactgccggccgacccggcgcccgacgcacgcccctaaggccacgcacgcaccgtcgtacggccccgtttccgtgtacgcttcacgcgctggtactctcgccgcccgtttccgtcgcccctaagacgtagtatgttcatgaacacgacgcgccttgtacatgtctctggaatgtgcagcctgcatgtgttttgctcgcgagccgtttttcttttgctgtcgaccgatcgtgaantcgtcacgcagcactcagcagtactgagcttagcattctgccgtcagtgtggaaatggcactctg

SEQ ID NO: 14412 - DNA, 628 bp, Zea mays
  Clone ID: cC-zmpo148067h08d1
ggaggagaaccagcagcctccaataatagccagccagagatattaatattattctcaccgccgccatccgagagaagaggccgaccgacctcgtccccaaggcaatccgtcgccgacgtaccaccgccaccgcaggagctgagatggagatgaaaaggatccctctttgccgtcctcgtcgtcatcgccgcctcggtcaccgcagtgctggtctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctgcctcctcgcctactacctccactaagcgtgtgcgtgcttacgtacgcgcgcatggacgacgatggatccgtccaccgttgccattgcagttgcctcgctcgttcttggtgactgttgcttcggtggtcgacttggaagacgtcacctgcaccgctgtttccatatattattattgatgtgatctgatatgaatatatatgcctggtgacgggttgcgttaaatacatacacgtgatttaatttatctattt

SEQ ID NO: 14413 - DNA, 571 bp, Zea mays
  unsure at all n locations
  Clone ID: cC-zmpo148067h09d1
gccacgcgtccgcccgaccccaaggccgaacgggggaagttttgcagtcccagcctccgggtagcgcagcgggggcgggaggtcagcttcccgcctcgtctgggtcggttcggccccgctccgacgcgtggtgggcgcgagcgcgaccagtctgcgaccccccggcttcagtcagcgttagtgaggttgaggctctattcgagctgttcaagagcataagtggttcggtgattgatgatggcctgatcaacaaggaagaattccagctagcactatttaagaatcagaggaaagaaaatcttttcgccaatcggatatttgaccttttcgatgtcaagaaaaggggtgtcattgattttggtgactntgtccgagctctaaatgtgtttcatccaaatatcccaatggaagaaaaagtcgatttctcgttcaagctatacgatatggatggcacagggtttattgaacgaaaggaggttaagcagatgttaattgctctcctaggagaatcagaaatgaggctatctgatgagatcattgagacactcctggatgagacattttcagatgc

SEQ ID NO: 14414 - DNA, 396 bp, Zea mays
  unsure at all n locations
  Clone ID: cC-zmpo148067h10a1
accgaacngangcgcatatatcgccacggcaggataatttatatggcagataaccaaactatctaaattagatgacacaatgctaaacagatagcaacactgctaagatcaagatcagggacataagccttttctactatgtgtaaccttcttatctttatcatatgtaacttctgacttctaacacattgctggattcgagtgtataaaatcccttacaaacttgtggctacatcacaaataatctctaactagatatatacatggaggcgtgcatgtaccatagtctgtataatgagatgcaagttcaatttggtcgccgagaatgactaatactgctgcttgcgacggaggaggatccaatgatgtcaacaacagcatcgccattgactacac

SEQ ID NO: 14415 - DNA, 590 bp, Zea mays
  unsure at all n locations
  Clone ID: cC-zmpo148067h10d1
gggacgcgtgggtgggtgcgctgctcaacgtcaagggcttttttgttttcctcgccatcaactttgggaacaagagcaacggatggggctagaccatgcaggtggtgcttctcctatcatccatcatcaacacgttcatggccgggccggcgtccgccggcatcgtccgccagcagcgtcgtgcctaccactatcgctcacgctgcctcgaggaccttagcctggcccacgagcttcgtatgctcgtatgcacccacggtgccactagcgtctactcgatgctcacgctcagtcacctctccaggggcagggcaccagtcgtcgccgtgtacctgttgcaccttgtcgagctcgcgacatcgcgcaagtacgccatcacgcagcagctataccacgcccgggatggtggcgaggatgaggacgagtggggctacgcacgtgagatcgagcatgtggcctccgccgtggccaccttcacctatgacaatgccatcctcgtgcggcagatgacggccatattcagcttgggctctatggacacagacgtgcgcaactgtgtggaggatgcgcgtgcgtcncttgtgatcatg

SEQ ID NO: 14416 - DNA, 413 bp, Zea mays
  unsure at all n locations
  Clone ID: cC-zmpo148067h11a1
nnnnnnnnnntttttttttttttnncaaaaaaaaaaggcgagagggaagggtttatataactcccattacaatgatttttccgaaaaccccagtacagtgatttgagagggcatgcatctcaagattacatatatccattcatttggtccccttcactacccttctttcgtatttgttcttttgagtttggattggatggtcagaccacgaggagaaaacgaggccttcttcgtattaacgcgcgggggcgtaagacggcggcagcggcaaccccaccaccttgccgcagaagagggccttgtccggcatgttgtactcgtcgcgcagagatcgcgccggcgagaccacactaatgtaaaactgctccccgaggtatcccccccccacatgtttggaatgcaccctccacatc

SEQ ID NO: 14417 - DNA, 272 bp, Zea mays
  unsure at all n locations
  Clone ID: cC-zmpo148067h12a1
nnnnnnnnnatttttttttttttnncanncaaanaaacaaaacggggncgggcagaanttaaaacccgcagccaaccaaccaaaaaaaaaagcccccgggnaaaaaaaaaaggggcccccaacaaaaaaccccaaaaaaaggccaaaaaaaaaaaacccgcccaaaaaagggaaccggggggcccaacaaacccccccccacccaaaagaccccccccccccccaaaaaaaaaaaaacccaacccaagcggggcaacgaaaccgaaaaaccc

SEQ ID NO: 14418 - DNA, 559 bp, Zea mays
  Clone ID: cC-zmpo148067h12d1
ggcgagatcgagggccaccacgctcacgtcggcggccatcgtttgccatttctgcgccacctgggctcagagcaccggattccgcgagttctagcccgaggagatggctgccatcacgaaggatttcgacgagccggggcacctcgccccgaccggccctgatacttgggaggcaccaagtacatggtcatccaaggcgaacctggagctgtcatccgtggcaagaagggatccgggggcatcactgtgaagaaaacagggcagtcactcatcattggcatctacgacgagccgatgactcccgggcagtgcaacctggtggtggaaaggctgggcgactacctgctcgaacaggggatgtaatgacaaccccttcccctggaatgcatgttgatgatgttgctggttccaacttcgttttcagtaataataacaacaaagcgaagaccctcctacctaccctatttgcttgagcggctcttgtccgcgccacaagataccaattgttgcgctgggaatattcagttacgatgcccccgcttagttcagtttttttttt

SEQ ID NO: 14419 - DNA, 522 bp, Zea mays
  unsure at all n locations
  Clone ID: cC-zmpo148068a01a1
ggntgttatacttactcattaatcatcaaaagttgagccacagacatcggtatacattttagatatgcgaggcaccaaacatcagttgccatgcatacagtaacgatcgacgaccaatgtataatgcatgtgtgtaatatatacacacacgcggtaccacacgctgaggcctggtacctgcacgcgcgtgcgacattgacattgcgcgcacatcgaccagagagatatgatcagccgcgacagccggtgatcgggttgcagccgcggctgtagacgttggcggttttccctgggcgggaggcctcggcgcccaagttcttgtcgcagttgcccagtaccttgcagctgatcaaattgtcaaatgacaccatcccctcggcgctgatggccccctgcggccctgtcgctaacaggaggcacagaaccaccgccgctaccaaggccagcctcgccatgttcgtcaccttcttcctacctgcgtgtggtgctacggtggtggtatcttgctcctcttgcaattga

SEQ ID NO: 14420 - DNA, 537 bp, Zea mays
  Clone ID: cC-zmpo148068a01d1
tccgctcctcgatccatcaattgcaagaggagcaagataccaccaccttagcaccacacgcaggtacgaagaatgcgacggacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacacatgcattatacattggtcgtcgatcggtactgtatgcatggcaactgatgtttcttgccttgcatatctgaggtgtatcctgatgtatgtggctcaacttttgatggataatgattagtatgacaccc

SEQ ID NO: 14421 - DNA, 401 bp, Zea mays
  unsure at all n locations
  Clone ID: cC-zmpo148068a02a1
agcgggcgncctttnnntttttttttggnngncatactttatcattaaccagcaaaagttgacccagagacataagtatacattttatatttgcgacgcaccaaacaccaattgccatgcatacagtaacgatctacgaccaatgtataaagcaatgctgttataaatacacacacgcagtaccacactctaatgcctggtacctgcactcgcgtgcgacattgacattgcgcgcacatcgaccagatatatatgatcatccgggacagccggtgatcaggttgcagcccccgctaaagacttttatcattttccctgagcgggaggccttttccaccaaattaatgcctcaaatgcccaatacctttcaacttatcaaattgttaaatgacaccatcccc

SEQ ID NO: 14422 - DNA, 554 bp, Zea mays
  Clone ID: cC-zmpo148068a02d1
ctcgagccatcaggtgcaagaggagcaagataccaccaccttagcttcacacgcaggtacgaagaaggcgaccgacatggttaggctggccttggtcgcggcggtcgttctgtgccttctgttagcgacagggccgcatggggccatcagcgccgatgggatggtgtcatttgacaatttgatcagctgcaaggtactgggcaactgcgacatgaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgcgtgtatatattacacacatgcattatacattggtcgtcgatcgttactgtatgcatggcaactgatgcttcttgcctcgcatatctgaagtgtatactgatgtatgtggctcaacttttgatgattaatgtctagtattacaacccactaaaaaataaatggctgccct

SEQ ID NO: 14423 - DNA, 416 bp, Zea mays
  unsure at all n locations
  Clone ID: cC-zmpo148068a03a1
acncaanaaaaccaanttttaggttncagtttaaattaaaaatccaggacctgcctattaccctttttttggggggaaaaaaaggtgtttcaaaccctttgaaattaaaaatttctacccaccccaaaaatactaacgggcccttgtgttatgttgcttccagataaataaaatttggagtttttgcatgggaatttttcttgaacaaatccattttttttttcccgtttaatgcgggcgtgcccccccaaacaataattattttggcctggggcctggggtcaatcgtccccaaaacactatttaagggccgaaaccggggccgttttttttacatgttatttcgacaccgttttttttggcaccttaccctttcccaacaccattttttttaagggcttttcccggattatttt

SEQ ID NO: 14424 - DNA, 621 bp, Zea mays
  Clone ID: cC-zmpo148068a03d1
cctcgaccatccctgcaaattaccgcgatggctcccaaggttctagttatccttgtgttcctcgccgtggcctgagcgggtgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatcctccccacgctgctctccgtcaccgacaagaaactcggcgtcctcaactacaccagggccgacgacgggcagatgtacttcggcgctcccggagccccctgcgtggccaagctcgtcaaggtcgtcgcagcgcggccgtactctgtgtccatcatggagatcagcgagcccattttgccggccgcgttggcctcccccgtcgcggcgccccgttcgccgcggcaagggtggtaagcgcaagatcaagccttagcggtaacccatgaggatttcaacatg

SEQ ID NO: 14425 - DNA, 448 bp, Zea mays
  Clone ID: cC-zmpo148068a05d1
ccccaaggactggctggacgctaaagcgacatggtatggcaagccttttgtttccggacccgacgacaacggcggtgggggcgggttcaaggacgtgaacaagccctccttcaatagcatgggcgcatgcggcaacatccccatcttcaaggatggtctgggttgtgggtcctgcttcgagatcaactgcgataagcctgtggagagctccggtaagcccgtggtggtgcacatcacggacatgaactatgagcctatcgcggcgtaccacttcgatttagcaggcacggtgttcggcgccatggtcaacaatggcgaggaggacaatctgcgcatggcgggcattcatcgacatgcagttccgaagggttaagtgcaagtacgacttcaaggtcacctttcaccttgaaaaggggtgcggccccaactacctgacactgctggtcaa

SEQ ID NO: 14426 - DNA, 559 bp, Zea mays
  Clone ID: cC-zmpo148068a07d1
caagggcgcaaccagtaatagcaagtgtgatcatccgttgatccattttgctaataagcctgcgtgcccttcggggttcgtcttctcgatcccgacgacgctccgctcggctccggcaaaccacatcaagtcgcgatggagatgaagaaggtcgtctgcgccgtcctcgccgtcgtcgtctccgccaccgtggtcctcgccgccgaggccccggcgcccgtccccaccagcgcctcctcagccgcgttcccggccgtcggcgccgcgctgggcgcctccgtgctctccttcttcgcctactacctgcagtaaaattaaaggaggatcggagggagaggctgctggctgccattgcctgtattcggttggattccgtttatatatatatttaagtactttaatttgggtctgaacatgttgattgatccattcattttatctgctatgccatttctcccttttctgttaattacgatttgtacagaggggaagatggtagacactattccgttggacatgacaattggaaattaatcaatacccattgttagttaaataa

SEQ ID NO: 14427 - DNA, 524 bp, Zea mays
  Clone ID: cC-zmpo148068a09d1
gcgatcgtcgacgtggcgggggccgacggcgaggacgccattgacattcactccggcaagaaggccggcgacgagttcggggtcccgggggaagcctccattgccacgaccggcaagacggacgagtccctgtgcgcgcccacgtcgtacaatgagtcgagtgagaagacgctcttccaggccaccaatggcaccgagaaccccaaggaggtgttccacagcgttgccaaggtggcgctggagtcggtgaaaacagcggtcgagcagttcaagacgatcggcgaggctaatgccagcgactccatgaccgatagcgcgcgggaggactgcaagaagcttctcgaggacgccgttgacgacctcaggggcatgctcgagatggccggcggcgacatcaaggtgcttatcagccggtccgacgactctcagacatggttcacgggcgtaatgacgttcatggacacctgtatcgacggcttcgtcgacgagaagctcaaggtctacattgcacaccgtgctgcgca

SEQ ID NO: 14428 - DNA, 356 bp, Zea mays
  Clone ID: cC-zmpo148068a10d1
gggcaccagcaagagggtcaactggcccggcttccacgtcatcttacggttaggaggccgagccgatcaccgccagaccggtcatcgacggcgccatgtggctcaagtacaccggcgcgccgcacatacttggtttcaagttctaaaggccgcatggcatggcatacatcacatcatatatagtgaggtggcacacacgctcgcgcgcgcgcgcacacatgtttgtgtgtatgtacaatgactgagacttgcaaacagaggggtcggagaacaggagggctgacatttgtaccttcaaaaataaaaactcctattaatattaaatataactataatttaactaaaacctataaaaa

SEQ ID NO: 14429 - DNA, 578 bp, Zea mays
  Clone ID: cC-zmpo148068a11d1
gtccggcaatcgtcgactgctgctgcgttctgttccgttcggaagaatttcttttagagcttccgggtggagagccctgaggtgaattacggcgacggcgagatccagccggagtaccgctacgacaccaccgaagtcgtcccgccggggaatggcggcggcgcggggtgggtggtgcgcccaaagtccgtcacctacaacttcaagaccagcaccaacgtcccaaagctgggggtgatgctcgtctgatggggcggcaacaacgggacgacgctcacggccggggtgatcgccaacagggaagggatttcgtgggagacgaaagagaaggttcacaaggccaactacttcggctccctgacccaggcttccaccatcagggtcggctcccacaacggggaggaggtctacgcgcctttcaagagcctcgtgcctatggttgaccccaactctatcgtgtttggtggatgggacattagtcagctgaacatggccgacgccatggccagggccaaagtcctagactttcacctccagagcagcttatgccctacatggaatccatgctggcactccct

SEQ ID NO: 14430 - DNA, 584 bp, Zea mays
  Clone ID: cC-zmpo148068a12d1
tccggcaatcgtcgactggtgctgcgttctgttccgttcggaagattatctttgagagcttccgggtggagagcccagaggtgatgtacggcgacggcgagatccagtcggagtaccgctacgacaccaccgaagtcgtcccgtcggggaatggcggcggcgcggtgtgggtggtgcgcccaaagtccgtcacctacaacttcaagaccagcaccaacgtcccaaagctgggggtgatgctcgtcggatggggcggcaacaacgggacgacgctcacggccggggtgatcgccaacagggaagggatttcgtgggagacgaaagagaaggttcacaaggccaactacttcggctccctgacccaggcttccaccatcagggtcggcttccacaacggggaggaggtctacgcgcctttcaagagcctcgtgcctatggttgaccccaactctatcgagtttggtggatgggacaatagcaagcctgacatggccgacgccattggcagggccaaagtcctagactttcacctccagaagcagctcagccctacatggaattcatgctgtcacttcctggcattt

SEQ ID NO: 14431 - DNA, 269 bp, Zea mays
  unsure at all n locations
  Clone ID: cC-zmpo148068b01a1
aaccaaaggccgcccctaacccaacagcgctactcggaaacacaaaaaaacaccttgtatacaaaaaattttaaattaccaggctcattcaaaaataaagnggttaaagcctaccaaaccatgttttgaaaatagcaacacaagcacctaaaaaggccaccaaaaaaaagaaaataacgccaagtcccctccaaactgggaggccataccaaccatttttatcaaacaaacacaaaggccccttgaccccaactaatgaaaccactgca

SEQ ID NO: 14432 - DNA, 579 bp, Zea mays
  Clone ID: cC-zmpo148068b01d1
gcaacgtgatcctccacaacctgcacgtccacgacgccgcgttgcattgcggcggcgcgatccgggactcgcaggaccagtggggcgtgcgcggggagagcgacggcgacggcgtctccgtgatggggtccagcgatatctggatcgaccacctgtccatgagcagctgcgcggacgggctggtggacgcggtggacggctccaccgccatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcatgttcaaggaggtgaccaagcgggagtacacgcagtacagcgagtacaagaactgtgtgtggaagtcgcaggacgacctgtttcttaacggtgcctttt

SEQ ID NO: 14433 - DNA, 492 bp, Zea mays
  unsure at all n locations
  Clone ID: cC-zmpo148068b03a1
acagtcgcctcccgccganccgatccatgaagaagngggttggctttttacaccagcttattggaatgtacagagttaccccacccccctagcgcatcttcattttaagggcccgtaattcgatgtttacagtttgcatcccgtgctgcatcaccgccagacagtctgaaggaaggaaccagctgcaccggccccctcatatggcgtagatgcggtcgacctccgaatccgagagctccgagttgtggtgccacgagttcgagccgctcctcctcgtcgacttcaccttcttcctgatcttgcgcacgcgcttggacttcaccacgtagtacgtcattgtgccgagcacgccggccatgatcaccccgccgatcagggtcaccaggagcgccgcccacttgaaatgcccccccaccaccatgtaccatgaggatatgaacgcgaccgttgtgcaaaccgangccagccacatcaacttgttgatgaccccca

SEQ ID NO: 14434 - DNA, 556 bp, Zea mays
  Clone ID: cC-zmpo148068b03d1
agagcaaaggagcggaatgggcctcgggatgagctcagattttcttttacagagatcaagaaggacgtgcacagtcagggttgagcaggccagaaaaaccaacaagaatgtctacggcatcgcgaaggagctaaggaaactccacagggagggcatcaacaacgcgacgaattcagtcacggtcgtggcggtgctcttcgccacagtggcgttcgcggcaatcttcacggtgcccggcggcaacaccgacgacggcgtagcggtggccgtgcacgcgacgtcgttcaaggtgttcttcatcttcaacgcggtcgccctcttcacgtcgctagcggtggtggtggtccagataacggtggtgaggggcgagaccaaggcggagaggcggttggtgggggtcatcaacaagctgatgtggctggcctcggtgtgcacgacggtcgcgttcatatcctcctcgtacatcgtggtggggcggcactttaagtgggcggcgctcctggtgaccctgatcggcgggtgatcatggtcggcgtgcttcggacgatgacgttct

SEQ ID NO: 14435 - DNA, 539 bp, Zea mays
  Clone ID: cC-zmpo148068b04d1
tccccggacgcgtgggtttggtcagtcacattgttcaatagacatattttctattaaatatgcagggcatcgtagaagagagggggtctcccttccaaaaagcaaaacaaaacaaactcgtatagtcgatcgacgaccatgcatcacatttccttttcctcgatcttctcttatttccgcagaaaaacaacgaaggaaacccaaccaaggaaacgcatgctattgcttaagcatcgtcggaggagctggtcgatcgctcgctcactcacgggcctgattgttccggtcacctgtcgtcgtcgtcgagctgagacacgctcctccagaagcccgtgccgtagaacctggcccacacctccttctcaagctcccccgtctcctccagctgcaaggcgggcttcaccggcagcgccaccgcctcgacggcgctggcgttcaccttgacgacgacgccggcgttgtccaccgggagctcgtagatctccgtggcctgccccacggaagcggagcgccgtcggccgcccttgctcgcgcgggcc

SEQ ID NO: 14436 - DNA, 485 bp, Zea mays
  Clone ID: cC-zmpo148068b05d1
cgcgccaagcgggccctggagctggagtgccccggtgttgagttctgcgccgacatcctcgcactggcggggggcgtgctgatcaccatgaccggcgggccccggtacccggtcccgctggggcgcagggactcgctgtcgtcgtcgcccacggcgcccgacgtggagctgccgcacgccaacttcaccgtggaccgcctcatccatatgttcggcgccaaggggttcacggtgcatgagctggtggcgctgtccggcgcccacacgctgggcttctcccactgcaaggagttcgccgaccgtctctacaacttccgcaaccagggcgggaagccggagcagttcgaccccagcatgaacccgtcctacgccagggggctacaggacgtgtgccgggactacctcaaggactccaccaatgtcggtgtcaacgacattatgacccccggcaagtttgacaacatgtactttgtaaccttgagcgc

SEQ ID NO: 14437 - DNA, 610 bp, Zea mays
  Clone ID: cC-zmpo148068b06d1
gtcccaccacctttaccaccgagagagagaaacgcgagcaaccagcgatttccctatggccgccatggctcgttccgtctcgggcgtcgtggcgcccctgctcctcctctccctcctcgtctccgccgcggccagcgcgcggaccgtgggcgacaccgtgcaggacgcgtgcagcaagacccagttccccaagatctgcgtggacagcctcgccgtcaagccggagagccagaaggcgacgccgcgcaagctggcggagctgttcgtgaacatcgcggccgagaaggggtccgggatggccaccttcgtgcaccgcaagtacagcgacaaggaggacagcgacatgatcaggtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaactttagcctcgacttcgagaagctgcagcgcgtcacgctcgacctcatcaccgaagcgtccggcaccatg

SEQ ID NO: 14438 - DNA, 446 bp, Zea mays
  Clone ID: cC-zmpo148068b07d1
ccggacgcgagggcgacgatggcgtcgaataagacggtcctcattgaactttcgatgctcctcatcacgctcgcgcgggagggcgtccctccggcgaccgccatggactgcaaggccgggtgtgacgaggtcacgggcccactccacattgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaactcaccgatctcgatggattttgtaatcgtgctcacttgatcgagagatcgatcgatgcttgttattatatctgtattccacaatatatataagaaatacaaatttatatta

SEQ ID NO: 14439 - DNA, 481 bp, Zea mays
  Clone ID: cC-zmpo148068b08d1
cggagagcgggcagaagggcgagcactttgacctcaccatattggttttcctcaagatcgccgaggagaaggcgggcagggttcccatcacctaccgcaaggtggcgcgcgagaggaaaggcggcatccggtacacgatcacagggaaccagcactacatcgaggtgaacgtgaccaacgtgggcggcgccggggacgtggtggcgctgtgggtgaagggcaacaagcgcgtcaagtggacgccgatgaatcgcatctggggccaagatctggaccactgaggtcgacctcaccggtgagtcgctgacgttccgcgttatgaccgtcgaccacctgaaggctacctactggcacgtttcgccccgcgactgtgagtttgtcaaaacgtaccaggccaccaagaacttctatgggtcgtaatcggggaagctgactctcggcccttattttattcggtgtgattaaacataattgtctaatt

SEQ ID NO: 14440 - DNA, 511 bp, Zea mays
  Clone ID: cC-zmpo148068b09d1
ctcggcgagctcctgccgcatgtggtttccgcgcggccacccatggggctcacgcaccaggtcgagaaggccatcgacgcgggcaccttcccgctgatgctcgacatcaccgacaaggactggcccgtcgaggaggccgctcggctacgcaaagctcgcgctcaagtgcaccgagatgctgcggagggaccggccggacctcgtaaccgtcgtactgccggagcttaaccggttaaggaacctcggccacgcgtacgaggcacgcatgagcgccgtcggagccaacagtggaagtggcgaaagtaatgaccaggtcagcgggagctcgccgactgcaggtggatcatggagaacggcggagagctagcgggttggtacggcgtggccatgagtcaattagagaagcagcctctgatgcggagagttctttttgatggacggagagttcaaaaatcaaaaatcttggggtatgtacagctggctattaggaatactaccacgtctttgaagt

SEQ ID NO: 14441 - DNA, 463 bp, Zea mays
  Clone ID: cC-zmpo148068b11d1
aaaggtctgttggcaatgcttcatctcatgcattacgactttcggttctaacggcctataccgactcagcggagaggggaacaacgaaaaacaggggcagaacaaagcgatttggaggcaccagaggctgcgtgctcatgatgctgtgctcgtcggcgacactggcgccggccgaggacccggacctgtacttgtagaggaatgcaacgcacagtaccaatacagtgctgggagtgcgcccacaaggtcatgaggatctacggagagttactgggccccaggataaccagactactgcaatacacacaacaggtgtaacgtggataacgagctggaccaatcgctatgcataacctgaagcggcaagcggcacaagacgaactactggatggacgggatgccaatcacgcactgcgcgatcctgcctagcagcaactttgacgacaagcggcggcccaaggac

SEQ ID NO: 14442 - DNA, 415 bp, Zea mays
  unsure at all n locations
  Clone ID: cC-zmpo148068c01a1
aatattatactgtctgcatgcctttntattattatccatgcgatgtgtgaaaatcacacatttgcgtgacattacattccgagttccatcgacggtatatttggaaaaaaaacaattttctttaaaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatgcatggttcattcatttcaaggggcttcgcttcaagaaggaggaggggtgcacgacctcttgcagttctcgctgaggcgcgggttcttctccttggcgcatgtgacgctgcaagccttggtgaccttggccgcc

SEQ ID NO: 14443 - DNA, 428 bp, Zea mays
  Clone ID: cC-zmpo148068c01d1
cggccgaggtcaccaaggcctgcagcgtcacctgcgccaagtttgaattttcccgcgcctcagcgagaactgcaaggggtcctgcacccctcctccttcttgaagcgaagccccttgaaatgaatgaaccatgcatgcatgcatgcatgtatgcatgcgccggggtgacgtggcgttcagctcatgcgctgagcgagtctatacgtacgtcgtcaccggctggccacgcatgcgataaccatctgatatggacggaactatatattgtattcctattaatctggcattttctaagctaattgttttttttccaaatataccgtctatggaactccaaatgtaatgtcacgcaaatgtgtgtttttcatcgattgaatggataataataaaaaggcatgctggcagttactactaaataaactataaaa

SEQ ID NO: 14444 - DNA, 361 bp, Zea mays
  unsure at all n locations
  Clone ID: cC-zmpo148068c02a1
aacacgnactgancaccagccactggtttcaattttaattccaaaatccccccttccaccctgcaatacatgcatcgattttacaacattcacaataccaataatccactaacaacaaactactgattaattaaaccattcagattaccattccacatacagttcaaccgatcgatcacctcccctttatatctgctaactactagaaaaactcccccgcagtagtgattgacacaactaacacggcaccgtcatacataactatagatccgccctccgccaagacaccaactctattgccgtaactgtctcctccctcggccaaattatcatcctgcaccatcattacatacttaaagtt

SEQ ID NO: 14445 - DNA, 639 bp, Zea mays
  unsure at all n locations
  Clone ID: cC-zmpo148068c03a1
gcggacgaccttgtntttttttttttnnnntttttgtatattattaaaanaaaaaacattacaattaggccgaaagtttaaattttaataacaatatacacccaaacccccaaaaaaaaaaaaggagcaaaatactatatttttaaaaacaaaaaaaaattataaaaaaaaaaatctaaaaaaaagcaattaaaaaaaccctaaaaaactaattaaaaaaatataaacaattaaataacacaccacccatttaaaaaaaaaaatgaccttacattataaaaaaaacatcctccttttaacaaaaaaaaaatctaaaaataactaattttttaaaaaaaaaaaaaaataatcattatttaactctttgaaaaacacatcataaaattaaaagacaattgcgaaaccaaccaaatatttttttataaaaaaaaaacttcttaaaaaaaaaaaaaaaaacatctgccgaacaacaaaaaaacaaaatgaataccacaaaaactccaaaaacaaaaaaacaaatgtttatcataataaaatccacactaaacaactaattaaaaaaaaaaatagcgacaaaagctctttcccccccaaaatacttatttctaaccaaaaaaatataataaaagactaactctt

SEQ ID NO: 14446 - DNA, 535 bp, Zea mays
  Clone ID: cC-zmpo148068c03d1
gaggaggtggtcggggcgcagaccgcggtgcaccggagctttgcgtttgcggactacggcgccggtgggagccgcgtgcggtcactgaccgtgaacgccgtctcgctgcacgcgcacttcgaggccgtcgccgccgacactgttggcgcgggcgccgttcatggtgtcatggagccctgcatgggcagagaggacttcgcgtacttctcggtggccgtacccgcctcgcacttctacttcgtcggtatagggaacgaggctatcggggccgtgcacgccgtgcactcgccgcactttcttgacgacgatggtgcgctcccgtacggcgccaagaagcacgccaacctcgtcatagagtacttgcggaaccacgcgatagccataaagttcgttggtcctcacgacgagctttagatagaatctacctgcagccagacttttgcgagcagtcacaatggaggctgtggcgccggcgtccgctttacgtctcatggcttcgtgtccaacgaagctcaagacgagctgatgcttgtga

SEQ ID NO: 14447 - DNA, 579 bp, Zea mays
  Clone ID: cC-zmpo148068c05d1
cctcgatcaccctccctccctcacacaaataataaggaaaggtttcgcttttatcctccgacatccacaagggggggggggaggacacgtacattcacccggcggcaataatggcctcggttccggctccggcgacgacgaccgccgccgtcatcctatgcctatgcgtcgatctctcctgtgccgaggctgacgacccgaacctccccgactacgtcatccagggccgcgtgtactgcgacacctgccgcgccgggttcgtgaccaacgtcaccgagtacatcgcgggcgccaaggtgaggctggagcgcaagcacttcggcaccggcaagctcgagcgcgccatcgacggggtcaccgacgcgaccggtacctacacgatcgagctcaaggacagccacgaggaggacatctgccatgtggtgctggtggccagcccgcgcaaggactgcgacgaggtccaggcgctcagggaccgcgccggcgtcctgctcaccaggaacgttggcatctccgacaagcctgcgccccgccaacccgcttagctactttaagggactgccgcttcccgttgtgccg

SEQ ID NO: 14448 - DNA, 565 bp, Zea mays
  Clone ID: cC-zmpo148068c06d1
cacctcctccattggggagcacctgcaagaacggctccctttccctttttatctgaaatccgaggatctcgacgggatcgggacgacgtcctcctcctgcagtcaccaggagtgcaaggatcaagaagagaacacgggggacattctggaggagaagcgtgacgggaaggacagcgaagacctgagcagcacaggcgacaaggcttgtgtcgggctcgggagcagtgatataaacatcccgatggaagaagcggttgatgaacctgttaaaccggcggaagctgcggacgaagctgggctgaagagagatgtctgctgttcaccagctgagccaaacgaagccgatggtcagaacgagctcaatgaggctgctgtcgtcggtgaaacgacgactgaaccgaaagaggctgatgatgaagccaagataataatagcaagtcgactgcgaaactgcatcatacgaagttgctagtactggggccgactcaagggactatgccgttactatggaacccgagccgctggtagcagcagcagcatcaccacatgaagacaaggcccaagc

SEQ ID NO: 14449 - DNA, 182 bp, Zea mays
  Clone ID: cC-zmpo148068c08d1
ttcttaggatgattgccacccgctgtactaacgaccgcatgatccgtctggcgaaggcacgatatcttgatgtcaaaaatatttttggatggggttattttttgaaaaaacattaaaaaaagggcgcgttatagaccgctactacctgcatgcagatagtttttaggcacctaattattatg

SEQ ID NO: 14450 - DNA, 527 bp, Zea mays
  unsure at all n locations
  Clone ID: cC-zmpo148068c09d1
cgggaagtggtcgccggaggtgaggaagacgtacaacctgcttgactttgngagccggcacacgatccaggtggggccggggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctccgctgcggcaaggtcgtggggctgccgctgccgccgtcctacgcccccgcgcgctaagacgacgaaggcctcgttttctcctcgtggtctgaccatccaatccaaactcaaaagaacaaatacgaaagaagcgtagtgaaggggaacaaatgaatggatatatgtaatcttgagatgcatgccctctcaaatcactgtactggggttctcaaaaaaaatcattgtaatgggagttatatatataactatatcttaccaatttatttacaccaacatgtcattgggt

SEQ ID NO: 14451 - DNA, 628 bp, Zea mays
  Clone ID: cC-zmpo148068c10d1
gtccgcccacgcgtccgtcagaattctccaagacctcaatcatattattattctttttctatattcttctacaaatctgtgcatgctcctctgctgcctgcagcacgatcaaagcttcatatgggagcatttaaagttggtaacataaccaatgagaatttcttctttgaaatcatcaatggtctacggccagcaaacactgcaggttgcagttcatcaaccgatgcacctaacatcccacatgatggcacatctgtaattgaattgttgtctgatagcatgaaccaactgtccattaagaatgagaatcacttgctgcaggactttcttttagatgaaaaccacagcctgccagagattgatagtgatagtgttggatcacgattgcaggataaaagaagtaggcgcaatgaggagtcattttcattcacaagctctaacagagaaagttggggcagatgttcatctttaggagcagccagtgatgaatcattctcaggcgataataatgataagcagaatttgacagtcaaggctttggctacgcctgtaagacaaaaccagaggcaaagccagaggaaaccgattgagaaagctaagcagaagaagattcaagccctatggaaga

SEQ ID NO: 14452 - DNA, 577 bp, Zea mays
  Clone ID: cC-zmpo148068c11d1
cccgtccggctccgccgtcctgaggagccccctgtccgtcctcctctacattctcttcgccgtgcccgccaccgccgcgggggcgcggaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacagggcgacggcgacgcggtcgcggtccctggcgcacagggcgcggggcccctgcacggcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgtcgacctcgtcacccccaggaagggcacgctccggtacgccgtgacccgggcccgggcgctgaggatcacctttgcgcgcgacatggtgatcgagctctgccaggagctcatcgtgagc

SEQ ID NO: 14453 - DNA, 462 bp, Zea mays
  Clone ID: cC-zmpo148068c12d1
cgggtccggcggcaactgctcattacatccattatgatttgcgtttcgatcggccgatacctactcggcgagaggggaacaacgagagacagggggacgacaacgcgagtgggcggcaccagcagcggcgtgctgctgatgccgtgcgcggtggcgaccctggcgcgggccgaggacccgtacctgttcttcgagaggaaggcgacgcacaggaccaagaccgtgctgggcgtgccccacaaggtcatcctgatcaacggagagttacccggcacccaggatcaacatgctactccaacacccacatcaggggcaacgtcgtcaaccagctcgaccaatcgctacgtttcacctggaacggcatgcaacacaggaagaactcctggatggacgggatgccaggcacgcagtgtccgatcctgcctaacaccaacttgacgtacaagtggcagcccaaggacc

SEQ ID NO: 14454 - DNA, 423 bp, Zea mays
  unsure at all n locations
  Clone ID: cC-zmpo148068d01a1
aaagacttatccctantattcaggtccattcccaggttccgcagaaagcaagccttttgcactggcatatccacccatctcaaccagagggatcagatggtgtttaatattcttgcttgaattgcaccttgttgtatatacacgaacacgacacacacatgtccacacaggccatgcacgctcggaagcgcaagcgcgtcaatgcttgcggtggtggttgttggcggcttccgggccgtcgcggtcggcggcggcggccttgagatggtgcgtgggcgtcggcgtctgcatgagcgcgagcgcgctctctaactgcgcccagcgctgctccagcgtgccgttgtagccgacggacatgctgacgaggcccggttagatgcccgcgcgcgcgcggtcctcgggcggcatttcgctgctggtgct

SEQ ID NO: 14455 - DNA, 650 bp, Zea mays
  Clone ID: cC-zmpo148068d01d1
tcccccacgcgtccgcggctgccgcacctgccgctgcggatgcaggttcactttcgccgcgcgctggcgttcgccgagcggatgcaggggctgggcctgcgcgtgctgtacccgggcctcccgggccacccgcaccacgcgcgcctggccgtcatgggcaacccgggctacggctgcggcggcatgctgtgcctcgacatgggcaccgaggagcgcgccaaccgcctcatgcaccacctccagaacaccacccagttcggcctcatggccgtcagcctcggctactacgagacgctcatgtcctgctccggcagcagcaccagcagcgagatgccgcccgaggaccgcgcgcgcgcgggcatctccccgggcctcgtccgcatgtccgtcggctacaacggcacgctggagcagcgctgggcgcagttcgagcgcgcgctcgcgctcatgcagacgccgacgcccacgcaccatctcaaggccgtcgacgtcgaccgcgacggccccgaagccgtcaacaaccaccaccgtaagcactgacgcgcttgcgcttccgagcgtgcatggcctgtgtggacttgtgtgtgtcgtgttcgtgtatattactactagtgccattcaagcaggaatattaaacaccatttgaaccc

SEQ ID NO: 14456 - DNA, 397 bp, Zea mays
  unsure at all n locations
  Clone ID: cC-zmpo148068d02a1
aggctcgcattgctcatttgancattgttatatttctaagaaaacctccgctcactaccccctttngcgttggacgatacaaacgcaaagaaaggtcgttgctactttgttccttgcgaggagaatccttgcctagtactaggaacgtgcaagaatccatccgccatccctgctgggtacgttgggacttgggacgagcccggaaccggtgtatatgaagcttccgtgagctccgtctaatgctgtggctgaagcttccgctgggtacatcagttcctctgcgccatcaccgcctctgccaccacctgctgctgctgttgctgctgcactataagggcctgctgcttcttcctacagtgccttatgcggtccatgtcaatctgcttcctcctgcaat

SEQ ID NO: 14457 - DNA, 611 bp, Zea mays
  unsure at all n locations
  Clone ID: cC-zmpo148068d02d1
cccagctgccgnccggagcctccgtttgcggngcgacagcatttcttttaccggcccccgcgcgcgtgccgnagcgggccgggtacgacgccgggcggtcgatggagttcacgtcgtcctacttccacgccttcggcaacctcgacctcgcggcggtggtcttcggcgacggcggcagcgcgcaggcccaccggccgcgccgctccaccgacggcgcgaaggcggatgacggcaggagccccaccaccacaacggcgaggcgcgcgccgtccatgttctgcgtccccgacacggaggcggaggagcccaacggcttcctggacgagtgcaccctctgccgcaaggcgctctgcggcgacatcttcatgtacagaggggacacgccattctgcagcgacgattgcaggagggagcagatcgacatggaccgcataaggcaccggaggaagaagcagcaagccctcatagcgcaacagcagcagcagtagcatgcgtgtgtagcggcggcgatggcgcaaagggaccgacgtacccaacggcagcttcagccacaacactagacggagctcacggaagctttatttacacccgtttccggctcgttccaagtt

SEQ ID NO: 14458 - DNA, 338 bp, Zea mays
  Clone ID: cC-zmpo148068d03a1
tattattatgatttttttgacaaccccacccccaccgatttgagagggcatgcattttaagattacatatattccattcttttgttccccttcactacgcttctttcggatttggtcttttgagcttgaattggatggtcagaccacgaggagaaaacgaggcctttgtcgtcttagcgcccgggggcgtaagacggttgcagcgacaaccccacaacctttacgcagcggaaggcgttagcgggcatgttgtactcgttaagcagtgatcgtaccggcgagacgacccttatgtataactgcttccctaggtattaccgatcccaaatgttggaatg

SEQ ID NO: 14459 - DNA, 601 bp, Zea mays
  Clone ID: cC-zmpo148068d03d1
tccccccacgcgtccggcaacaactcctcattacatcctttatgagatgctgttcgattggtagatacgtactcgggtggggcagagcaacgagagacatggcgacgacgacgcgtgttgccgccgccgtcaccggcgtgctgctggtcctgtcggcgttggcgaccctggcgcgggccgaggacccgtacctgttcttcgagtggaaggtgacgtacgggaccaagtccctgctgggcgtgccccagaaggtcatccttatcaacggcgagttccccggccccaggatcaactgctcctccaacaacaacatcgtcgtcaacgtcttcaaccagctcgaccatccgctccttttcacctggaacgggatgcagcacaggaagaactcgtggatggacgggatgccaggcacgcagtgtccgatcctgcctaacaccaactttacgtacaagtggcagcccaaggaccagatcggcagcttcttctactttccgtccatcggcatgcagcgggcggcgggcggctacggggccatcagcgtggtcagccgcctcctatcccgtcccgttcgatcagtcctgccggagaacgaccacgtggt

SEQ ID NO: 14460 - DNA, 569 bp, Zea mays
  unsure at all n locations
  Clone ID: cC-zmpo148068d04d1
tcccgtggtgcgcgccaagctggccctggagctggagtgccccggtgtggngttctgcgccgacatcctcgcactggcggggggcgtgctgatcaccatgaccggcgggccccggtacccggtcccgctggggcgcagggactcgctgtcgtcgtcgcccacggcgcccgacgtggagctgccgcacgccaacttcaccgtggaccgtctcatccagatgttcggcgccaaggggttcacggtgcatgagctggtggcgctgtccggcgcccacacgctgggcttctcccactgcaaggagttcgccgaccgcctctacaacttccgcaaccagggcgggaagccggagcagttcgaccccagcatgaacccgttctacgccagggggctacaggacgtgtgcagggactacctcaaggaccccaccatcgccgcgttcaacgacatcatgacgcccggcaagttcgacaacatgtactttcgcaacctcgagcgcggcctcggtctgctcagcaccgacgaggagctgtggacggacccacgcaccaagcccctggtgccgctttatg

SEQ ID NO: 14461 - DNA, 568 bp, Zea mays
  Clone ID: cC-zmpo148068d05d1
gaatttaccgatggaagagattggcaaattcaaagagatgttccattcaatggacaaaaacaaggacggtagtgtgtcggttgaagagctgaaggagggtttccggataaacgatcatcctgttccagaggaagagataaagatgttgttacaagcgggcgatatacatggaactgacacattagattgtgaggaatttgtgacagtcttgcttcacattaaaaagatgagtaatgacgagtatctacctaaagctttcgagttcttcgacaaagacgggaatggttttattgaaatgtccgagttaatggagactctaagtgatggtgaactaaagcctgatgagcaattggttaacgacattattcaagaggttgacaaggataaggatggtcgcatcagttacccagagtttgaattgatgatgaaaagtggatcggactggaggaacgcctctagacgttactcaacagagaatttcatcagcctcagtcaaaaactgtgcaaagatactttatgaaacaagaaagtagtttccaagcagtcattactgactgaagtaccacac

SEQ ID NO: 14462 - DNA, 87 bp, Zea mays
  Clone ID: cC-zmpo148068d06d1
cgcagcggaaagatggatagataggtctttgtttcggattttttagtttgaataaatgaataatacgtctagaagtgagggtctgtc

SEQ ID NO: 14463 - DNA, 560 bp, Zea mays
  unsure at all n locations
  Clone ID: cC-zmpo148068d08d1
caacctgcgncagtcctgcatcaccaccaccaagctcatttcttttagctcgcgaaaataatgaagagccggagcgtggcatcatcggccgcgctcttggtgctagccctcgcgctagtggcggccaccgccccacaggtagcggaggcacagaagaagagagcggcggacagcggcgaggcggcggaggcgaataagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggtgccggccatgaaggtctgccaggaggagtgcgacatggcgtacgtggcgaacgcggccgatgtcaccaaagcctgcagcgttacctgcgccaaggagaagaacccgcgcctcaacgagaactgcaagaggtcctgcacccctcctccttttgaagcgaagccccttgaatgaatgaaccatgcatgcatgcatgtatgcatgcg

SEQ ID NO: 14464 - DNA, 569 bp, Zea mays
  unsure at all n locations
  Clone ID: cC-zmpo148068d09d1
acgctaaagcgacatggnatggcaagccgacgggcgccggtttcgattacaacggaggcggctgcgggtacaagggcgggagtcaagccccccttcaatagcacgggcgcatgcggcaacatccccatcttcaaggatggtctgggttgtgggtcctgcttccagatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctactcaaggcgggcatcatcgacatgcagttccgaagggttaagtgcaagtacgacttcaaggtcaccttccaccttgaaaaggggtgcggtcccaactacctggcactgctggtcaagtacgttgacggcgactgtgacattgtggcaatggaccgtatagataagggctccgacacatacgagcccctgaagcacttctggtgcgccatctggaggaaggacagcgacaaaccgtttaagggacctctcaccgt

SEQ ID NO: 14465 - DNA, 514 bp, Zea mays
  Clone ID: cC-zmpo148068d10d1
cgtccgggggcaaggagcccctggacaagaagctgtcggaggcggagtttaatatatgtcacgtacgtggtggaccccaggggcaggggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgctggccaagcccggcgccaagggcggccaggcggtggcggtgcggctgttcgggaccaagacgcagatctacaactgcaccatcgacggcggacaagacacgctgtacgaccacaagggcctgcactact

SEQ ID NO: 14466 - DNA, 645 bp, Zea mays
  Clone ID: cC-zmpo148068d11d1
acccgtccgcttaccaccacggcggaacgggaaatcgtacgggacatcattgaaattcttgcatacgtggctcttgactagggtcaggagctggagaacgccaagagcagctcatctgtggagaagagctacgagctgcctgatggccaggtgatcaccattggggcggagaggttccgatgccccgaggtcctcttccagccttccttcattggtatggaagctcctggcatccatgagaccacctacaactccatcatgaaatgcgacgtggatatcaggaaggacttgtatggtaacattgttctcagtggtggcacaaccatgttccctggcatcgctgaccgtatgagcaaggagatcaccgtccttgccccgagcagcatgaaaatcaaggtggtggctccacccgagaggaaatacagtgtctggataggagggtccatccttgccttcctgagcaccttacaacagatgtggatctcaaatgctgagtacgaagagtcaggaccagcgattgttcaccgtgagtgcttctaagctcaagggcccccttcgtccccattcctatgtattcccttccctgagtgcttatcttatagccaccatgtttgacattgccgcccttgaacaagcaatgttgtt

SEQ ID NO: 14467 - DNA, 502 bp, Zea mays
  Clone ID: cC-zmpo148068e01a1
gaactactgaatatggattgaatgaatctggggaatatatacaggtattggactaaatgcctgccctatcccaacagcgctactcgtttacacatcagagcagctcgtctacaggcaatttctgcttcccaggttcattcattaataatgtggtgaatggctaccgaatcatgttctgatgatggcaacacaggcgcctctgtaggccagcagtggagggagtttaggccgaggtcccgccaagctgtgtggccatgcgaaccatttttatcatccagccacaagggcccgttgatccgaactaatgaagccactgcatgctggatgttgacatatatacaggtgacgtggacaccgctaggtgctttggtgatcatgacgcgcctaccgccatttctggtggtttctcttgtgcctcatccttgccaagaatgctggtgtgactgaaacaacaccgatcaggaataacagtgctatcgactgggtggtctaaaggtcactc

SEQ ID NO: 14468 - DNA, 580 bp, Zea mays
  Clone ID: cC-zmpo148068e01d1
ggggagacagggaaagctctcttcctcctcctcctccttttgattttcgtctcttgtccctgtcgtcctcgcgcggtgttcccggtttttgagaggggaaagaggaggcggaggagagggatggggagggacgagaggttcccggtgtgggaggccgcgctcggcgccggagtcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagacctttatgatcccagggacaatattcatgtcactgcttgctggtgctctgtttgggcaactgcgtggccttgcgctggtggtctttgctgccactgcaggtgcttcttcgtgctatttcctgtcgaagatgattgggaagccactggtgttcacactgtggccagattagctcagcttcttccagagacaggttgtctaatgaagatgaagttgttgaa

SEQ ID NO: 14469 - DNA, 377 bp, Zea mays
  Clone ID: cC-zmpo148068e02d1
ggggagacagggaaagcgctcttcctcctcctcctacttttgaatttcgcctcttgaccctgttgttcttgcgcggtggttccagtttatgagaggggaaagaggaagccgaggagagggatggggagggactagaggcttccagtgagggaagtcgagctcggtgccctagtcactcccgtcttcttcgttggactcgttcgcgtctacctttctatgccggactccgactactgctttcttaacatgccacgcaatctcgaggaactccaaatccttactggccaccttgagaactacactagtgactacaccctacaggtgttggtaggttattgctgctgtgtacaatcttcatgcagacctttatgatccca

SEQ ID NO: 14470 - DNA, 132 bp, Zea mays
  unsure at all n locations
  Clone ID: cC-zmpo148068e03a1
nnnntnnanattttataanatgnttcnccgcccaacactaacttttagctnccagtttaatttataancacaaacctagcccataacctatgcatgttagtcaattagttcaaatgcacgccaactcctttg

SEQ ID NO: 14471 - DNA, 485 bp, Zea mays
  Clone ID: cC-zmpo148068e04d1
tccgttccatcctctccgccgtcgcgatggcggccttctgtttccgttgccgccacacgccaccgcagagctaggtaccgactaagacaaggcgggcaatggccaacgcgcccctgccgcttccgtcgctgctcgtcctcgccgccttcttcttccaccacccctgctgcacggcgcagggccgtgccgaaaacatctcggaggtcgaggccgcggtccgcgcccgcgcgtccgagctgctccgcgacgccaccagccagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgtctcgccatcgtcttcgagctcttcgtgggaaactcgacggccgcgttcgccgcgccgcgcggctacgtgctg

SEQ ID NO: 14472 - DNA, 546 bp, Zea mays
  Clone ID: cC-zmpo148068e05d1
ccggggcgatgttcctgtcgttcggccggagcgacgacagttttgatttagacagacgacgacaccacgagccccgggaggagagccatcgcggctgctgatgacgattgcaagcctgccgatgacgagtcaacgtcgtggaagcgcctcgtggacggtatgcgcccgctccgcctccgcgggcagctggagtactacccgccgccaccgccgccaccgccgctgggccacgccgatgtgtaccatgacgtgatcctcccgccgtcgtcgcaggcacggttcggcttcgagatcaaggaggtgggcatgaccagccgctacgcgtccgctgaggatctgcaccagatggacagcgaccaggaagagggtgctgagggtggcgatgacggtgacagcagttgcccacacgccatcgacattgcaggctgaggagttcatcaccaagttctatgagcagttcaagccagaatcgttcaacggccgtgccttcgagtgatccattgatccattcgcttgcggcttgtatgtaaacgttcttgatcttaa

SEQ ID NO: 14473 - DNA, 570 bp, Zea mays
  Clone ID: cC-zmpo148068e07d1
gcgacccctgctgaagaacccgtggaggacatctttttcatttcccatgggggtatctccatcggcggcaagcggctcgacgtgccggaggccatcctcgcgctgaggcccgacggcaccggcggcacggtgctagactcggcgaccacgctggcatacctcgtggagccggctttcaaggagctgaagaaggccgtcatggaaggcatgaagctgccggcggcgaacaggagcatcgacgactaccctgtgtgcttcgagctgccgcgtggcatgtccatggaaggggtgcaggtgccgcctctcgtgctgcacttcgctggcgacgcggagatgtcgctcccgcgggacagctacttccaagagccgagccccgtgatgatgtgcctggcggtgatgcacgcgccatttgaaggcgcccccaatgtcatcggcaacgtgcagcagcataacatgcatgtgctctacgatctgtgcaaccgcaagttctcctatgcgcccaccaagtgtgacagccttttgagatgctacctatcacatgcctgcaacgcaactagtaccatgccaaca

SEQ ID NO: 14474 - DNA, 373 bp, Zea mays
  Clone ID: cC-zmpo148068e08d1
gcgcagctgctgggcttgtgcctctttctatatacatatttagatttaataagaacaaagacgtactataacgggctgattttgttacccatcccgtttccacgcaaaggcgccgagcgcgatctccgtccgtgccgccatggatctcaccggtctctgatgatgatgcttctcgccgtcgtgctcgtctctgagctggcctctgtcgaatacgtcgacgacgccaacgccatgctcaccattctgacccctgtggcgcataccccgctggggtccttctactgcgataagccggtctctgacgactacgccgctaacgacgacgatgacgccgtccttgtcggtgcgcctaactgggccaccatgactgatc

SEQ ID NO: 14475 - DNA, 434 bp, Zea mays
  Clone ID: cC-zmpo148068e09d1
gcgctgaacctgcaagtgagcatcatcagccaggcgcttttctttttgacccggacccagagccggacctgggggggggggccctaagcgctgctggagaacccctaactggaagaccagacggaggcgacgcgcatcgacgagaacgccaactgggagttcttgaatatgcatggcatctagctggggctggggcggtaccatctgggcgttcagcgacgtcacctacttaccgctggacgtgctcaagttcgccatccgcttacgcgctctacggcaaggcctggaacaacatcaacaacaagacggacttcaccaaccgaaccgactactgcaagggcaagcgagaggcgcaacgggccacggtacagaggacgctgaacggcctaaaccaggccaccgacaacttcgacctcttcggcgaccaccagggc

SEQ ID NO: 14476 - DNA, 467 bp, Zea mays
  Clone ID: cC-zmpo148068e10d1
gtccgcggacgcgtgggcaagaactacagctacagcctcgttttctgtgccaacgggaggaagatggtgtgggagggcgccccaaggagcgtccgcgacagccaccgcaaggtgagggacagccacgacggcctcatcatccagaggaacatggcgctcttcttctccggcggggaccggaaggagctcaagctcaggatcaccggacggatctggaaagagcagcagacaccagacggcgcatgtactccaaatctgtgcagctaattaagcaatcttcaaacacacaccttgcctgtccttctttctctttctaattaatcgtggtggtggtgctcaaagggattatttattactaattattaggaggacgtaggatgctcgtgtaaatgaaactgtgtatattatatggatggcatggcatccctggccttaaatcatgtcacagcacagtactgtactgtacc

SEQ ID NO: 14477 - DNA, 538 bp, Zea mays
  Clone ID: cC-zmpo148068e11d1
gtccggtcagctcaccaccagctccagtgaagtcaccgccacttccattaccagtgagctcaccaccacctccggtgaggtctcctccgccaccagcaccagttagctccccaccacccccaataaaatctcctcctccaccggcaccagttagctctcctccaccagcaccagtgaagccaccatcactaccaccaccggccccagtaagctcacctcctccagttgtcacccctgccccgccgaagaaagaagagcagtcattaccaccaccagcagaatcccaacccccaccatcattcaatgacatcatccttccacctatcatggccaacaagtacgcatcttcgcctccccctcagttccaagggtattaagcgccacagagacatggttgatgaagcatgaatggaacagtctataaggtcacatgcgcagacaaactgctacatgtaaaacactgcaagcgtgtgtgaaattgctattttcttttgcacgtgcacgcgtgagtataatcttattcgtacatatgtaccga

SEQ ID NO: 14478 - DNA, 329 bp, Zea mays
  Clone ID: cC-zmpo148068e12d1
gtccgcgattacgcggcgtggatctcgtcaaaatgggagactttctgttctagcaggatcatgttgctcccatgatatgcgcccttcacgaccacgcgctctaggtatttgggccatgtgacaatgtcgctctagttatgtgatttgctttctgaaacatcaatccactgcactattattgtaatcttttttttcctcctaatgtcttgttcggttattactatcctatatagattggatgaacttgaaaaaaatataaaagattttgacttgtttggaatttaaactcactcaatccatatggattgagagcaaaacaaacaaggcct

SEQ ID NO: 14479 - DNA, 490 bp, Zea mays
  unsure at all n locations
  Clone ID: cC-zmpo148068f01a1
attgcctgcatgcctttntattattacccattcgatcgatgaaaaacttacatttgcgtgacattacatttccagttccatcgacggtatatttggaaaaaaacaattagcttaaaaaatgccctgattaataggaatacaatatattagtccgtccatatcagatggttatcgcatgcgtggccagccggtgacgacgtacgtatagactcgctcagcgcctgagctgaacgccacgtcaccccggcgcatgcatacatgcatgcatgcatggttcattcatttcaaggggcttcgcttcaagaaggaggaggggtgcaggacctcttgcagttctcgctgaggcgcgggtttttctccttggcgcaggtgacgctgcaggccttggtgaccttggccgccttcaccacgtacgccttgtcgcactcctcctggcagaccttcatggccggcgccgtgattcccttctgctcagtgcacttgcccttgc

SEQ ID NO: 14480 - DNA, 507 bp, Zea mays
  Clone ID: cC-zmpo148068f01d1
tccggcaagggcaagtgcaccgagcagaagggcatcacggcttttggttttgaaggtctgccaggaggagtgcgacgaggggttcgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttttccaaatataccgtcgatggaactccaaatgtaatgtcacgcatatgtgtgtttttcatcgattgaatgggtaataataaaaaggcatgctggcagttaataaaaaaata

SEQ ID NO: 14481 - DNA, 335 bp, Zea mays
  unsure at all n locations
  Clone ID: cC-zmpo148068f02a1
gccccccaancatcacccattcgagcgatgttaaatttaaatttncgtgaccttccctttccccttccatctacttgaatatttgaaaaaaaacaatttttttataaaaatccccatttaatcttaatacaatatatagttccttccatatcaaatggttatcgaaagcgttcccatccgtttacgacatacatatattactcgctcaactcctgaactgaactccacttcaccctcttgcatgcattacattcatgcatacatggttcattcatttcaatgtgctttgcttcaagaaagattaaattttgcaggaccttttgcaattctctctt

SEQ ID NO: 14482 - DNA, 564 bp, Zea mays
  Clone ID: cC-zmpo148068f03d1
tccgcggacgcgtgggtgggcgggcgccgcgcgtcgagggcttgcctttgcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcactcgcggcgggctgcgccgctgtgtgctgctgctttccctgcgtcatggtggaggtcgcggtgctcgccacggtgcgcgcgcccgcggcgctgtgccgtaaggtcgtccgcgtgctcaagggccgcaggtgctctgtcttcgcgggccaggccacggagatatacgagctccttgtggactacacc

SEQ ID NO: 14483 - DNA, 363 bp, Zea mays
  Clone ID: cC-zmpo148068f05d1
tccgttggctgcgctgcgctgctctgctgctcccgcgcatttccttttcgtgggcgtgctctgattgggcacgggggtggcagtggcacaccttcgtcttcctttcgtttgctttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaaccatcaaaaaaaaaaataaaaaaaaaaataaaaaataaatataattaataaaataaaaaatatataaaaaatataaataaaataaaa

SEQ ID NO: 14484 - DNA, 589 bp, Zea mays
  Clone ID: cC-zmpo148068f06d1
tccggatgccggcgccacaggctctcctgctgtcgctgctgtttgctttgctagcggtggccgccgatgtcgccagcgcgggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtgcccgcccaacgaccagcagtccgcggacagcggcgggtggtgcaacccgtcgcgggagcactttgaccttagcatgtccgcgtttcttcagatcgcacaggagaaggcctgcatcgtgcccatttcctaccgtatggtggcgtgcacgaagcatggtggcatccggtacaccattaccggtaacaagtactttaacat

SEQ ID NO: 14485 - DNA, 231 bp, Zea mays
  Clone ID: cC-zmpo148068f09d1
ccggtttattctctctctgtgtttttttcgttcgcttccgtttaattatacccaaacaaaaaaaacaaaggggctgaagagttcatcatgcatgcatgatgaagtcttgatcattgatggtatatatatagaggaagcatgtctatctaataagtccctcatccaaaattgttctttatgtcatgtatatgtacgtgcatatatatatataaaaatacgtctccttttatt

SEQ ID NO: 14486 - DNA, 460 bp, Zea mays
  Clone ID: cC-zmpo148068f10d1
gtccgcccacgcgttcgcgatgccaccggcggtatctacctcttagctcccagagcatttggtacgagtatgggggatgataaccccactgtttctgatcctgctgtacgagctgcggcggcacgaaagaaggatggcccaatggctttcaaagttcctgtggataagaaaaggctggatgcgcggaagaagagcttgaagagattataggcggaacgtcctgggaagaagagagagggtttagagttcagaatttttatcggaaactcagcagatgcttatttaagctgggagacaaacaattaggggaggagaggcatctgatgacctggctttcgggagaagggggtccggggcggtgccaaaggtgaataatgtgaagcaactgagtccttcgggacaactgtatgtgcaatgcccaatcatttggaagaacacttgcctatttctttttgttgtc

SEQ ID NO: 14487 - DNA, 420 bp, Zea mays
  Clone ID: cC-zmpo148068f11d1
gttcgcttgaggaagggagcaagtaatgcccgagcttgggctttcttttttccttctgtttcactgggtgaagggtcaggttcaagacaagcttagccatcttagagatgtttgttagggtagctgctcacatgtttccgtgcaaaaccatttaatctttgctccccactgtttctgtgcagtcaggaaggggggaaaaccttgcatgcatgtaaattttgaggaaatcatgtgctgttgtatattaggaatacctttgcatttgctggtgcgacgcctaatcttcctgtctattaaccagagtttttatttggcaatgtatcatgaacttgtaggggtttttttaggatttctctcttgtttgtggtgctgttgtactttacactgtaatcttcattaaagaacttggtttcacttcgt

SEQ ID NO: 14488 - DNA, 577 bp, Zea mays
  Clone ID: cC-zmpo148068f12d1
cacgcgtccggtcggcgctggcgaccttggcccgggccgaggacctttaccttttcttcgagtggaaggtgacgtacgggacggggtccctgctgggagtgccccagaaggtcatcctcatcaacggcgagttccctggccccaggatcaactgctcctccaacaacaacatcgtcgtcaacgtcttcaaccagctcgaccatccgctccttttcacctggaacgggatgcagcacaggaagaactcgtggatggacgggatgccaggcacgcagtgccccatcgcgcccaacaccaacttcacgtacaagtggcagcccaaggaccagatcggcagcttcttctacttcccgtccatcggcatgcatcgggcggcgggcgggtacggcgccatcagcgtggtgagccgcctcctcatcccggtccccttcgaccagccgccgtcggagagcgaccacgcggtgctcatcggcgactggtacaccaaggaccacgaggtgctggcgcgccagcttgacgccggcaagagcgtgggccgccccgcaggcgtgctcatcaacggcaagggaagcaagga

SEQ ID NO: 14489 - DNA, 236 bp, Zea mays
  unsure at all n locations
  Clone ID: cC-zmpo148068g02a1
gggaaaaacccccctcacccccccggncaaaaaaaaccccaaaccttggccccccataaataacgggcccgtaaccccccactcttcaacggcccaaccggaaggtggcacgcacgaccaaacccggaagcgggtggggcacaaccaggggatttttttaaccaaaccataaattcccccccgagggggatcgaacccaacacctggaggtgctactcaaaagccttaaccattac

SEQ ID NO: 14490 - DNA, 303 bp, Zea mays
  unsure at all n locations
  Clone ID: cC-zmpo148068g02d1
aggctggcgagnagcacctccacgacctttgctttaccccccacgggggcgaaacaacggcgcggcgaaaaaaacccccgcgcagagccccacccgcccccgggcaacgacccgcgcgccacccaccggcagggccgaagcagaacgggcgacgacggcccgcaagagacggggggccaaggcaaggggaccaacccggccgggaccaagagggcggccacacccaccccagccgagccacccaccaaaaaaagagaaaaaaacacaaaacaaacaaaaaaaaaaacaacaaacaaagggcgg

SEQ ID NO: 14491 - DNA, 400 bp, Zea mays
  unsure at all n locations
  Clone ID: cC-zmpo148068g03a1
atattattagacanagacacaatctgcttggctgaatgttctcattattggaagaacaaaattcaaaaccccaaaagaagaagagggaggaggatcctctcttacgtatcaagtcgtcgtttttcttcattatcattcatcttccaaacctcggaattcaggctaattgcttcagtagtaattaattaacaatccaatcatcactcagttaataagtcagcgctactacgtacgtacgtagataggaacgaacagatgggtggatggagtcagttattgtttggtgttttgttcttgttcttgtccaagtccgttgcatattagttgcaggttattaatacgccccccttgaagcactctgctcgtgcgcaaccgaccttggtgctcccggacgcctggt

SEQ ID NO: 14492 - DNA, 385 bp, Zea mays
  Clone ID: cC-zmpo148068g03d1
cgggagcaccaaggtcggctgcgcacgagccgagtgctttttggtttgcgtcttcatcacctgcaactactatgcaacggacctggacaagaacaagaacaaaacaccaaacaataactgactccatccacccatctgttcgttcctatctacgtacgtacgtagtagcgctgacttatttactgagtgatgattggattgttaattaattactactgaagcaattgcctgattccgaggttggagatgatgatgatgaagaagacgacgactgctacgtacgagaggatcctcctccctcttcttcttttatgttttttaattctgttcttccaattttgagcccaatcagtcaagcagattgtatctatatctatatatatac

SEQ ID NO: 14493 - DNA, 331 bp, Zea mays
  Clone ID: cC-zmpo148068g04d1
ttcggtcgaggagctgctgcagccctgcaaggaggacggttttttttttgctcctcatgcacccggaggcccgcgcgcgggcgtgcgggggcggcacactgcaggaacggcaagggaatgatagctagcgctcttaattgatcagctgatcagatgatctgtcgccacgcacacgtcgtcttgtatgggctggctgctacaatgcaaccggtagatctccctgcttagtttcttgagatcgagggctccagttcttgctttgcatcctgcaaccgttgtccacaatctttgccttccgtcaaattttaatacatggtcggaacattgaggc

SEQ ID NO: 14494 - DNA, 643 bp, Zea mays
  Clone ID: cC-zmpo148068g05d1
gaaagcctggaaataagaccggcggacttggtgcacgttttctttttatcaaagccaaatgaaagcctgtatgagcaggggcccgaagaaacagctcctgtcctgccatcatcggtgattgcaagtactacagctaggagcaaaccccatacttcccgattttgagtttgtagaaaatgcacctgctcctaagactgggagcagctcagaaggcaatctcatgagtggacatgttgcacccccaaagtcatcgaacttctttgttgaatttgggatggacagtggatatcacaaaaaatctacatccagttcatccaaagtgcagattgaggaaagcagtgaagcaagacagaaattctcgaatgcaaaatcaatttcatcctctcagttttttggtgatcaggccagtttcgaaaaggacactcaagtctctctccaaaagttttctggttcctctgccatatcaagtgctgatctatttggccattcagcaaacaattctagcgtggatctcagtgcttcagatttgatcaacagaatatcattccaggccactcaagatcttgcctctctcaagaacatggcaggtgaaactgagaaaaggttacatcgatggcttccacatattattgatttcagaccg

SEQ ID NO: 14495 - DNA, 456 bp, Zea mays
  Clone ID: cC-zmpo148068g09d1
ccgggcgagggaagggctgcgcgtcgagtcccttctcttcttccaattcctcctcctctctccaacaccccatcggtcagggctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgg

SEQ ID NO: 14496 - DNA, 549 bp, Zea mays
  Clone ID: cC-zmpo148068g10d1
gttcgcccaagcaaagaaaagaagctagctagctaggcgtattttcgttttacgacgcagggcggcaacaggtggacgaggacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcacttcggcgcgtccaaggagacgctcaaggcggaggcgacgacggacgacagcgggtggtacaagctggagatcgaccaggaccaccaggaggagatctgcgaggtggtgctggcccggagccccgacccggggtgcgcggagatcgaggagttccgcgaccgcgcccgcgttccgctcaccttcaacaacggcatcaagcagcagggcgttcgctacgccaaccccatcgtcttcttccgcaaggacccgctcaaggagtgcggcgccctcctcgag

SEQ ID NO: 14497 - DNA, 555 bp, Zea mays
  Clone ID: cC-zmpo148068g11d1
cacccgtccagcggtgtccacgtcacctgtatatatgtcaacatctctcatttagtggcttcattagttcggatcagcgggcgcttgtggctggatgataaaaatggttcgcatggccacacagcttggcggtacctcggcctaaactccctccactgctggcctacagaggcgcctgtgttgccatcatcagaacatgattcggtagccattcaccacattattaatgaatgaacctgggaagcagaattgcctgtagacgagctgctctgatgtgtaaacgagtagcgctgttcggataggacaggcatttagtccaatccctgtatatattaaccagattcattcaatccatattcagtggttcaaagataatgccctgttcagctgctgtgttcttgaatgttttgctctatttcccttctgtgccttcgctgtcggtgggaaacagtagagcttgttcctcctttttcatgccaagtgtagcggtcgtcaatgaacaacttgcaaaaggaaacagtacattataagagtttttttgctattttggtattc

SEQ ID NO: 14498 - DNA, 584 bp, Zea mays
  Clone ID: cC-zmpo148068g12d1
cacgcgtccgctcttctgcatcgtgcatggtgagaaggaagagtcaattggtttcgatgcgaaagcgtccgggcctggggggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggtgaggtgtccggggtcacgctgctcaactccaagttcttccacatgaacatgtaccggtgcaggacatgctgatcaggacgtgaccgtgacggcgcccgtgaca

SEQ ID NO: 14499 - DNA, 606 bp, Zea mays
  Clone ID: cC-zmpo148068h01d1
acccgtccgcccacgcgtccgcccacgcgtccggaaggcggcggcctttggtttttagcgcgagaggaagagcaggaggaggggtgggccatgacggggaaggcgaagccgaagaagcacactgtgaaggagatcgccgcgaagatcgacgcggcgacgacgaaccggggcggcggcaaggccgggcaggcggaccggctggggcaggacaagggcgggcatgcgaagctggcgtgcccgctctgccgcaccccggcgcccgacatcaagtccatgcagatccaccacgaggcgcgccaccccaagctccccttcgagccggagaagctcctcaacctgcactcctccgcccccgctgctgccgccgccgccgccgctgccgccgccgctgccgaggccaccacctccaagcccaagcccggcgtccgcggcagcctcaagaagtaagcttgctgggcttggttggctcgcccgcctgcatggggcgcaattccctttcggttcaatcccattcggcgacccgatctataatcaatcaaaccgtcgtcctccggcctggcggctggcgcagtctggctgctgtgtactgttagtctgctgctgatt

SEQ ID NO: 14500 - DNA, 110 bp, Zea mays
  unsure at all n locations
  Clone ID: cC-zmpo148068h03a1
ccnnnnnnnnngcaancaagggaaaaagataaatttttttaatgtaccaccacaaacccccacaggctaggcgcagcttgcatttgagctgaaaaccaatcggacccctg

SEQ ID NO: 14501 - DNA, 130 bp, Zea mays
  Clone ID: cC-zmpo148068h03d1
ccgattggttctcagctcagatgcaagctgcgcctagcctgtttatttttgtgctggtacattgagagctcttgggtatgggcttagattgcaaaaaaaaaaaaaaaaaaaaaaaaaaaaaaaaaaataa

SEQ ID NO: 14502 - DNA, 569 bp, Zea mays
  Clone ID: cC-zmpo148068h04d1
tccgcaggacgactatggcccggccgcgcctcctcctcacctttctgttcgccgcggcggccgtgctgaccacggggccgggcgtctcgctcgccaagtcgaagctcgccaagaagagcgacgacgtcgtgaacgggccccttctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaacggcaaaggccggacctccatctcccacgagtccgcctcttccgacaacgccgagtccgccgcgttcaccgtgaactcggacaacgtcatcgtcttcggcgtcagctttaggaacagcgcccgcgtcggtctggtgaacgacccggagatccgttccgtggccgcgatggtggcctgtgacaaggtggccttttaccactgcgcgttctacagcccccaccacaccctggtcgac

SEQ ID NO: 14503 - DNA, 608 bp, Zea mays
  Clone ID: cC-zmpo148068h05d1
tccggtcatctcctccatcagcaccaccaagctcaacaacagttagctttcgaaaataatgaagagccgcagcatggcatgatcggccgtgctcttggtgctagccctcgcgctagtggcggccaccgtcccacaggtagcggaggcatagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaatggcatcacggcgccggccatgaaggtctgccaggaggagtgcgacaaggcgtacgtggtgaaagcggccgaggtcaccaaggcctgcagcgtcacctgcgccaaggagaagaacccgtgcctcaacgagaactgcaagaggtcctgcaccccttctccttcttgaagcgaagccccttgacatgaatgaaccatgcatgcatgcatgtattgcatgcgcctgggtgacgtgggcgtcagctcaggcgctgagcgagtctatacct

SEQ ID NO: 14504 - DNA, 563 bp, Zea mays
  Clone ID: cC-zmpo148068h06d1
ccgaggcgctgcagcacctgagacttgtctttcctccgtcctatcgattcattctatttcgaagagctagtaattggctggagcgttgtcttcccacggtggctggagctactgattcagaagtgcaaaggcctgcgacggtttgagttgcagtgtggtctgtcattgctcaggagctgcctcgacggtggcaagaactggcatctcgtgcagcagatccccgaggtgcgcatcataagctgcgatggcaagagatactttcggtataacaagagccgccgtatctacgaaactaatgcacagtcagaagaatgaagccatttctgaaaaccttggcacgacactggtttgttttgggtcagccacacgtttcagttgtcgctgtccctactttgttccgggagtattgagagcttgtgatctgttcacgattgattcaagtgttatcctttgttttgcgtgttttttttcttcttctttttatcgctgagccgatatatatgccactggttctcctctgaatatgggtgtccttcaccatgacttaatatgtgtaatacttt

SEQ ID NO: 14505 - DNA, 460 bp, Zea mays
  Clone ID: cC-zmpo148068h07d1
ccgctcgagcgctccatcgacggggtgaccgacgggaacgtttacgttttcgatcgagctcaaggacagccacgaggaggggatctgtgaggtggtcttggtggagagcccgcgcaaggactgcgaccaggtgcaggcggacagggaccgcgccggcgtcctgctcaccaggaacgtcggcattcagcgacaacctgcgccccgtcaacccgctcggctacctcaaggacgtgccgctgcccatctgcgcctcgctgctcaaacagttggactcggacgacgacgacgatcagtaatagcacattgacgacgacgatcgatatgtaatagcacgtcgtcgacgaccgaccgcagtcgtcgcagactggctggcactaaaccacaaattctcttcacctggattacaaatatgtaactgagaaaggaaaggaatacataaatgtaactgcgtggctgtacc

SEQ ID NO: 14506 - DNA, 556 bp, Zea mays
  Clone ID: cC-zmpo148068h08d1
tccgcggacgcgtgggcgaatctgccatcctctccaacacgtttactttgttcatcagcaatgtcgcagtgaagggggcggccgtggccgcgctgctgctggtcgcagcggtgtcgcctgccgcgcgcgcggcggcggtggcggtggcgggaggggcgccgtcggtgtcggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcacggagccctggtgtggagcaagaaccagtgccagcattcttacaattgcatgattcttccgaatagcttggtgctggattt

SEQ ID NO: 14507 - DNA, 526 bp, Zea mays
  unsure at all n locations
  Clone ID: cC-zmpo148068h09d1
ccggcacagaagctagctagcgcagccagaccagctagccagcatttttcgttagagcccgtccttctntcctcgcctctcgggccgtggccgttcctgtcccgccctgccgccgctcgccgcacttcacgggatggtagatgatagaagatccgcctgcgctcgtcctctgtcgcccgcctcggcaggccactcgtggacgctcgctcgcggagggctccggctctcggctcccacctagcggcttcctccgccgtcgcgtcccgccgtctggcgccgccttcggggcctgtcgtcgcctccttcttcgcctactacattcagcgagccggccgtggccggtcgtccggaggccgaggaagagacgaagcgggagagagagtgacatggctgcgcgcattccgatgcgtgggcatgtttttgattcgactcacctttagtcctctttttctttgttccctctctctccttaatttaacgaattgatgcatgccgctgatggtcttcctcctgatagagggattaa

SEQ ID NO: 14508 - DNA, 550 bp, Zea mays
  Clone ID: cC-zmpo148068h10d1
ggacgcgtgggctaatctgccatcctctccaacacgtttatttcgttcatcagcaatgtcgcagtgggggcgggggtcgttgacgcgctgctgctggtcgcagcggtgtcgcctgccgcgcgcgcggcggcggcggcggtggcgggaggggcgccgacggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgactggcgggctggagctgaagggcccctgcaagtcctccatcatcatccgtcttgacggcaacctgctcggcaccggcgaccttagcgcgtaccaaaggaactggatcgagatcgagaacgttcagaacctgtccatcaacggacacggcaccatcgacgggcaaggagccctgatgtggagcaagaaccagtgccagcattcctacaattgcaagaacctaccgaatagcttggtgctggatt

SEQ ID NO: 14509 - DNA, 594 bp, Zea mays
  Clone ID: cC-zmpo148068h11d1
acgcgtccgggggccagggaccaagaggaacaacaacagcggaggtttagtttgagcaagaaccacctccggctccggggcggccgccaccgccacagcagcggcggcaccatacgaggcggagaagcaggaggtgatcaagcagtgggcacaggtcgctgacgccttcagcgcctctgaagcttacaacagcaggttgaggcagacgcttgacgccaagcagctcaagactggaatgatgcacaaggggaaggtgaacagggtggacttctcagggccgctgctgtcgcagccccggcgcatcgacgagctcctgcacatccacgagcagcagatccggcaagctggtcgccggccatggttcatgaaaggcaccgaggaggaggagcactgatggcagagacacggcatggacacaactaaacgcccatcagatttgcacgtacttaccacagagcaagagaagatgctggaaacatatcaaaggagttggaccgtgagctagctctcctgatgagcaggtgttttttcagggcccgggacagacaaacgagtcggacttatgccatcatggaagagctcagatggaagctg

SEQ ID NO: 14510 - DNA, 644 bp, Zea mays
  Clone ID: cC-zmpo148068h12d1
cacccgtccgcttatcaccacagaagctcaatcatatatctcgatttttcctttctcctgacattcaactctccagcaggctgggacctcttttggtggtcaatgtacagatgcttgtctaaatggatgttagtggtgaaaatgaactgtatgtcaacttgcttcaaacatattcaggtcccattatatccggcttcattatttcagaatgaaacagatggggaagggatgagctttgttttgtactttaggctttctgatggttactcgaaagagctttcacattcattcattgaaagtatcagaaggctggttgatgatcatgtagagaagataaaagcattcccaatggaaacaactataccattccgagagcggctgaagatacttggccgggtggctaatctggaggatcttcctttgagtgcaccggagaggaagctaatgcatgcctataatgagaagcctgtcctttctagaccacagcatgagttttacctgagtgataactacttcgagatcgacatttgacatgcacagatttagcttacatcttaaggaaaggttttgaaacatttttggacaggctaaaagcatgcgtttagattgtgagctgacaattcacggaaataaacctaaaaact

SEQ ID NO: 14511 - DNA, 475 bp, Zea mays
  Clone ID: cC-zmpo148073a01d1
atggaaacttgcagagaactcaagggcggggggatttccatccgatatcttttctttttcatctggtgtaacaacttccactacgaagagacagagatcatacaaccttcatcttagtgaaacaacaaaaggcagctttccagcccttttttttcctttatattttgtcatcaccaaactgtctattaatgtaaggattaaggtgcgtgaacaaaaggaaaaaaaacaaaaaggatatctgcagcacacagcattttccacatcacccatgactggacacacttaacccgacggcagcacatttacgtaggttgctttatcggaagctcagctctcagatgcagcatcccgtcgatgaagaagaggctgtcatcggccatgaacgcctgccacgggattccaaagagatttctgtacccaactgtctttccactcgtaaatgtgtagttacccttatacttgccacaaactcgcc

SEQ ID NO: 14512 - DNA, 444 bp, Zea mays
  Clone ID: cC-zmpo148073a03a1
aggctcagcatgatgcaacgtttcatgactcacataagttttgaccaaataaataattaaaccctcgcctaattcacttacttttaatcaaaaggaaaagatatagagagagacaagaggtaacacctgaatttggtttgcatttaaagaagaaattttataccctaaaattcagggtgttacaccgtcaaacataatatagctgttggatgtttgtcgttttactgttgtgcgttaccaatggatagcaactaatatgcaatgcaaggacgagagaaaaattataactagagagatgggtcagtcgacggagggtctagaagcatgcaagctccttgaggcaacccttggtgctgcccttggcgttcgtgcatatagccatggacttgttgttggtgccgctttactcgacgttgacctcatccatggtgacgcccgtgcatg

SEQ ID NO: 14513 - DNA, 609 bp, Zea mays
  unsure at all n locations
  Clone ID: cC-zmpo148073a03d1
cgcccgatcacgacaagatggcgtgcacagacaatgcgatgagagtcttgttcctcctggtcctcttctgcatcgggcatggtgagaaggaagagtcaaagggcatcgatccgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaagggaaaccttgacgggcagggcccagccgtgtggagcaagaactcctgcaccaagaagtatgactgcaagatccttcccaactcgctggtgatggacttcgtgaacaacggngaggtgtccggngtcacgctgctcaacttcaagttctttcacatgaacatgtaccagtgcaagaacatgctgatca

SEQ ID NO: 14514 - DNA, 348 bp, Zea mays
  Clone ID: cC-zmpo148073a04a1
ggggttggtttaattttttattttttaaatcccccggcaaaaacccaaaccccggggccctattattgaataaaaaaaaacttggaactttttaaacccgtttttagttacaaaaaaataaggccccattgcacccccccacccacccaaaaaccctacctgtgtacaaaattttttaacccccaggcaaaaccgtaaatattctggaagggaaaaaacttttgggcccacaccctgggaagtttttaaagcttccaacacgtgccgtccgaatgcttttccccaccaacaaccaaggaattctaaaggcccatccaagcaacggaaccccatgggagccccaactcg

SEQ ID NO: 14515 - DNA, 590 bp, Zea mays
  Clone ID: cC-zmpo148073a04d1
cacccgtccgggaaggcaggccgggtgtcctgcctcccttgcgcgcgctctctctacccatcccgtcgtgcgtcatcgagctcgggcgggcgggccatgcacgcgtccagctagctcacacagcgccgtctcgaccggctgccggtgctccacccggcccgcgttcacatcacggcgggcgggcgcgcgcgtgaacggtttcctctccgcatgaccctgtgatggtcggtgggttcctgcggcgcggccacagcctcgacaggctcctgtcgaggaggcgccgggccgtttcgcccagcccctcgttctcgtcctcctcctccacgccgtcgtctccgcgtggcagcagcgtcaggagcggcatgatggcagaggacgacgacgacgcgcccaccaccgtggcggcgccaccgctgcagagacgggtgctgtccaggagccacggctcgcgggccactcccggccggtcccaggacctgccgccggtgccatcgaggaccgtccgcgacagtgggccggcttcagatttagatttgatgaaggataagttcgccaagctgctgctcggggaggacatgttccggcacggc

SEQ ID NO: 14516 - DNA, 405 bp, Zea mays
  Clone ID: cC-zmpo148073a05a1
catcccacggtgggaagacatgtgccacgccgcaagaggcaacaccgaaaagaaggacacgcgctaggtccgcatgaagtcggcatgcgtccagtctatcgactgacagacacacgcgaccagcatcaaattacatatgttttaggccggacgacgacgactacgacgacgttaccgaacgtagtagggggtcgggaaaaagaaacatacaaatcaatggacatgttcgtaagggatcatgttggagagcgtgcggcagatctcggacatctcgatgagcgacctgttgtggtcctccatggggttcttggagacggccttcctgaactcctcgtcgcagttctgcgtgtcctgcgccaccatgctcatcgtggcgcggatggtgacggcgtctcggaagccgat

SEQ ID NO: 14517 - DNA, 602 bp, Zea mays
  unsure at all n locations
  Clone ID: cC-zmpo148073a05d1
acccggcgggtgcgatggctggggcctgngcactgctcatcgacctcgttgctgccgtcgcggacctggccgcgcggccggcgtctttaggcggaggagccgcggcggtcgcggagatctgcatgaagactccgttccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcatgacggccgcgacgcccgaggcgcggagggcgctgaacctctgcaagacctactaacctggacgccgtcgacaacctcggcgcctgcaagcgcgccatcggctttcgcgacgccgtcaccattcgcgccacgatgagcatggtggcgcatgacacgcagaactgcgaccaggagttcaagaaggtcgtcttcagaaccccatggaggaccacaacaggtcgctcatcgagatgtccgagatctgccgtacgctcttcaacatgatcccttacgaacatgtccattgatttgtttggttcttttcccgacccctactacgttcggta

SEQ ID NO: 14518 - DNA, 417 bp, Zea mays
  Clone ID: cC-zmpo148073a06a1
ataaccgtacacgatcggatgcacgcctaccttcatggaggtatacctggctgggatgtcccggtactaatgaaaaccctgagctttcattagctcgtctatatatatatataagcaaaacatttcatcagtaaagagattagagattcgtgtctctcgcttttgcttcgtactcaaatagatatatcgagtggcatgcgtcgctacttgggcggtggctggatccacgtgtcgccgaggacgtaatgtgtgccgacgaatggcttggcctgcgcctcggagaggtccagagcccaccccaccctcttcttcttcttggcgacagcgccggggccaaagcacttgaactcgccgtagtagatgccgctgctctccggcttggcgaactgccagccgttccatcccacggggaccacc

SEQ ID NO: 14519 - DNA, 469 bp, Zea mays
  Clone ID: cC-zmpo148073a06d1
gtccgctcctcccgggtcgtgtactcgtacacgaagatgggggaggatgtggtccccgtgggctgggacggctggcatatcgccaagccggagagcagcggcatctactccggcgagttcaagtgctttggccccggcgctgacgccaagaagaagaagagggtggggtgggcgctggacctcaccgaggcgcaggccaagccattcgtcggcacacactacgttctcggcgacacgtggatccagccaccgtccaagtagcgacgcatgccacacgatatatctatttgagtacgaagcaaaagcgagagacacgaatctctaatctctttactgatgagatgttttgcttatatatatatatagacgagctaatgaaagctcagggttttcattagtaccgggacatcccagccaggtataccttcatgcaggtaggcgtgcatccgatcgtggtcggttctgattc

SEQ ID NO: 14520 - DNA, 316 bp, Zea mays
  unsure at all n locations
  Clone ID: cC-zmpo148073a07a1
annannnnanaatttaaaatttccacacngcacgcataanggncggcacggttaataagcagccgcggaccaaacaaccccccccactcagaacaaacaaggaaagccccactgactaggagaagatagagtaactaatagatgcaatccattaaaggtccttaacgagcgccatcgaaccaattatgcaattctatagaaagatccaatccaatccaagcaagaactccgtcgcgtcatccccccacacttggcgagcatgaaactcggagacttgggtgtgtgcgcccccgtgcattgcttatgcatgcttcct

SEQ ID NO: 14521 - DNA, 580 bp, Zea mays
  Clone ID: cC-zmpo148073a07d1
ccggccggatgctcaagacgtgggaggaactggtgctgccgtcggacatacttggccgttcctgctccggttccccggggcggcgttcggtatctgcctgggcgtgagcacccatgcgatcctgtggaagacgatcgcgtcgtcgtcgccgaccacgttcctgcacgtatcccacaaggtgaacctggtgctctggtgcatctccgtgctgctcatgtgcgccatcacggccgtctacgcgctcaagctcgccttcttcttcgaggccgtgcggcgcgagtactaccaccccatccggatcaacttcttcttcgcgccgtggatcgcctgcctcttcctcgccatcggcgtgccgccgtccgtggccactgagcccctgccgcagtggctctggtacgcgctcatggcgcccgtgctcttcatggagcttaagatctacggccagtggatgtccggcggtcagaggcgcctgttcaaggtggtcaacccgttcaaccacctgtccgtggtgggcaacttcgtgggcgcgctgctgtgctgccaacatggtgctcagggagggccccgtattcttcttctc

SEQ ID NO: 14522 - DNA, 423 bp, Zea mays
  unsure at all n locations
  Clone ID: cC-zmpo148073a08a1
atattatatttttataaatataatttttttnggtnttgtttttattaaacggcaatcccctccccaccagggtaatgtaaaaatgtttatccaaagcacacatattcgtgagggtaaaaacaaattggtgaactggcccaaaaaaatggaaagcaatggtacaggggtcaatccctcacttgagggaaaaaacaaaaaacagggcaccaaaaaaaacgggggcataaacgaaaccaatttgttaaaagaaaatcaagtaaaaagaggaaggaaaaaaaacaaacaaaagggaaacgagggggtgccactgccaccgccgtgcccaaaaaaaacacccccacccattgggaatgcgcgggaacaaaaaaacaacgcaaagaaaacaaatttctccccccaccttgggttttttcctccggttcc

SEQ ID NO: 14523 - DNA, 626 bp, Zea mays
  Clone ID: cC-zmpo148073a08d1
cggcgatcgtcggagcggagagagacttcctcgcctccatcccttcccgccgccgccgtctctacggtcgctaaggagccgtcgcatccagggatggagatgaacaccatcgcctgcgccgtcctcgtcgccgcctcggccaccgtggcgctggccgcggaggcgccggctccgtctcccaccagcggttcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttctgttggtttttttcccttcctctttctactagattttcatttaacgaaatggtatcgttgatgcaccaggttaatttggtgccccgttattggttctttccctcgagggagggatcgacacccgtaccattgcttgccatttggctggaccaggccaacaattcgattaaccatcacgtatatgtgtgctttgataaacatattccttaccc

SEQ ID NO: 14524 - DNA, 453 bp, Zea mays
  unsure at all n locations
  Clone ID: cC-zmpo148073a09a1
atagactagtggncaatagaacaccaccagagcaagggaagctgaagtcttacaacaaaaatatgtcgcatacaccttggtgcccatgcaccattacttacaaaaatctcactagtaatgccatttacaccagtttgattttttataatacaataaaaaaagaaaacacgtgaaaggtcaacatcaagaacgacctcagaataatggacgggcaagggggatatatatataatgctcccaaaccatgtgcagataaaagagtagcctatacaactcacggataaagctgctggtgatcgatcatcatcagcggaacgagcatgatgagaatgctggacaatcctgtgcgacgtaagggcttttattagttcgaagccagccttgtctcaaaaaagatcggctttctttttttgcaactcctgctttcaccttggctgctcgtaaaactccttc

SEQ ID NO: 14525 - DNA, 477 bp, Zea mays
  unsure at all n locations
  Clone ID: cC-zmpo148073a09d1
ggccagaaatacttacgacatgccgaggcctttgaaggtataatacttgatgagcctctctataaagccaatngggggaattaaccttgcttcttcaggacatacctctcctgggatagcgcacgatccgtgattcatggaaactctcttgagaagaaactctcagttcttttcggaatgcgttcagagggtggcaataagggctcatgtgatggtgggccaactcaaagggcatcagccttggccgctctttcatctgcattgaatccatcgccgcaaggaaaacagtcagatgagaagcccacaagctcatatgacagcgagcatactcaacgagctttagcaatggcttgccttgtcctctgcccttaatccatcgacaaaacctagcagcacacaggcacaatctcattcaggtcaagggtctcaaagagccgttgctgttgcatcactgtccaatgttttgactgcagaggg

SEQ ID NO: 14526 - DNA, 329 bp, Zea mays
  Clone ID: cC-zmpo148073a10a1
atattattatattttttacctttttttttttttcgttttgttttattttttttttggtttttctctaaaccaacaaaaaaaaaattaacaggtatccgtaaatatcttactttcacaaacctaaaaacctcccccttttaaaataatataaaaaaataataacttaccattttggaccccaatgtaaatatatacctttgctccaccaaaaattgaataaaactgtacctaaaaaaatttcacttggggccaaaaaaatttttgggcataaacaaaaattttttttggttttaaaaatctgctgggctaaaaatttccaaaattaaact

SEQ ID NO: 14527 - DNA, 598 bp, Zea mays
  Clone ID: cC-zmpo148073a10d1
ggttcagttgtagccggtgagacttgggaggcaggcgacatgtttggcgggaaggacgacggccacgatccgtgcaaggcttacaagggattccacggaggaggctacccggccgccggtggatactacggcggccagtaccccggcggtggctaccctgctccaccgggcggcggtgcgtaccctcccgggcctgggtacccggtaccacctggtgggtacccgcctccgggtggctaccctcagcctggcggatacccgccgtcgcacggggcgtacccggcgccgggtgcaggcgcgtatcctcccagcgggtacccccatcaaccggtctacccacagcctggctatccatcgatgcccggtcatggtggcatgtacggaggaggccacggtgcagggggctctgcaggccacggggcgatgctggccggaggtgccgcgggggcgtacggggcttacacggtgtcccactcccacgggatgtacggccacggccacggtcacggcaagttcaagcatggcaagttcaagcacggcaagtttggcaagcaccaagagatgtttggatgcacaaaattatgttcgcccgcagtga

SEQ ID NO: 14528 - DNA, 379 bp, Zea mays
  Clone ID: cC-zmpo148073a11a1
ggggccagcccctgcccggaaattttcaaaagacaatccttgggatttttgggaaaaaaccccgcttacattgggacctttgggaataaaaaaccgtaaaaaggtctgaaacttcgtaagggattgttcggtaaacctaaaccttttgggaaaaaagaatttctggttggcaaacacccacacaaacaggaaggaaaatgctaattccacgcagggaactgggggggggggggaaaaagatgggttctaacacccacacacaccagaaggaaaatgcaattactccccatggaacttgggtgggtggtggaaaaaatgtgtgtctaacaacccccccctaagattggaaatcatctatctccactcagggattttggtg

SEQ ID NO: 14529 - DNA, 480 bp, Zea mays
  Clone ID: cC-zmpo148073a11d1
acccgtccggtgcgcttcgtttcggggcggcgaacggccggtcgagcgctttctccttgctgggtcttcactagtcctggccggctacgagcgtccacctggtgtctactgaactgagcagacagtagcaagagccactatgctgttcttcttctacttcaaggagctcgtggggaaggaggtgacggtggaactcaagaatgacctggcgatccgcgggacgctccactcggtagaccagtacctcaacatcaagctggaaaacacccgtgttgtcgaccaggacaagtatccccacatgctgtcagtgcggaactgcttcatccggggctcggtggtgcggtacgtgctgctcccgcaggacggtgtggacgtggacatcctgcacgacgccaccaggagggaggcgcgcggaggctgaacggcatcggcattggcccccctcacctgtgctgcttctcccccgggaggagaatgatc

SEQ ID NO: 14530 - DNA, 428 bp, Zea mays
  Clone ID: cC-zmpo148073b01a1
aacattgggcttggtttccactctttggaatttggcatacatgactagaattgcctcctaaacccaaacaaaaggattacatatactagaaatcataagtctcaatagtatatatggttagcggtgcatgctctctcatgcaatatatataaacttaattagcttgctgctgcaagtccatagcccaccgtgccggatgaatcgaagggaattcaaagtctaataaaattggaccttggaagtgtaaacggcaatcgggtctccagttcggcgggatgacctctttggcgatgaccttcttgccggactccctggtgaagctgattgataaagggcccttgaacgccttggcagtgttcattcctcagatggccccccaagagagctttatgggctttcaactcagccgacaacctgtcctggatttc

SEQ ID NO: 14531 - DNA, 483 bp, Zea mays
  unsure at all n locations
  Clone ID: cC-zmpo148073b01d1
gggcgacatcgngctgatggaaanccaggacaagnngncttttgatttgaagcccatgaagctctcttggggcgcggtctggaggatggacactgccaaggcgctcaagggccccttctccatccgcctcaccagcgagtccggcaagaaggtcatcgccaaagacgtcatcccgccgaactggagacccgatgccgtctacacttccaacgtccaattctactagactttgaattcccttcgattcatccggcgcggtgggctatggacctgcagcagcaagctaattaagtttatatatattgcatgagagagcatgcaccgctaaccatatatactactgagacttctgaattctagtatatgtaatccttttgtttgggtttaggaggcaattctaatcatgtatgccgaattccaaagagtggaaaacaagcaaaatgttaactcttttacaaaaactaacaaccccaaaattaatcc

SEQ ID NO: 14532 - DNA, 317 bp, Zea mays
  Clone ID: cC-zmpo148073b02a1
ttgaatcctcttagcgccgcctttttttcttcttttttttttttctctttaacacccaaatactgatccgtttcatcaatccaaagccctgaccacatcacaagcaattcaacattccactatcacaaacccaaacttaaccaaactcccacagttacaaactaacaacatatacctttaacaactactcactgacgcaagtatcccatatttacaatacatacacacttactgatctatttctcttatcattcctactaatctttcaacctactacccccattgcctcaacttcttccctcttaacctcaccttca

SEQ ID NO: 14533 - DNA, 574 bp, Zea mays
  unsure at all n locations
  Clone ID: cC-zmpo148073b02d1
cgcccgctaagtcgcgaacgagcgtctnttctcctccgtccgcgcctttattgtttatcggttttgcctgccggtgggggaccggctgcacgagcagcggctagccagacgtacgggcttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaggcaaaggctccaagcaagctatcatctgcattctttggaactcaagataaatgcgcggcctgccagaaaacagtgtatccattggagaagatgactctggaaggcgaattctaccacaagagctgcttcaaatgctcgcac

SEQ ID NO: 14534 - DNA, 381 bp, Zea mays
  Clone ID: cC-zmpo148073b03a1
ctgatccttaaggccgcctttttttttttttttttttaagccatttatttaaccgggaggatttacctatccgcttcatgacaacatatatctctcagaatgacatacccaattattgaacaactacatgataagagttatcactagtcagcaaattggcagactgactattactccttgcttgcacacaatgacaaaggaaccaaagacccactgtaagagcacagtacaatatatgtactacataatgtatagctcatctgggccgtgaccgtgaacccaccttcagcttcacggccaagtataggtcatacttttgtgcggctgtccttgtgcacgccgtcttaatggcttgaaccaccctggatttatcactcaata

SEQ ID NO: 14535 - DNA, 556 bp, Zea mays
  Clone ID: cC-zmpo148073b03d1
gcgcccgcccgcgccgaggtgctccgcgtcggcgccgacttcgcgttttgcttgctccgcgccatccgcttcctgcggctccggtggcaggagctcgcgcacgacctccggacgggcaccctgagcgccaaggtcacggagccgtccatccgggaggccgtggccgaggtgctgaggcccgacgccgacctcgcggactttgtggaggccgagtgcggcaaggagagctgggagggcatcatcacccgggtgtggcccaacaccaagtacctggacgtgatcgtgacgggcgccatggcgcagtacatcccgacgctcaagtactacagcggcgggctgcccatggcgtgcaccatgtacgcgtcctccgagtgctacttcggcctcaacctccgccccatgtgcgacccgtcggaggtgtcctacaccatcatgcccaacatgggctacttcgagctgctgccgcacgacccggacgcggtgccgtcgtccagggacgacccgccgtcgcggctgctggacctggcggacgcccaggtgggcaggactacgagct

SEQ ID NO: 14536 - DNA, 338 bp, Zea mays
  Clone ID: cC-zmpo148073b04a1
tttttcattttatttagcattattagaatattttaaaataaactatgggcatggtatcatagaagatgaatatagatcccattgctggagactttagaaacttctgccaaaacggaaaaaactgttaacagtcaaagctagccgcgaaacaagatagcatcgtactctggatgcgtattacatcctgttgcttgcgggaagcgttatgccatacagcttggacaaagcattatcacggaagttcttgtacaggaggccatcctcaaggccattgtactgcaatcccgatcattcatttgccaatatacttcaacttgcaagagcaacgatcccacaaa

SEQ ID NO: 14537 - DNA, 505 bp, Zea mays
  Clone ID: cC-zmpo148073b04d1
gggcgaacacccgtccggccacgcgtcctctgtgaaaacagtactcatgcttgctgatctattgataaaccgagtggaatacatgcattgggggggatttattcattgtgacatcaagccacacaactttcttatgggcttaggtcggaaagctaatcacgtctatatcattgattatgcgacttgctaagaaatacaaggaccttgatactcataaacacatcccgtacagggagaacaaaaatctgactggaacagcacgttatgctagagtgaatactcatcttggaatagaacaaagtaggagagatgatctggagactgctggctatcttctgctatattgtataagaggaatccttccatggcacggtcttaaagctggcactaagaaacagatgtatgacaaaataagtgaaaagaaaatgcttacctcagcagaggttctttgcaaatcttacccgtacgagatccgctcatatttcaactatagtcgcttcctgcg

SEQ ID NO: 14538 - DNA, 570 bp, Zea mays
  Clone ID: cC-zmpo148073b05d1
cccgtgcggcgaggcgtacagggggaaaaactgcactgacactcgcccttcgtccacaccatcaacggccagaggtacccgctggatttaacctgttccacaggagcgcccactgtcctcttgcggtcatatttatcctttaccagctgggctcccctgactccttctactaccacctgaagcggcatctgtgctagatggtccacgaccggtgctacttctccgatgaggatgagttgtggatggaggccgttctaattcacctgcgctcgctgcataatctcaccggcagctactttcgctacactggctcccttaccgtgccgccctgcaccgagaacattctctggagcgttctctgcaaggtgcgccaaattatccatgaccagttgcagctgctcaaggcgccgtttgcccggagcgacgctcgcccaaccatttcgttaacggcaggaccgttcaattctacaacccttccatcataccatcttctttcagatctaacactataaatactttggaatcttaatatagagtaactctgttttgaaaaatcatttctatcatttg

SEQ ID NO: 14539 - DNA, 492 bp, Zea mays
  Clone ID: cC-zmpo148073b06a1
tttattatttacctaaatttaactcgtattcttttagaatcaggggcgggttcaaatgcacgtcacaatggccatacattcaagcaaaagaagaaaaagaggaagattccgtggtaccgtcggcggtttgaacaccctgctgacctggctctctttctccagccgtctttccttcctctattctgaccggaagtgctggtcgtcttcaaccttctatgcacatatgtggtgcagtgcagtgcaatgcatcgcatgctctttgtcacctcacctgtgcagtctacccttaaggcaacacgcactcaatcttctgcggagctgcctccccatgtccaactttaacagtatcagaactaatgctcttgtatatactcttagaagagatatgtgcatgttccggtgctcctgccttactgatctgcagcttccatcccattatagtagagaagagatcgtcctatcatcctgccttgcaaaaaccgcatctgaatc

SEQ ID NO: 14540 - DNA, 519 bp, Zea mays
  Clone ID: cC-zmpo148073b06d1
gtccgcccacgcgtccggtgcgcgctgctggaggaggacaatgctgttttcgcgatcgcagagatcagcagggtcgtgggtttcaagatggcgaccgattgccttgagctccgggcgtggttctaccttgcgcttgagcagtgcgagctggctgtgcaggacgtgagggcgatattgacgttggatccaacctacatgatgttccacgggagaatgcacggggagcagctgattgagctcctccgaggacaggtgcagcagtgggatatggcggattgctggatgcagctgtacggtcggtggtcggcggtggatgacatcggctctctggcggctgtccagcagatgctctccagggaacccggaaacagcagcttgcggtttcgacagtcacttctccttctaaggctaaactgtcagaaagctgccatgcgcagtttgcgatatgctcggaacaagcacgctccatgagcatgagaggctcgtatacgaagggtggattctgtatgacagtgggca

SEQ ID NO: 14541 - DNA, 544 bp, Zea mays
  Clone ID: cC-zmpo148073b07d1
gtccgcggcgtctcactatgcaccaccgcgccgctccggtttaatttttcctcgaccggccagcgcaattctgtgccgggatcgatcggtcgtaaggcaagtgagcaagctatatatatatatatatatatatatatataggagattcttcgagcgagctagtagcgagatgggttccgccgacctcttttactgcatctgcatcgccgccgtcgtcgcattgtcgtcgtccatggtcgccgtcgggtccgccgccccgggggaaacccccaagttcatctcggcgagcgcccttgagtgctccgctaacgtaacggaaatagcaaaggcgcgcaagctgatcgatgtccatggccacgggctgtgcccggtgcggttcgaccacacgcgcgggatcagcgcggtggccagcagctgcaaggaccgcccgctgccgtcgccggagcgctgctgcggggcgctcaaggcctacgcgtgcccctacagcgagctcattaacgacaacgccaacaacggctgcgccagcgagatgttctacgtcatc

SEQ ID NO: 14542 - DNA, 416 bp, Zea mays
  Clone ID: cC-zmpo148073b10a1
tttttcttttttatcataataataacggtccgacgtatatggggatgggccggaaggcctctatatataggactccaactctatttagcaggaagatcagacaagagatgtcccgctaaacaacttggctgaaacacaatctaatttggaaaagcgaatgaagcggaaattaaaaagaactagtgagctagatcatcatcaaggatgagataccatgcatgcatgcaaaaggaaggtcatcatcagaccaggcaagccagtgcctcgatgcttcccttggcggagcccttggcgttgctgcagacggccatggttttgttgttcttgccggcgtactccacgttgacatcgatgagggagacgccgctgcatggttgcgtctccgagcagagcaggctgatggccttgggcgtgga

SEQ ID NO: 14543 - DNA, 536 bp, Zea mays
  Clone ID: cC-zmpo148073b10d1
gtccgcccacgcgttcgatcgacatcgacaactcagagagcatcaccttgaaggacgtgaacatcaccgcgcccgccggcgttgttaacacggacggcgtccacgtcgcaggctcctccaagatcagcatcctcaactcgaccatcggcaccggcgacgactgcgtctcgattgggcccgggtgcaacggcgtcttggtggacagcatcacctgcggccccgggcagggcatcagcgtcggctgcctaggccgctacaaggacgagaaggacgtgagcgacatcacggtgcggaactgcgtgctcaagaacaccaccaacggcgtgcgcatcaagtcgtacgtggacgccgagtccgtgctgacggcctcccatctcaccttcgagaacatcaggatggaggaggtggccaaccccatcgtcatcgaccagtacttctgcccgcagaaggtatgccctggcaagcggagcaactcctcgcatgtcttcggcaggacgtaacgtttcgcaacatcaccggcacgttgtccacgcccg

SEQ ID NO: 14544 - DNA, 437 bp, Zea mays
  Clone ID: cC-zmpo148073b11a1
ataagcagaacaaaagattcttttggggtcagttttactaaagttatacagctaataatatcctatatatgaaatggaatggaatggaatggaatggaatgtgatttaatgtagatcttcccagctccactgaatatattagcgaccgagcaatcagtacatacagacgaataataagcatacatatgtccctggcctggactgatcaactccgacccaattgtgaatcaaaactctacgttggcctggtaggttgcggactttatgttgggtttcttcttgggcgagatgctattgaggacgagcgcgcagtgcacgttgactttaatttggcggaggtcgacggagccgaactgcaacttccacggggactctgacgaaaatgtcgagcgggatgtccccggccttctcgtttttctctagcgcctgctggagcc

SEQ ID NO: 14545 - DNA, 640 bp, Zea mays
  Clone ID: cC-zmpo148073b11d1
acccgtccgagctcctaccccacccgccacccgtcgacgccggcctctctctttacccgctcggagagtcggagcccggcggggggagggcgacgtcgtccctaataaatactaataatttatcactatacataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaccgcctccgtgcgcgccgagaaccccaacgagatgatcaccatcaggtacggcgagggctcccacaccgtggtctcctaccgcggcacgccgctgtgctccgggaagcttccgggcctttttcaaggctacaagaacgtcaccgtcatggacattttcatggaagccggcacggcttcggtcggggctccgcaagcgctaaggagagcagaagccggggacaatccgtcgacatttcgtagcgtcccgtgagctgcact

SEQ ID NO: 14546 - DNA, 390 bp, Zea mays
  Clone ID: cC-zmpo148073b12a1
atatactaaaaaaacgaataaggcttttagggttggggtttttttattcatgcatgtaacaaggccggaaccggaaaccctagaacatatatatatacgtacgtattcaacagcagcacatacatatacatgtaaggaaataaaaataattcgatatagtacgtacgccttggaaagacctgcatgcggcgtggcatcaatataatataaattataatatgcatgcaaatcgatgcaagaaggtcgagaagcgatcgatcatagtagatagcatgcatatatatatataataattaatcgattcatgcggcggtggcggcgacagcggcgtggtgtgtgaattctaaggcgatgtgcgccatacgaccgtactccctgtcgtgcgcggcg

SEQ ID NO: 14547 - DNA, 501 bp, Zea mays
  Clone ID: cC-zmpo148073b12d1
gtccggcagggaacatcgtgcatccgagctaagtaattaggtcgaaatttacccgtgccagcagcagtagcagcagcgggggtgtgacgctggtactgctcggtctccgcctgctgcttctggttggtgttgcgcaggcggtagtggagttggtgcctgctgatgataatatcgccgccgccgctgctggcacggcggtggacgatggcgagccgtctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgccagcaccgagtccaagatcgacgaccttcgcggagctggaggcggcgtcgtctgatccgaatgcgcgcgcccgctttaaccactgcctggagcaatac

SEQ ID NO: 14548 - DNA, 368 bp, Zea mays
  Clone ID: cC-zmpo148073c02a1
acatgtagcatcacatatttctgaggtggtttggtgccacaaaataaccatagaaaaaatattgtcttgctaacatgagcaccaggtgagctcttttgaaatataattcatcatcagaggctgattagatgctgagtgtggtcttataggtggtgccggccttgaaatcagcggggatgacgtcttcagcgatgcggtagccaccggacttgacagcaaagcggatgcaaagggggtacttgagcggggccttggtgtcgagcgtccaggtgccggtcgggccctccttgagcgtaaaggataagtcatcgcccccgtgctctttgatctccacgtcggatatggttgcaacattgggggtgaggatc

SEQ ID NO: 14549 - DNA, 538 bp, Zea mays
  unsure at all n locations
  Clone ID: cC-zmpo148073c02d1
gaaagaaacaggcacacaagaacaaanaccncgctaccaattttgttctccaggacctccatcctacttggggcggggatgctggctgcgctgtttgcggctggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagaccggtggctaccgcatcgctgacgacgtcattccccgctgatttcaaggccggcaccacctataagaccacactcagcatctaatcagcctctgatgatgaattatatttcaaaagagctcacctggggctcatgttagcaagacaaaatattttttatggttatttggtggcaccaaaccacccaagaaatatgggatgctacatgtcccttttg

SEQ ID NO: 14550 - DNA, 397 bp, Zea mays
  Clone ID: cC-zmpo148073c03a1
ataacacagcaagtctgctggtggacgggttatactttcatcaaacaacctggacatacatcctttcagacacaccaagaaaaaaaaaagagaactttgcaaatcccatcaaagtgtgtccttatttcaaatgtgacaagcaggtcaaatgcaaataaaacatagcgaccgagaaatagcaggagcatgcttcacttggtccaccagtgaaggaaatccttacacctgttgatcttcttttggagctgaagaacgccgtacagcaatgccttaacaattggtgggcacccagggacgtatatgtccacagggactatacggtcacattcacgtacaacagagtatgagtaaaggcattatccaccaacgttggcacaattgcccattgaaaataacc

SEQ ID NO: 14551 - DNA, 434 bp, Zea mays
  Clone ID: cC-zmpo148073c03d1
cgccgggttatttcaatgggcagctgtgccaacggtggtggattttacctttactcctactctgttgtacgtggaggtgagcgtatagtccctgtggacatctacctccctgggtgcccaccaactgctgaggcactgctgtacggtgttcttcagctccaaaagaagatcaacaggcgtaaggatttccttcactggtggaccaagtgaagcatgctcctgctatttctcggtcgctatgttttctttgcatttgacctgcttgtcacatctgaaataaggacacactttgctcggatttgcaagttctcttttttttttcttggtgtgtctggaaggatgtatgtccaggttgtttgatgaacgtataactcgtgtaccagcagacttgctgtgaatctaaaaaaaaaaaataatatatataaagggcggcc

SEQ ID NO: 14552 - DNA, 261 bp, Zea mays
  Clone ID: cC-zmpo148073c04a1
ttttcttattttttttctatctctcctttttttaatttaattatggattggtaaaactttaatcacatatatttccaaacccaaaaaggaaatctattcaacaccttccctgttcttacaactgactagccctccatctctcaccctgttattgcccttccttttcctcccattcccttttgattaacaaccacaaaaattttaaaaaccttttctaccaagcagtaaacattctcatttcttgccaaaaaaggtgaccta

SEQ ID NO: 14553 - DNA, 604 bp, Zea mays
  Clone ID: cC-zmpo148073c04d1
gtccgcccacgcgtccgatgctctctctcctctctcggccttctttgtgtgtttccctctttttcttaggccgccctggcacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcgtcgatgcgcgtcgcggcggagaaggccagggaggccaagagccgggtggacgagttcgcggcgaggaaccacgagggccggccgatggagtccatcctcggcgcctgcagcaacgggtacggcaacgttgtgcagacgctcgaggaggcgcggaagatcgtcgccacgcgggcggcggcgggcacccaggcccaggccgacgacatgaacacgaagctgtctgccgtcgtcacgagcgccagcgactgcgacaac

SEQ ID NO: 14554 - DNA, 455 bp, Zea mays
  Clone ID: cC-zmpo148073c05a1
ggaatcatatcatttttttgggacgggacgcatttctacacgaagtgaccaaatccccactctacacgaacacaatcacaagcaatgccaatagcgccgccagcaatagagctggcgccacccgaccactggcactgattatctggaccgggaacaggcaaccgcgcgtggaggcgttcttgtctgtgatcttggcaagcccttcgaagtcgcaggcgcgcacatcctggtcctgcatctggaagtacatgttgaacgcgtatgatatgttgctcttctcgtccagcccattgcatgagcagccatagccgaatgccgttcaatcgccgctcgcacatgcatactggacgatgctaagcagcttggacttgtcctcggccccgttgtcaaacacgcaccactgtttcgggaggtactaaagttcgttactggcgaaaagcaactttttttggccc

SEQ ID NO: 14555 - DNA, 567 bp, Zea mays
  Clone ID: cC-zmpo148073c05d1
cgattttcctctcctctgctctcctctccctccatctaaggagatgagagatatgcagctcacgagctccaccaaggcctgacctcccaaagctgtggtcgcgatccaaacagaagggaaatgatcaggcgacaacccggcatggatcggttcctgcagctgctggccgccggcgtggccgtgctactgctagtggcaccgccggccttggctgacgacgacattgtagaagtcggcgtcaactggggttcgcagctctcgcacccgcttctccccggctccgtggtgaagatgctcaaggcgaaccgcatcgccagggtcaagatgttcgacgccgactcctggcccgtcggcgcgctcgtcgactccggcattgaggtcatgctcggcatccccaacgacatgctggagaccatgagcagcagctacggcaacgcccaggattgggtcaaggagaacgtcaccgcctacggtgacaagcttaagctcaagtatgtggcaatggggaacgagccatttttcaaggcatacaacgggtcattcattgagaccacctttccggcgctc

SEQ ID NO: 14556 - DNA, 395 bp, Zea mays
  Clone ID: cC-zmpo148073c06a1
caaatgcacgtcacaaggcataaattcaagcaaaagaataaaaagaggaagattctatggtaccgccggcgtgttttgaacaccctgctgacctggctctctttctccagccgcctctccttcctctcttctgaccggaggtgctggtcgtcttcaaccttcgatgcacatatgtggtgcagtgcattgcaatgcagtgcatgctctttgtcacctcacctgcgcagtctacccttaaggcaacacgcactcaatctcctgcggcgctgactccccatgtccaactctaacagtaacagaactaaggctattgtatatacttttagaagacatatgtgcatgttccggtgctcctgcctcactgatcttcagctttcaccccatgaaaatatata

SEQ ID NO: 14557 - DNA, 519 bp, Zea mays
  Clone ID: cC-zmpo148073c06d1
cacgcgtccgcccacgcgttcggtgcgcgctgctggaggaggacaatgctgttttcgcgatcgcagagatcagcatggtcggcgttttcattatggcgaccgattgccttgacctccggtcgtggttctaccttgcgcttgagcagtgcgagctggctgtgcatgacgtgagggcgatattgacgttggatccaacctacatgatgttccacgggagaatgcacggtgagcagctgattgagctcctccgatgacaggtgcagcagtgggatatggcggattgctggatgcagctgtacggtcggtggtcggcggtggatgacatcggctctctggcggttgtccagcagatgctctccagggaacccggaaacagcagcttgcggtttcgacagtcactttttcttctaaggctaaactgtcagaaagcttgcatgcgcaatttgcgatatgctcggaacagcacgctccattgagcatgaaaggctcgtatacgaagggtggattctggatgacagt

SEQ ID NO: 14558 - DNA, 336 bp, Zea mays
  Clone ID: cC-zmpo148073c07d1
gtccggccagggcagagcaggatgttcagctccggatcggagtacgttaccggggccaactacgcggccaacatcaggaggttcatgaaggtggccttcgagagcagccagttcagcaacgactacagcgggacaagcgagtacggcgccgacttcggtgacgcggcgacccagcggcagcaacatcgctgacctcctcgtccgagatgcgtgtgtggtgtacaatatttataccaaggggtcgatgtcgactgtcggatactatcagagatacccaaccctcgatcgtgacagctttagtacatgtaatgatgctcataaaatgtcatgtaacgt

SEQ ID NO: 14559 - DNA, 482 bp, Zea mays
  Clone ID: cC-zmpo148073c08a1
aaacgaataaggcttttattggggggggttttttttttcatgcatgtaacaaggccccaaccggaaaccctagaacatatatatatacgtacgtatccaacagcagcacatacatatacatgtaaggaaattaaaataatttgatatagtacgtacgccttggaaagacctgcatgcggcgtggcatcaatataatataaattataatatgcatgcagatcgatgcaagaaggtcgagaagcgatcgatcatagtagatagcatgcatatatatatataataattaatcgattcatgcggcggcggcggcgacagcggcgtggtgtgtgaatccgaaggcgatgtgcgccatccgaccgtactccctgtcgtgcgcggtgacggggacatcctactcctcgcccttccacgcgttcttgcaactttcggaggcgcccattgcggcggacagctgatccatggccttgccgaagatcttccct

SEQ ID NO: 14560 - DNA, 441 bp, Zea mays
  Clone ID: cC-zmpo148073c08d1
gtccggcagcagggaacatggtccatccgagctaagtaattaggttgtaaatgacccgtgccagcagcagtagcagcagcgcggcttgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtacgagacgcacgccggcgtggcctacgaccactgcatggcgtcgctgggcgccgacccgcgcagcaaggaggccggcaacaagaacatgcacgggctggcggtgctggccaccaggatggccatcgaccacgccgtcagcaccgagttcaagatcgacgacctcgcggag

SEQ ID NO: 14561 - DNA, 311 bp, Zea mays
  Clone ID: cC-zmpo148073c10a1
taaaaaaaaaaacccaacccccaaataacttaaacccccaaccaaaattaccacacctttaaaaagttacatgcccttttccccttaaacacaacataaaacctttaatatccccttataaccccaaaaaacattttttctacccaaaccaaaaaatattcttatccccccctccaatgttcaattctaatcaatttccaattgaatcctttgcgctcccttcatacaaaaaagcaccccctccatttgggggggaaaactttcaattctttaaactggataaaaaacacctcatccctttccaataaaaa

SEQ ID NO: 14562 - DNA, 438 bp, Zea mays
  Clone ID: cC-zmpo148073c10d1
gggcgaacacccgtccgcccacgcgtccgcccacgcgtccggtctactccttcaacggttctcggatgggcgcccccttcaacaacaccagcttcatgcagggggtgccgggcctcgcttacctcgagcccatcaccgacgcgaagacgacatcggaacccatgcttcccggcaagcagcagtcggtcatctcgttcaccaggaaagacgcgcccaatgtcaacattcccagaggggaaggtttccccaagagggtctacttcgacggcgaggagtgcgcgctcccggataggatacccaaggtgtcgagcgcgcgccgacgggctgggaccgcgaacctgggtcagatagccatggcggcggcgctcgtgatgattgtggcgctagtggattccttgtgcctatgatgactgaaaacttctttggttcataaaggat

SEQ ID NO: 14563 - DNA, 581 bp, Zea mays
  Clone ID: cC-zmpo148073c11d1
ccgtccgcgatccctgtccacggcgttgggagcggcgcagcccatggttgtcaacgagagagagaaagagaatgagaaggggaaggataagcactacgggactgacgtccccgatgaagaagaggacgaggaaggtaacatgcgagtcgtggtgcttggcccccaggtccccctcaaggagcagctcgagctcgacaaggatgatgagagcctgaggaggtggaaggagcaactccttgggcaggtcgacacagagcagctgggagaaactgcggaaccagaggtcaaggtggtggacctgacgatcctgtcacctggcagaccggacctgatccttccgatcccgttccaggctgaccagaagggctatgcgtttgccctcaaggacggcagcccctacagcttccgcttctccttcatcgtctccaacaacatcgtgtcaggccttaagtacaccaacactgtctggaaaactggagtcaaagtggagacccaaagaagatgctggggacgttcagcccccagctagagcccttaggctacgagggcgaagaagagaccacccctgcttgcatttttgc

SEQ ID NO: 14564 - DNA, 534 bp, Zea mays
  Clone ID: cC-zmpo148073d01a1
caagcctgttgacatgggccgaggacgggcgtagtctacactgtcgcgcaatttgtagtaagagaatttacagttgcaaagggttgctataacatatgttttcttcttcatctgctgcctttcactattcaccacggcaaaattcacctccactatgtttaaagaagcaaagggaaaataattcctggtatctcccgatccaggttttctgaagtattggcctaaccaacccgaccttggagcttcctgatgcacgctctaataagggcctgttctgttttatgagactatgatagccctagagaacgagaaaagcgatctgcaaggttcgcgataacaaagcctgaaaatacctggacagaaccaagaatatatactgctgaatagtgacggccgtgaatgatcatattagcaaccattgctattggaattgggagagacattgctagaatggccaccaagggagtagtccaacaacagaaagagcccataagtagtctgataatcacttccgataggctatttgcaccacca

SEQ ID NO: 14565 - DNA, 583 bp, Zea mays
  Clone ID: cC-zmpo148073d01d1
cccctttgaagaatggtgaatttcagaagatgttggttttggtttcacagaaaactatagtggtaaggggccgtgatgtgagcatccctgtagtggaagagacaaaaccactcatatgcggaatcactgaaatggatgatggccttttcaaggacaagcaactttccactaaggagattgcaacgtatggattgtatctttgccccttatggtttgtgacagagtatttatcgaatgcagcgcttgcaagaactagtgttgccagtaccacagtgctgtcttcaacttcaggactcttcactcttttcattggtgttttacttggccaagactccataaatgctgcgaaaattattgctgttttcattagcatggctggcgttgtaatgacaactgtgggccagacttgggcatctgatgaatcagaagcaggcaaatctggttttacacagaggactcttctaggtgatatgtttggtcttatgtcaacaatcgcctatggcttattactgtgctgcttaaaaaatttgtggagaggaaggagaaaaggttgatgttcaaaaactgtttggttatcttgggc

SEQ ID NO: 14566 - DNA, 334 bp, Zea mays
  Clone ID: cC-zmpo148073d02a1
aacacctaaaggttggggtaatttaaaaaataaattttataccctcaaatttagggtgttacaccgtaaaacataatatatctgtcggatgtccttcattttactgatgagcgttaccaatggatagcatgtaatgggcaatgcaaggacgagagaaaaattataactagagaaatgggtcaacctacggagggtctaaaaccatgcaaacttcttgaggtaacccttggtgctgcccttggcgttcgtacatattgccaaggacttgtagtaggtgccgctatacttaacatttacatcattcatggggacccccgtgcatgggacctttgca

SEQ ID NO: 14567 - DNA, 581 bp, Zea mays
  unsure at all n locations
  Clone ID: cC-zmpo148073d02d1
gatcaatcacgacaggatggcatgcacaaacaatgcgattttagctttgttcctcctggncctcttctgcggggggcgtggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgactgcaagatccttcccaactcgttggtgatggacttcgtgaacaaccgggaggtgttcggggtcacgctgctcacttcaagttctttccatgaacatg

SEQ ID NO: 14568 - DNA, 411 bp, Zea mays
  Clone ID: cC-zmpo148073d03a1
atcaaccaattcaacatcacatctcgattcgaccaaacaacatgacagcctaaaccccccccccccaaaaaaaataaaagatcaacacaatgtgcagggaaaggaaaaacgatggcctgcacctaattcccagcaggatcttcagtggtcgtgcgcctccttagcttggcacgcgtcacacagatcgtctcctccatcggcgtctcctcttctagcgcatggtcaagctcttctgcgccctctggggcgttaccactggcctcgtctatggccatcttgtccacccctttggctccagggagtgatgggacccttggctcgcttttcggtgaatcggcacctgtggttggagtttgaactgggtctgcaacaagtttgaccttgcctttctttgggctaccaccatgtttt

SEQ ID NO: 14569 - DNA, 606 bp, Zea mays
  unsure at all n locations
  Clone ID: cC-zmpo148073d03d1
cccgggcgccggccggccgnctcccgnccacatccctcctcctttcctgttatggntcctgngcggaatgtagcggagaggggtcggagtcggagtcggagtcggagaacatgatgggcgggttcctctccagggtcctcctgttggcttttggctatgcctatcctgcctacgaatgctacaagactgttgaactgaacaaaccagagattgcgcagctcatattttggtgtcagtattggattttagttgccctattgacagttttggagagattcggagatttcacaatatcatggctaccgttttactcggaagcaaagctgatgttctttgtatacttgtggcaccctaagacaaagggaactacgtatgtttatggaactttttttaaaccatatatttctcagtatgagaatgaaatccaccggaatctccttgagctgagagctcgagccaccgacacagttgtactttattttcagaaggctgttttggcacgaacaaaatacttttttttgacgttttaaaatatgttgttgcccagtcaccttttaaaaaataaggcatcctccttcataagaattaacagtgccgcccaacaac

SEQ ID NO: 14570 - DNA, 332 bp, Zea mays
  Clone ID: cC-zmpo148073d04a1
gattaggtgtaacgattcgggatgcaatccgacacaaacgaacaaggccttagccgtcttgcgctgcgctgcaacttgtatgataaaacgaacaatgggtgacaatagcaagaatccagcactcagaatttggtacagccacgcagttacatttttgttttcctttcctttctcagttacatatttgtaatccaggtgaataggatttgtggtttagtgccagccagtctgctacgactgctgtcggtcgtcgacgacgtgctattacatattgatcgtcgtcgtcgatgtgctattactgatcgtcgtcgtcgtccgagttcaactgtttg

SEQ ID NO: 14571 - DNA, 594 bp, Zea mays
  Clone ID: cC-zmpo148073d04d1
gtccgctcgtcgtcgtctcactcaccccgccttcacgcctccctcactaattaaggtcccgcccttttccgacattcggaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgcaacccgctcggctaccttaaggacgtgccgctggccatctgcgcctcgctgctcaaacagttggacttggacgacgac

SEQ ID NO: 14572 - DNA, 402 bp, Zea mays
  Clone ID: cC-zmpo148073d05a1
cctatcagtaactgccagcatgcctttttgttattatccattcaatcgatgaaaaacacacatttccgtgacattacatttggagttccatcgacggtatatatatttgaacaaaaacaattatcttagaaaatgccatattaataggaatacaatatatatttccgtccatatcagatggttatcgtatgcgtggccagccggtgacgacttacgtatagactcgctcagcgcctgagctgaacgccacgttaccccggcgcatgcatacatgcatgcatgcatgcatggttcattcatttcaaggggcttcgcttcaagaaggaagaagggtgcaggacctcttgcagttttcgatgaagcgctggttctttttcttggcgcatgtgacgcttcatgcct

SEQ ID NO: 14573 - DNA, 625 bp, Zea mays
  Clone ID: cC-zmpo148073d05d1
gggcgaggcggcggaggcgaataacatccaggacgacttctgttctacgctgtgcgagggcaagaaggggacggggcctgttttgtgcaatgagtcctgcgcgctctcccatcattccaacctgttgctgtactgcaggatccagtgcaagggcaagtgcaccgagcagaatggcatcacggtgccggccatgaaggtctgtcaggaggagtgcgacaaggcgtacgtggtgaaggcggccgaggtcaccaaggtctgcagcgtcacctgcgccaaggagaagaacccgcgcctcagcgagaactgcaagaggtcctgcaccccttctccttcttgaagcgaagccccttgaaatgaatgaaccatgcatgcatgcatgcatgtatgcatgccccggggtgacgtggcgattcagctcaagcgctgagcgagtctatacgtacgttgttaccggctggccacgcatgcgataaccatcttgatatggacggaactttatatagtattcctataatctggcattttctaagctaattgtttttgttcaatatatatcccgtcgattgaactccaaatgtaatgtcacgcaaatgtggtgttttaatcgattgaatggatataatta

SEQ ID NO: 14574 - DNA, 310 bp, Zea mays
  Clone ID: cC-zmpo148073d06a1
tcaattcgatgaaacaacgacacagtttcgcgtcgacaattaccatattggagtttccatacgacgagtatattatggaaataaaacaatttagcttagaaaactgccacgattaatcaggaatacacatatatagtctccgtccatatcagatggttatcgcatgcgtggccagccggtgacgacgtacgtatagactcgctcagcgcctgagctgaacgccacgtcaccccggcgcatgcatacatgcatgcatgcatggttcatttatttcaaggggcttcgcttaagaaagatgaagggtgcaaga

SEQ ID NO: 14575 - DNA, 594 bp, Zea mays
  Clone ID: cC-zmpo148073d06d1
ccgcagcatggcatcatgggccgctctcttggtgctagccctcgttctagtggcggccaccgccccacaggtagggggggcattgaagaagagagcggcggagagcggcgaggcggtggaggcgaagaagatccaggacgacttctgctcgacgctgtgcgagggcaagaaggggacggacctggtcgtgtgcaaggagtcctgcgcgctcttccagcagtccaacctggtgctgtacggcaggatccagtgcaagggcaagtgcaccgagcagaagggcatcacggtgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctccttcttcttgaagcgaagccccttgaaatgaatgaaccatgcatgcatgcatgtatgcatgcgccggggtgacgtgccgttcagctcatgcgctgagcgagtctatacgtacgttgtcaccggcttgccacgcatgcgataaccatttgttttggacggaact

SEQ ID NO: 14576 - DNA, 366 bp, Zea mays
  unsure at all n locations
  Clone ID: cC-zmpo148073d07a1
aaaacatnaatttttccttaacactcgnaagacttggcttgggttgggttctattcccaactgtacattaatctgcaccacatgaactaccctgactgacccagaccccattaagtttacaatccgacattcacaagaggtgaaaatgctattgcttcgtgtcgcctgttcttccttccttcacctgctggctgcagcaggagggatgctgacccactgcagctgcagatgaatctccccgctctccacgttcctgaggcggaggatcatgtcctgcgcgaacttgccgttcctccatcacacgtggctctcgtcggcgaggcaattcgtggcgctcggccgcaccgacaggatgatggcgccgtt

SEQ ID NO: 14577 - DNA, 547 bp, Zea mays
  unsure at all n locations
  Clone ID: cC-zmpo148073d07d1
cggaaagaagtcgcctggttctttcgatcgaattaggcgcctncttcgtcccacgctccgtctttatttgtaatcggaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcaggacatggatcctcgcctaggaacgtggagagc

SEQ ID NO: 14578 - DNA, 476 bp, Zea mays
  unsure at all n locations
  Clone ID: cC-zmpo148073d08a1
nannnnnncttttcgatttgacaaccacgagcatcattataggcggggtcgtacataaacaatggcagagtgagagatttggatggatcccccgcacgcgcccgcagacgtcgacctaatataatgaacaatgcgggggcggccggaatcaatgaatcatcagtaacggagtataaatcatgtcatgtcagggaagaaacgaaacagcgggacacacacgcatggccatggggatagatcactgcgtggcgacgagctgcacgccttggacggcgagcgcggcgagcgggccgatggcgagggagttgatgtacgtgcagggctcggtgtaagaggagttgccgcgcttgtccacgaagccgttgttcttgtcgggcccgccgaccatggcgccggtgagctcgttggggttgggcttgtcgggcgccatccagtccccgaagctgaggcccaagttgacttccgtgccggggggc

SEQ ID NO: 14579 - DNA, 614 bp, Zea mays
  Clone ID: cC-zmpo148073d08d1
aatatttggggcgaaccacgcgtccgcccacgcgtccgagcggatggactacctgctgggcgccaactttcggcacagctcctacgtcgtgggcttcggcgccaacccgcccacgcagccgcaccaccgcggcgcatccacccccgtgctgccccccggcacggacgtaaactgcggcctcagcttcggggactggatggcgcccgacaagcccaaccccaacgagctcaccggcgccatcgtcggcgggcccgacaagaacgacggcttcgtggacaagcgcggcaactcctcctacaccgagccctgcacctacatcaactccctcgccatcggcccgctcgccgcgctcgccgtccgaggcgtgcagctcgtcgccacgcagtgatctatccccatggccatgcgtgtgtgtcccgctgtttcgtttcttccctgacatgacatgatttctactccgttactgatgattcattgattccggccgcccccgcattgttcattatattaggtcgacgtctgcgggcgcgtgcgggggatccatccaaatctctcactctgctattgtttctgtacgtccaagattataatgatactcataataatctcgtcgg

SEQ ID NO: 14580 - DNA, 431 bp, Zea mays
  Clone ID: cC-zmpo148073d09a1
agcaagccctttattcatcgagtgaacggtacaaaaaattaccgcaaatgcttatttgcgtgacgttacattaattgggctgttatatatgtgtatgaagcagtcgacgaaactatacatcgtcggtcatcaaattggtaggtatacccatgcatgcatgcatcaaatcgtcatcgcatcccatgcatgcatgtatgatgtatcagtgattcagtgtcactcaagcaggcagaagacgacgaccggcgggcgtgctctgcgttcaggaaggaggaggggtgcaggacctcctgcagttctcgctgagcagaggctgcttcttcttggcccaggtggtgttgcaggccttggcgacctcaaccgccttgaccacttatttcttgtcgcacgcctcttggcacaactttatctgcggcgcggtgatgcccttc

SEQ ID NO: 14581 - DNA, 448 bp, Zea mays
  unsure at all n locations
  Clone ID: cC-zmpo148073d10a1
atttnnnntttttgtttagaaaaaccccatattaaagacgggaaatatgcttgcttacatatatatatacacatagagaaagagagagtaatataagtaatccatcgacaatgcttaataatccaaaaaggatgggatcggggtacgcacacgtacgcgtgtaaaagaagaataaatgatggcagaaaatataaatgggtgatgagaattgcaattgcaataattgggcggttaatctccaccttgagtagaagcctcctgttcttctgctttggttacacgccccgcggtagctgctgcttcctcctcctgcagctgcaggttggagcggcgaccatacgcgcgtgcattcacgttggcgtggaagcgcgcatcactggagatgaggttcattgatctgcgcgccccccgtggttccttgtggcgggactcctgcgtgcgcctgttc

SEQ ID NO: 14582 - DNA, 628 bp, Zea mays
  Clone ID: cC-zmpo148073d10d1
gtccgatcggattggaactggatcggaaggaaggtcctgcaggccgttttgtcggtcgtcgatcgaggaaccaagcggcggctgttgctaccggacgacaccaaccatcatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatcttcagtgctgcgcgcttccacgccaacgtggatgcacgcgcgtatggtcgccgctccaacctgcagctgcaggaggaggaagcagcatctaccgcggtgcgtgtacccaaagcagaagaccaggaggcttttactcaaggtggagattaaccgcccaaatattgcaattgcaattctcatcacccatttatattttctgccacatttattctttttttacacgcgtacgtgtgcggaccccgatccctcctttttgaataattaacattgtcgatggatacttatatactcttccttcctaggggaaataataagaagcagcctatttggatgttttaaaaaaaatatttttacccc

SEQ ID NO: 14583 - DNA, 411 bp, Zea mays
  unsure at all n locations
  Clone ID: cC-zmpo148073d11a1
aacccccgacaanggctggaatggggggaagaaattttataccctcaaattcacggtcctacaccgtctaacataatatagctgccggatgtctgccgttttactgttgtgcgttaccaatggatagcatctaatgggcaatgcaaggacgagagaaaaattataactagagagatgggtcagtctatggagggtctaaaagcatgcaagctccttgaggcaacccttggtgctgcccttggcgttcgtgcatatagccatggtcttgttgttggcgcccctatactcgacgttgacctcatccatggtgacccctgtgcatgggaccttggcagtgcagagcaggctaacggcctccggggtggaggaggtgcccgtgatgttcttgaaggtgacatccttgaccgtgac

SEQ ID NO: 14584 - DNA, 427 bp, Zea mays
  Clone ID: cC-zmpo148073d11d1
acccgtccgctcaaggtcaccgtgaaggatgtcaccttcaagaacatcacttgttacctcctccaccccggaggccgttagcgtgctctttactgccaaggtcccatgcaccgccgtcaccatggatgacgtcaacgtcgagtattgcgttaccaacaacaagaccatggctatatgcacgaacgccaagggcagcaccaagggttgcctcaaggagcttgcatgcttctagaccctccatcgactgacccatctctctaattataatttttctctcgtccttgcattgcccattagatgctatccattggtaacgcacaacagtaaaacgacagacatccgacagctatataatgttccactgtgtaacacccttaatttgagggtataaaatttcttcttcaaatcccaaccaaattcaggggtt

SEQ ID NO: 14585 - DNA, 524 bp, Zea mays
  unsure at all n locations
  Clone ID: cC-zmpo148073d12a1
cacanaaaaaaaagaacgggggggcgcgttttcttaaacaaatgttgggcccaacatcttcacacaagggatggatccctgcgtggtgatggcactattcaggcaaacagaattttgctcaaaccgatacatgtccccagggggcatgcagcaacacttatttacttacaaaagcccagagggcttgttacatctacattttttcattttttttggggcaagggggggtgataacctcgaacaaaaaataatcacacatattgcctattttataccacaccacatttggcaatgtctatctccggcagtttttaacagacagtaacttggtccttagcttatcattgagccgttatcctcttattcaaagatcaccaccctaccaaggcacattgttttcgtgcattcttagggaccaatttcaccatgaaattcgccggtccttttttaatttatggggcttaaaattgaagagaggcggagaaaaccacctttttgtaagcgggtgtttggttccccaaatt

SEQ ID NO: 14586 - DNA, 497 bp, Zea mays
  Clone ID: cC-zmpo148073d12d1
ccgtccgattctatatagctctgtcgcaacatggcctcggtgggcgttttcgctcttctttgggatttcagaatggcgcgagttctatcagtgacccagatcgtcttcccaacgagttgggcagtatgagcataagggacgacaaggacgttgaagatattgtagtcaatggcaatggggcggagcctggtcatatcatagtgaccagcattgatgggagaaatgggcaggcaaagcagaccattagttacatggctgagcgggtggtaggtcatgggtccttcggaaccgttttccaggccaagtgtcttgaaactggtgagaccgtagctataaaaaaggttcttaaggacaagagatacataaatcgtgagctgcaaaccatgcgagtgcttgaccacccaaatgtggtggctctaaagcactgtttcttcttaaagactgagaagaggagctttacctcaatttggtgcttgagtacgtaccggagactgtta

SEQ ID NO: 14587 - DNA, 438 bp, Zea mays
  Clone ID: cC-zmpo148073e01a1
gtccacaaatcaacattaacattatgggatggggttacagatatacactagcataatgaataacttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagcttgacgccctggcatggcaggttgatggcgcaattgagcgtgatggccttcggtgtgttggatgtgccgtggatgttctg

SEQ ID NO: 14588 - DNA, 488 bp, Zea mays
  unsure at all n locations
  Clone ID: cC-zmpo148073e01d1
cccccgcgtccgccggcgcctccaaggtggccgncaacgacgncgttttcattaacatccacggcacctccaacacggggggggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataatccgctggtttgtattttctttcttctttggatcatcacaaaaccaaccgatgtaattattattagaccgacgcctcacaatcttggaacttattcattatgctagtgtatatctgtaatcccattccataatgttaatgttgatttgtggtc

SEQ ID NO: 14589 - DNA, 282 bp, Zea mays
  Clone ID: cC-zmpo148073e02a1
tttcttttttttatattttttttttttttttttttttttgttttggttttatttatttttctttttttttccaaaaaacctttcaatccattttttaactttaatcttttaaaccacacctaattctccccttacctataattgttaataaaaaaaattgaaaaataagataccaccttttttttttgccccaccataattttcataaaaaggttatcctacccaaaaaatctccccgcccaaacccctcctttttaaaccattttttggcaaccaacccaa

SEQ ID NO: 14590 - DNA, 549 bp, Zea mays
  Clone ID: cC-zmpo148073e02d1
ccccgcgtccgcaaaacatggctgtgaatgtgagaaccatgtggttttcttttcgggcacaggttgcgatggttggggcggtggtgttcttggtgagcggcgcatgctgccgtcctcccaaagtccccccaggcaagaacatcacggccacctatggcaaggactggctggacgctaaagcgacatggtatggcaagccgacgggtgccggtcccgatgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacataacggacatgaactatgagcctatcgcggcgtaccacttctatttagcaggcacggcgttcggcgccatggccaaaaagggcgaagaggaaaagctgcgcaaggcgggcatcatcgacatgcagttccgaagggttaagtgcaagtacgacttcaggtcac

SEQ ID NO: 14591 - DNA, 400 bp, Zea mays
  Clone ID: cC-zmpo148073e03a1
catatatcaaagaatggctctgcttcggagttcaatttttttccgcgaggctacacaggtccatgtagattttccattgtcggagcctccacgtaacgaaggcatctggcacacttgattgcagcgtgatgataaaccgggttcacagagagattaagaggaaaaaaaagggaggagggaataaagaagcgtcgtcgtcgtaaagaaatatggcaaacgtgtagacttcagtctgcgtgatatatatgcatgggtggttgttggtcgctccgatcctagatgtcctcttctttctcatcttgcggtggcgctggttccggcggttgctcctcgacagccacgtccggcagaaccttctgggacgggctcttcttgttcatgtggtttgagctccccttct

SEQ ID NO: 14592 - DNA, 540 bp, Zea mays
  Clone ID: cC-zmpo148073e03d1
cccccgcgtccgcccacgcgtccgcccacgcgtccgcccacgcgtttttcctttcgtccgcccacgcgtccgggcgagtgcgggcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactttggaaggcgagttctaccacaagagctgtttcaagtgctcgcacggcggctgcatcctgac

SEQ ID NO: 14593 - DNA, 432 bp, Zea mays
  Clone ID: cC-zmpo148073e04a1
aaaaaaactcgtattcttttgtggggaggggtgccttcagatgcacgtcacaaggcataaattcaagcaaaagaagaaaaataggaagattcgttggtaccgccggcggtttgaacaccctgctgacctggctctctttctccagccgcctctccttcctctcttctgaccggaggtgctggtcgtcttcaaccttcgatgcacatatgtggtgcagtgcagtgcagtgcagtgcatgctctttgtcacctcacctgcgcagtctacccttaaggcaacacgcactcaatctcctgcggtgctgcctccccatgtccaactctaacagtaacagaactaaggctcttgtatatactcttataagagatatgtgcatgttccggtgctcctgcctcactgatctgcagcttacaccccatgagagtagagaag

SEQ ID NO: 14594 - DNA, 561 bp, Zea mays
  Clone ID: cC-zmpo148073e04d1
gtccgcccacgcgttcggtgcgcgctgctggaggaggacaatgctgttttcgcgatcgcagagatcagcagggtcgtgggtttcaagatggcgaccgattgccttgagctccgggcgtggttctaccttgcgcttgagcagtgcgagctggctttgcaggacgtgagggcgatattgacgttggatccaacctacatgatgttccacgggagaatgcacggggagcagctgattgagctcctccgaggacaggtgcagcagtgggatatggcggattgctggatgcagctgtacggtcggtggtcggcggtggatgacatcggctctctggcggttgtccagcagatgctctccagggaacccggaaacagcagcttgcggtttcgacagtcacttcttcttctaaggctaaactgttagaaagctgccatgcgcagtttgcgatatgctcggaacagcacgctccatgagcatgagaggctcgtatacgaagggtggattctgtatacagtgggcatcgcgacgaagcgttagccaaagccgagcagtcgatcggactcc

SEQ ID NO: 14595 - DNA, 399 bp, Zea mays
  Clone ID: cC-zmpo148073e05a1
gtccacccatttcttcttaatggaaaaggggtgccctggtacatgttcgtgtacaaaagaatacacacatacaccggttgggtacgaaattcacacatactaacacctctgtggtgattcgaaggcatgacaggaaccccttgctcttgcattggcgaatatgcgcgccgagccgacgcgccaccacactagctaggcagatcttcgcaggtacgccatgacgcctatgccagtgactagggcagccccggcggcgaccccgctgtacgccgtcgcccacgcgttccggctggacatgcccaccgccatggctccacgtggggtggccaccgttttcctgcgcccggtggtgcctgagtagtccaagaacagcttcagaccctttcattccggacgcgt

SEQ ID NO: 14596 - DNA, 396 bp, Zea mays
  Clone ID: cC-zmpo148073e05d1
gtccgggatggaagggtctgaagctgttcctggactactccggcattatcgggcgcaggaaagcggtggccaccccagggggcgccatggcggtgggcatgtccagcccggacgcgtgggcggtggcgtacagcggggtcgccgccggtgctgccctcgtcactggcatcggcgtcatggcgtacctgcgaagatctgcctagctagtgtggtggcgcggcggcgcggcgcgcatattcgccaatgcaagagcaaggggttcctgtcctgccttcgaatcaccacagaggtgctagtatgtgtggattacgtacccaaccggtgtatgtgtgtattcttttctacacgaacatgtaccagggcacaagttttccattaagaagaaatgggtggacc

SEQ ID NO: 14597 - DNA, 443 bp, Zea mays
  Clone ID: cC-zmpo148073e06a1
ctatgtcattgagaacaccacatgtatgggtgggggtaaccttatcatgcatctcattaaaattgaatatgtcgaacatgtgtccaaaatgacaagtgataagcattaggtagcaacaatagacattacagtcttgatgaataggagaaagcggctgccgacagaccggcagaaaactttgatcatgctaatgaagaaacatcaacaaaaggagaaagaaacggtgcgggaggctggcgataatggcttcctatcggcttgcatcttttgggcccaaagaattagaagcatttcctgtgcacgatggacgggccagactcgtagtactcagccttggcaattcacatctgctggaaagtgcttatcgatgccaggatggatccttcaatccagacactgtacttacctcttggaggagcaaccaccttgatctttatgctgct

SEQ ID NO: 14598 - DNA, 571 bp, Zea mays
  Clone ID: cC-zmpo148073e06d1
gtccgctccatcatgaagtgcgacgtggatattaggaaggatctgatgtcaacatcgtcctctccggtggtaccacggtgttccctggcattgctgacaggatgagcacggaaatcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaagccgagaggagccattatcgccagcctcccgccccgtttctttctccttttgttgctgtttcttcattagcatgaacaaagtttttctgccggtctgtcggcagccgctttctcctattcatcaagactgtaatgtctattgttgctacctaatgcttctcacttgtcattatggacacatgttcgacctattcaattttaatgagatgcctgatgaggcttacttgcaaaatacatgtggtgttctcaatgaat

SEQ ID NO: 14599 - DNA, 407 bp, Zea mays
  unsure at all n locations
  Clone ID: cC-zmpo148073e07a1
nnnnnnntttttttttttcaagcactcnggnacattaggggagggcctttttttacttttctttcaggggatactgctatccatgccatgcgcgcgttcgctctgtatcaacgttatagttatgggcagactgtccgcgacgccgccgtggtacagtatactggtcgacgtcgtcgtccgagtccagctgcttgagcagcgcggcgcaaacggggagcggcacgtccttgaagtaaccgagcgggttggcggggcgcaggctgtcggagatgccgacgttcctggagagcaagacgccggagcggtccctgagcgcctggacctcgtcgaaatccttgagcgggctggccaacaacaccacctggcagatgtcctcctcggggctgcccttgaactcaatcgtgtaa

SEQ ID NO: 14600 - DNA, 551 bp, Zea mays
  Clone ID: cC-zmpo148073e07d1
ccgctcgtctcaccctcgctccctcacacaaataataaggaatgtcccgcccttttcctccgacatccacaggggggaggggaaaacacgtgcattcacccggcgccaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaagcgctcagggaccgcgccggcgttctgctcaccaggaacgttggcatctccgacagcctgcgccccgccaacccgctcggttctta

SEQ ID NO: 14601 - DNA, 153 bp, Zea mays
  Clone ID: cC-zmpo148073e08a1
ggggtggcggcgatttaaacccatgattcaccatcccgattacattacattactttacaaatttaagcatttagtccaccaatctccattttaatagttggtctaccgggggtcaagtagcaaggcacaacaccccatttttcaattttgccc

SEQ ID NO: 14602 - DNA, 153 bp, Zea mays
  Clone ID: cC-zmpo148073e08d1
gtccggcgcaagactggagaatggggtgttgtgccttgctacttgatcctcggtagaccaactactagaatggagattggtggactaaatgcttaaatttgtaaagtaatgtaatgtaatcctgatcctgaatcatcggtttcactcgcgctt

SEQ ID NO: 14603 - DNA, 423 bp, Zea mays
  Clone ID: cC-zmpo148073e09a1
aataaaaataaaaatcacttagagaagggggggggccaaactggcccatagcgtctcccacccccccagttttaatcaggaataatcaaaacaaaaaacgagtaaggcttgcattgctcatttagtcattgcaatagccttggaaaacctccgctcactacgttgtttcgcgtcggacgatacaaacgcaaagaaaggtcgtggctacttggtccttgcgaggagaatccttgcctagtactaggaacgtgcaagaatccatccgccatccctgctgggtacgttgggacttgggacgagcccggaaccggtgtatatgaagcttccgtgagctccgtttagtgctgtggctgaagctgccgctgggtacttctgaccctctgcgccatcgtcgacgatgccgccgcctgttgttgttgctgc

SEQ ID NO: 14604 - DNA, 475 bp, Zea mays
  Clone ID: cC-zmpo148073e09d1
ggccggaccgcataaggcagcggaggaagaagcagcaggccctcattgcgcagcagcagcagcagcagcaggcggggcggcggttgcgatggcgcagagggaccgacctacccagcggcagcttcagccacagcactagacggagcttacggaagcttcatatacaccggttccgggctcgtcccaagtcccaacgtacccagcagggatggcggatggattcttgcacgttcctagtactaggcaaggattctcctcgcaaggaccaagtagccacgacctttctttgcgtttgtatcgtccgacgcgaaacaacgtagtgagcggaggttttccgaggctattgcaatgactaaatgagcaatgcaagccttactcgttttttgttttgattattcctgattaaaactggggccgtcggagacgctatgggccagtttggcaacccagtttctctaagtgatttttatttttc

SEQ ID NO: 14605 - DNA, 504 bp, Zea mays
  Clone ID: cC-zmpo148073e10a1
aacccctgaatttggtggggatggggagaataaattttataccctcaaattcagggtgttacaccgtcgaacataatatagctgtcggatgtctgtcgttttactgttgtgcgttaccaatggatagcatttaatgggcaatgcaaggacgagagaaaaattataactagagagatgggtcagtcgatggagggtctagaagcatgcaagctccttgaggcaacccttggtgctgcccttggcgttcgtgcatatagccatggtcttgttgttggtgccgctatactcgacgttgacgtcatccatggtgacgccggtgcatgggaccttggcagtgcagagcaggctaacggcctccggggtggaggaggtgccggtgatgttcttgaaggtgacatccttgacggtgaccttggaggcccccgtggcagaacacaacttgttggggcattacttcatgtctaataagatggggttggctgagtccttcatcttgattttctc

SEQ ID NO: 14606 - DNA, 525 bp, Zea mays
  Clone ID: cC-zmpo148073e10d1
gtccgcgacaagatggcgtgcacaaacaatgcgatgagagccttgttcttcctggtcctcttctgcatcgtgcatggggggaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaac

SEQ ID NO: 14607 - DNA, 378 bp, Zea mays
  Clone ID: cC-zmpo148073e11a1
gccggcgttgtcttgtgcttgccgccctgctgcttggtgggggtgggcggctgttagtcggtgggcggtgaccgcatgcggtcgaacgacgagcacgacgacgacgagaggccgggcgtggtcggaatggagactgggtggtgcgccgggttggagctgaacggcgacggcgggtcgggcagctcgtttgcgctccgcggcagggaccgcgacgacggcatggcctgctgcctagggatctccagcttgaccttcatgttggaggtgtcaggaggatcagaagatggctgggtgtgcattatggcagggcgctagacggaagggacggcgcagagggccatttgaagcccttgtagcgcagagggcccacgcgacgcg

SEQ ID NO: 14608 - DNA, 383 bp, Zea mays
  Clone ID: cC-zmpo148073e11d1
gtccgcgcgtcgcgtgggcgctctgcgctacgagggcttcaaatggttctctgcgccgtcccttccgtctagcgcccggccataatgcacacccagccatcttctgatcctcctgacacctccaacatgaaggtcaagctggagatccctaggcagcaggccatgccgtcgtcgcggtccctgccgcggagcgcaagcgagctgcccgacccgccgtcgccgttcagctccaacccggcgcaccacccagtctccattccgaccacgcccggcctctcgtcgtcgtcgtgctcgtcgttcggccgcatgcggtcaccgcccaccgactcgccgccgatcacgcccaccaagcagcagggcggcaagcccaagccgacgccggc

SEQ ID NO: 14609 - DNA, 493 bp, Zea mays
  Clone ID: cC-zmpo148073e12a1
gatacagaaacatacaccaacttattggtgatggccttttattctaccaccacgaagacgaacgtcgatacacgagatttgatctaccctatctacaacacgatttccttgtgtgttattaaaccaaattgtactaaaatgacaccaacgaaaagaggacctatacatataaatgaaactaatcaaggaacaggtagtgtattctccctgcgatactcttgtcttcttccagctctgcaataaaagaatcacgactcttctgttgctgttgctacgttttttctatggagaagaaccaatcgtttgaaggctatattgactgcacatggacggaccccttggatgaatctgagtgatgagtctctcaaccttttgagctttgaatcaggctgacgcatattcgttcgggtgcgccttttgccatatccacgcctgggcaaggctatggccaagatccgtgtattgggctgtccagttgaggtccctgaagatt

SEQ ID NO: 14610 - DNA, 646 bp, Zea mays
  Clone ID: cC-zmpo148073e12d1
gtccgcggacgcgtgggtgctactcttcgtctccttagtgacaagtttttggttaccattgtggataacctatccagggggaacatgggagctgtcagagttcttcaacggctatttccagaacccggaaggcttcagtttatttatgctgacttaggcgatgccaaagctgtgaagaaaatattttcggagaatgcatttgacgctgttatgcactttgctgctgttgcttatgttggtgagagcacaatggagccactcaggtactaccacaacataacatcaaacacattgacagttcttgaggcaatggcagcatataatgtaaatactctgatttactcgagtacgtgtgcaacctatggtgaacctgatacgatgcctattgtagaaacaactcctcagaatcctatcaatccatacggtaaggcaaagaagatggcagaggacatcatcctagattttacaaaatcaaagaagcaatcagacatggctgtaatgatcttaagatactttaatgtgattggatcggacccagaggggcgactaggagaagcttcaaggccagaactacgcgagcatggacggatattccgtgcttgctttgatgcggctttgggaatcattcagggctaaaggtcgtgga

SEQ ID NO: 14611 - DNA, 367 bp, Zea mays
  Clone ID: cC-zmpo148073f01a1
aaaagggaagggtcctttatataacaacaggaatcaccaaaacatttaaacctaaattgtaggtgacaaggctacacaaatataggattttttgattccctttatacgcgcaaaattttgtttttcctttctggagggttagtccttaatctttatcgtccttcttgttcccgtccgtcgtccgaatttccctgctcatgggatttcggtaggtcctgtccgaccgcctgctttcacgatgcctttcatttcctgcttgaggtggcagcgtttgcaaaacggctctgcaacttagcgattaattagctccggtgatgcaattaccgagttcggcaacaaaacggtctgtgctttcacggtgacttaa

SEQ ID NO: 14612 - DNA, 392 bp, Zea mays
  unsure at all n locations
  Clone ID: cC-zmpo148073f01d1
cccccgcgtncgcttctaggcgccgggagagcaccgaccgctctgtttccgttcgccgctactgcatcaccggagctgatgggtcgctagctgcagcgccgctctgcaaacgctgccacctcaagcaggagatggaaggcatcgtgagagcaggcgggcggacaggacctaccgaaatcccatgagcagggagatgcggacgacggacgggaacaagaaggacgacgaagatgaaggacaaaccctccagaaaggaaaaacaaaattctgccacgtataaagggaatacaaaaaatcctctatctgctgtagcacatctcacctacaacttaggtttatatatgttttcgtgatctcctgttgtctgatatagaggattattcttttttctt

SEQ ID NO: 14613 - DNA, 523 bp, Zea mays
  Clone ID: cC-zmpo148073f02a1
aattgcccatctcttataatacggatgggctttcaatgggacaatacaacaacaatcaagagacggcgagtagttacaaggcatgacaaccaaaggggggaaatgaaaggctgtgattatagctgacagttacaccaggatatttaacaatgacatttttttaacaaattcaagccatccagcaaaaatgtccaagatcatcaaagtggacagcttgaaaattttgatgcatcttgaggatagttttttagacaaaaggatcaggggagttatcatagtctagaggatcggaacccattctagctctaactccagctcaccagattctacgttctgcagctttaagtgcacctcctgttttaccttgcctgcaacgacattcactgtgctatctttcatcaaggcgttgtctttggtcgtgaaccacccgccaatttgcatgtcaccaagacgtgaagtatcttcaaaggccaaggcggttgtgatcattggttggagaactatctcttgttcactcatgata

SEQ ID NO: 14614 - DNA, 540 bp, Zea mays
  Clone ID: cC-zmpo148073f02d1
cgtccgcccgccccccaacgccacccagcgcgacgaagcctttgtttgttcgctccagcgccgccgcgccggggagggtaccctccgggagccgccggcgctacccccctccctatcacgcctcatcgaatcctcaggtctaagttttttttggttttgtgagttatccaaagttggaccgcaaagatgagtactgctaatcactatcagcacatcaagtcaaccaagcctgttgtaggcaaagcaagaaaattgaaggatctcatgataaaaagtgataataggatatgtgctgactgtggtgcacctgatcccaaatgggcatctactaatattggagtgtttctttgcttaaaatgtggagatgttcatagggcacttggacctgacatttcaaaggttttatctgtaactttggatgattggtctgacagtgatatcgactccatggttgaggttggtggaaactcatatgcaaattcaatttatgaggcttttctttcaaaagatcacccaaaacccaaaccagattcaacgatg

SEQ ID NO: 14615 - DNA, 514 bp, Zea mays
  Clone ID: cC-zmpo148073f04a1
catcccaaacatatctggcatgtctgggtaacccagatataagttgatagcgtacaactaaatttacgccaataatatacaagtatgtgcatacaaagttacatccttacaggttcctgcgacggtatcaacttcagcgccaacgtcaacaaaagactgcccacggataaagacccaaaattagcgagccaaaaaaaaagaacaaatgacactatatatttcttgagcaaaccatatgatttcgccattacaaggatctttacatgtactctacaaaagcttcgacggcaacagcggtaggggcattacaaacaaggatggtcattgaccagacttgggcagggcaggcaggaggtaacagcattcagggccatataatcgatgaaaggcttcaaattagaagcgaatacagtttgcatctgtttagtgtcgtcttgtattttaaccccgtatcgtgacaccgtgcaaaaatttggtgaacccaataaagttaatctagccttcccattttctg

SEQ ID NO: 14616 - DNA, 395 bp, Zea mays
  Clone ID: cC-zmpo148073f04d1
ggccggcccgccgctccgggccgcaatggggcaaagctacaggaagtctctcggcgcgacctcgcgggcggaccaacgggccgacccaaagggggcggggtcggacgccccgacatccccgctgactgacaacggcacgccgatagcccccacacccaggcgccacaagtacggatccaccacaccgttgcaccaccaccaggcggctactcccggcgccgccgcctgacctagcccgtacccggacggcggcgccagcccactccccgcgggcgtgacgacgtcaccggcccagaccacgccccggaggttcttcaaactgcccttacaatcaaccaagcccgccaagcacataaaggccacacatgccaagcgcctaagcgggggcaagccca

SEQ ID NO: 14617 - DNA, 495 bp, Zea mays
  Clone ID: cC-zmpo148073f05d1
gtccgcggacgcgtgggcgcgcgcggaggcgaggcgttcgcacacttctcccgcgccaccaccaccgctccgttgcggccgccatccgtcacgcgtgacgtttcccggcgggccgggggagagagaggcagaaggaggaggcacggagaggacgagacaggatgctcgggttcaggcagatgccgtggtcgtcggcgcaggagcaggagcaggcgccgtcggagcagctgtgcgagggggtgtcggccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttcagcagcctcgggatggccttcaggttcgccgagatcgagtacgtcaccaaggtgaacgatctcattggtgccggcaagtcgtaccgcacgttgagcgaca

SEQ ID NO: 14618 - DNA, 479 bp, Zea mays
  Clone ID: cC-zmpo148073f06a1
agaacctgctgcaagtagcaactgggatggagaattgtgtgaatacatcacacaactcgcaatatggaaagtcgttttctataggtgtatcggacaccgctcgtgcgtgtggcacggcgaaacgaactccgttacataattcgtacgtgtccccgaaaaaaaatctcgggacacaccgggaggcgctagtaaagccatcgcccatagccgtaggtagtagtagttctccgtactcctgtcctgctcctcgtatcgtatcagcagttcagtacaccaagggggcgagaaggcacacccgctctcccttggtccgcagtctaccagaccagaccgcgtcatcacccaccgttcggaggctaagcgttctttgactgcaggtcctccgagcttagcatatgattcaaaaagccgctcgcgttctacggccagcaccgaaacgcgcccgtcgggtcagaccctggggcttaaacacgccacta

SEQ ID NO: 14619 - DNA, 425 bp, Zea mays
  Clone ID: cC-zmpo148073f06d1
cgtccggacacgcctcccgaccgaacctccaaaccaaccccaccatcttcattcctcgcggaccaagaagaggaagaagaggggatatgagacggagacggagaccgaaccgatggtcgcaaggatggacgcgggcatgcaggcggtgcacgcggtcggcctgctgagcgcgctggtgttgctgctcgtgctgcgccggctcctcgccgtgctccagccgctggccctgctcctgctgctgcccttacggtggcgcgcgcgggcggccggggccgtggccgccgacgtggcgaccgatgccgccacggcctccatgccgagggccagcgggaggaaggggaaggcgtcggcggtctcgcacggtggctctccggttgcccgtcgggtcccccatgatgcccgcgctgtggcatgcgtacaaactc

SEQ ID NO: 14620 - DNA, 480 bp, Zea mays
  unsure at all n locations
  Clone ID: cC-zmpo148073f07a1
tttttatattatatttttttttntttttttttttttggtagggtttattttaatttttttttttttcccgccccccaaaaaaaaaaaatttgttttttaccctttggttgtataaaaacgtatacaaacacaccctcttattttcacttaaaaaacacacacaacccaaggaaaccccaaccgtttaactaccgaaaattaaactgcattcccccacctaacgcaagttaaacaatcattcaccaaaaattaagccttcccccggggggggatttatatttttttctggaaaaccccccccccttataccccccccccccccggtactttttttgggtggaaaaaagttcccccacctttggcaaaaaaaacaacttttttttttttttttttccgcccccccccttgacctcggcttccatcctctttcccaaaaataaaaaaccttagggccccctctcagccggggtggaagccgat

SEQ ID NO: 14621 - DNA, 490 bp, Zea mays
  Clone ID: cC-zmpo148073f07d1
gtccgcccacgcgttcgggcggctgcctagcggaaggtcggcggcttcctcctcgctgatcgcgatggagcggcgtggcagcatcggcgcggggagctgcctggggctgctggcggtcgccgtggtgtcaacgagcgtcatcctcgttttctaccgccttcaccgccgtctggaggcggacctcatggtcatgatactcggcgaaggcgacggagccgcggaccagggccggcgccgcacgaagaagaacaagaaggtgcgcttcgcggccgacgtggcggagccgtcgtccagccgagaggagtaccggcggcggcgggcgtcgactgcggcggcggtcacccgagcaagatagcacgccgccgccgcgcgtcagcctgacttgtggtgcatggctgtgtagcttgcgtgacgtggcggcatgcacgttcaactgccgtacgtaagccgttgcggttttcgtgggctgtgtgtgcttgttcagtgcgaa

SEQ ID NO: 14622 - DNA, 450 bp, Zea mays
  unsure at all n locations
  Clone ID: cC-zmpo148073f08a1
accaaggggaaatnnggagggcaggaaaggagacaagnctcgaagcttctattacatgagtcattggcagtagataacaataagctcaagcaacattctcaaatttatctcatggtatacagggcttaatcctcatcctcaacaaccttagttcccaaacctttgagaccctccggtgggatctcagcaactgggaccagagagtagagttcctccttggcgtcttcctcatcgttccggttgcgggcaattctgacacggacacgcctcggcacactgcggataccactgctccagatgtgcttgttgagcttcacgttaatccggacattaggagtacccatggccttttgagcgaacttcctgatctccttgatggcatttggtgccttttttttaaaggtgcatccgtggaggcgtttgtggaggttgatagtgtacttgcgtgtc

SEQ ID NO: 14623 - DNA, 497 bp, Zea mays
  Clone ID: cC-zmpo148073f08d1
gcgtccgaagaagcgaggcgcgggcactcgcaaggatgaggtggtgacatttcgagtacactatcaacctccacaaacgcgtgcacggatgcacctttaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcagaattgcccgcaaccggaacgatgaggaagacgccaaggaggaactctactctctggtcacagttgctgagatcccaccggagggtctcaaaggtttgggaactaaggttgttgaggatgaggattaagccctgtataccatgagataaatttgagaatgttgcttgagcttattgttatctactgccaatgactcatgtaatagaagcttcgagacttgtctcctttctagtaatccaaatatccacatggtt

SEQ ID NO: 14624 - DNA, 266 bp, Zea mays
  Clone ID: cC-zmpo148073f09a1
gcttgaaatttagatcatgtatatgttttgaatggaattatagatccacactaccagaatgaataagaaagttcgcagattgccagaggcctaaaaaaagactggcgagagtgataaagagagaggtgacgaaaagtgagtgatggatgcaagtaggttcagacgcaggcgagctccttcgccatgccaatggacttgccgatggcgttcttgcagacggacatggtcttgttgtcggacctgttgtacttgatgtcgacgttgat

SEQ ID NO: 14625 - DNA, 272 bp, Zea mays
  Clone ID: cC-zmpo148073f09d1
gtccgatcaacgtcgacatgaagtacaacaggtccgacaacaagactttgtccgtctgcaagaacgccatcggcaagtccattgtcatggcgaaggagctcgcctgcgcctgaacctacttgcatccatcactcactcttcgtcacctctctctttctcactctcgccagtctttttttaggcctctggcaatctgcgaactttcttattcattctactagtgtggatctataattccattcaaaatatatacatgatctaaatttcatgcc

SEQ ID NO: 14626 - DNA, 397 bp, Zea mays
  Clone ID: cC-zmpo148073f10a1
cggatgggataaagaaaatagttgtgcatacccttattgcattttcctttgaaacaaacaactgcccggatttacaaaagcgggaaaaatgttggttattaaatggctttaactacaaaaccagttaaaaaacaaggccgatccaaccatactttaaagcttgcgcaatccctccattccacataacataagtagagcccccccaccaacacaaaacaaaggcttcgttgcagctggggcaatctgcatttagggggcctgaacctcctcgttgtcctccatttttttgaacaaacatgaaaaaaggcgccattgccccaagaaaaccaactggttctttaatggccccctcctctcccgagccctcggcattgccctccttcatttttggaatata

SEQ ID NO: 14627 - DNA, 604 bp, Zea mays
  Clone ID: cC-zmpo148073f10d1
gtccgcctgtttgtcatccttgaatgaggaaacgctgaagtgccatttttgtggaagtcttcaccctggagatttccggaatgtttgcctggaccttgatcatttccttgaagaatattttccagcagaatatgaattgagagggcagaaagttcaatttaagaaggatcagtgcaatcgtgaaacatcatcttcaggtacttcaggcagaaaaggaagcactagggcactgcatgctgaagacccgtcaaatattcacattggagtaggatgcgactcatgtggggtatatccgatacgtggtaagagatacaaatgccaggactgcactgagttaataggctttgacctttgcgaagcctgctacaactccagttcaaagctcccaggacgctttaaccagcggcacacccctaatcacagaatggaagttgacaattcagcactcgtgcataggatactgagacaccatggcatacccgaggaaagccctgagggactgatgatggaagtggttggtcctgatgcaatggtgcagatacttattgataatcatggaatggaggagggcaatgacgatggcccaggagaggcgggcattgaa

SEQ ID NO: 14628 - DNA, 468 bp, Zea mays
  Clone ID: cC-zmpo148073f11a1
ggagagacatgagaaaattcttccccgttccttcgcctccattacttttaaaaacttcgaattgggtgtgaaatctagtcgtcgccactcagatgccccgaccccgactcatacacaaaagaagaaaaaggagcaaggatcccgtcgatacctccctttcttttcctacgcctttttttaattctttcctattctttcattctggaggcccggggccggcccggtcattttcaaacctttgttgcacatattggggggcaccgctcagccagcttgtttttgaaaaagaggtccgactgattctttgctgaaacacatcttaacttgtctaagtaatgcaagctgcctgacttgtcacctggcagtctaccttaagcaacttgtgcttaatctcctggggtgctgcctaaaacaactatttgcagtgcctccgctgcttgagaacgctcaatattctgcctccaaaaa

SEQ ID NO: 14629 - DNA, 575 bp, Zea mays
  Clone ID: cC-zmpo148073f11d1
gtccgcagaaagctgcaatgcgcagtttgcggtgtgctcggaacattttctactccatgagcatgagaggcttgtatacgggggatggatcctgtatgacagtggacatcgggaggaagcattagccaaggctcagcagtcgattgggcttcaaagatcattcgaggccttcttcctgaaggcgtacgctttaggagattctagccttgacacagattcttcgctctccgttgtgcagcttctggaacacgctaacagttgtgcgtccgacaaccttcggaaggggcaggcatacaacaacatggggagcacctacgtggactgcaacatgctggatgaggctgccgagtgctacggcatagcgctgaacataaagcacacacgggcgcatcagggtctagctcgagtccatttcttgaaaaacaggaagaaggctgcgttcgaggagatgacgaagctcgtgcagatagctaccaacagcgcgtcggcgtatgaaaaacggtcagagtatggtgagcgcgacgctgcgaggagcgacctgtacactgcgacgcttcttgatcctaacaggacgt

SEQ ID NO: 14630 - DNA, 599 bp, Zea mays
  Clone ID: cC-zmpo148073f12d1
gtccgccatctatgacttcgtgctcagatgggcccgtgcacaatactttaaatcagaagagagacgtgagatccttagggctcggctgctccctcttgtgcgattcagccacatgacatgtaggaagctgcggaaggtcctaacatgcacagatatagaccacgagcaggcaaccaagtgtgtcaccgaggctcttctgtacaaagctgatgcaccacaccggcaacgagctcttgcagcggacacaacaacctgtcggaaattcgctgagcgggcttacaagtacagaccactcaaggtcgttgagtttgatcggccctatccacagtgcatagcatacttggatctcaagcgcgaggagtgctctcgactctttcctgcaggccggatatactcgcaagcgttccacctcgcagggcagggcttcttcctctcagctcactgtaacatggagcagcaaagcaccttctactgctttggcctgttcctggggatgcaagagaagggctcaacgagcgtgaccgtggactatgagtttgctgcaaggacgagaccattcggcgagtttgtgagcaagtataagggtaactacacattta

SEQ ID NO: 14631 - DNA, 392 bp, Zea mays
  Clone ID: cC-zmpo148073g01a1
atgtcgataattttgaaggtatactgagggcaaggaattgtacaagatccatgcttggctcaaaactggaagaagctagctggaaatcatgagttcagttggtggtgctcttcttcttcttcttgttcttcttcttgaggtccgtggcatagtagttgcatgtgatgaagacgcctcccttgaagcactctgctcgtgcgcatcccaccttggtgctcctcttgccgaccatgagcgcgaagtggccgcactccttgtacgccctgccgcctgtgcactgctccgtgttcctgtcgtagatggacttctccttgccccaccagaagacggccttcttggcggtggcgttccagtcgtcgtggctcctgaacaggctcttgccgtacttgtgg

SEQ ID NO: 14632 - DNA, 483 bp, Zea mays
  unsure at all n locations
  Clone ID: cC-zmpo148073g01d1
gcgtccgcggacgcgtgggcggacacgtgggggccggcgttttcgtttctagctcgancangaaccatagggggccgggcatgttgcccagcagcagcataccagtactgctgctcctcgtcgtcgccgtcgtcctctccaacgacccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcacgagatggagaaggcggtcgcggcggagaaggctgcccatcaggagctgctcaagtacgccaaggagaagggcattgtgtcaccgaccaacggcacggggtggtacaagggcattgcccgggagttcgtggacgcccacaacgagcttcccgcgcgctacggcgtgccgcccatgaaatgggaca

SEQ ID NO: 14633 - DNA, 533 bp, Zea mays
  unsure at all n locations
  Clone ID: cC-zmpo148073g02d1
aaagaaacaggaagacaaaaacaaaaaccangtttttaattatggccnacaggaccaccaaccgaggggcgaggaagaagcaggaagcgcaggacgcggcaggaaagagcaccaccccgcacaccaaacacganggcaagggaaccaagcccggccaccagaaccacacccccaacgacgcaaccacacccgacgaggagaacaaagagcacgggggcgaagaccgcaacacaacgcncaaggagggcccgaccggcaccaggacgcaagacaccaaggccccgcacaagaacccacaaagcaaccacnaagcagacaagaccggaggcaaacgcaacgaagacaacgaaaaccccgccgaaaacaaagccggcaccaccaaaaagaccacactcagcatcgaaatagccaatgatgatgaattataattcaaaagagctaacctggtgctcatgttatcaagaaaatattattttatggttattttgtggaaccaaaacaccaaaaaaaatgtgatgcaacatgtccttttg

SEQ ID NO: 14634 - DNA, 601 bp, Zea mays
  Clone ID: cC-zmpo148073g03a1
cttggatctctctagaggcggctcgcgactgcccgctgagcttttgcttggtcctgccaggaaccccgagcagggggagcggcgagcttctggcacagggaggcgaggaacagtctcatgtcacaggcgcatggcctggacaggaggagcaggaagacgacagcgaatgcggcgagcaggggggcaagcatcagcacgcgctggcgggaggagcgcgctgccactgcctctgccggagcgcccgctgctccgtccgtatatggataaacaacagcaggcgatgccgggagcagtggagctgctgttgctacgaccaagaccgcatcaagagctcgcctttattgcgctttctttctccgcccgatcggaggagccgtgcgggtgacgcgatggaatggaacccactttgcgacagggaggagaaaggaaaagtgcagcgagagaaggttaaacacacacacacacacacaataaaattaggtcggaattcatcgaatcgaagcccggtgatcggtggaaccaaggacacttgttgccgaccggtttgatttcagctgagcgggtaaaatgacctcaaatttgtgcttgaatctggcccttt

SEQ ID NO: 14635 - DNA, 407 bp, Zea mays
  Clone ID: cC-zmpo148073g03d1
ggacctcgcaccaggccctcctcctaggaagcgagttagttagtggagggagagggaggagcgagggaccggagagctcgagaggcggcgcggccctagcacgccggccctacccccagctcactcaccacgctcttcttttaccaactctctctctcttatcttcttccaagaatcccccatttttttgttgttgtcccccccattcttgctaagatcattccttgaactttcgctcgctccagcacgcccgttttccagcttcggagatcccatcttggccacctcctgcggcctccaagctccaagaggccatattccagcacaaatttgaggtcaatttacccgcttagctcgaatcaatccgttcgggaacaagagtccttggatcccccgaaccccgggct

SEQ ID NO: 14636 - DNA, 395 bp, Zea mays
  Clone ID: cC-zmpo148073g05a1
gtgtacaaatatattatattgcagtcggtccagcatgattgaccgtatcagggattgacaatttggcagcacatcgacgtggttaaggcacaatttgatgcaacaagggaacaaaaaagaagaatgaaagaacatccttatgtgttacactcagaatcgcagcttgctggcatacgcaagcaccagctcgcttccatcacacgcaaaaccttttttctcgtgggcgtgaacaattcactgctgtttgcttctaccaacgaaagaaacgcttgcttttcttcttcttctcaatgtatgcaacgatctccaactgacgctcaagagtctcctgcaaggtcttctttgtagctgcaagctcctctttcagtgcactaacgcgggagacagcagtctgc

SEQ ID NO: 14637 - DNA, 595 bp, Zea mays
  Clone ID: cC-zmpo148073g05d1
gtccgcggacgcgtgggctgcggagaaaatgatttgtgaagacgacttgtatcctaagaaacaagctttgtttgatggtgaaacacaattagctggagacgagcattctcagtcacagaaaatttcccgtggccggattgaacatcctcacgtgtcacctcttcacgaggaacttatccccacttcaattcatacccctggatcaccctattcttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcattgcaacgatggtccgtctgacccgcagcatgatgcctgggaaggttctcggtgctgccataggtggagctaccctctcagaaggtaaatcaaaagtacaagagcgccagcggtccaagctatcataagaggctgtggaggaagctgaagactccgtctctgcaaagcgcctcttggagcttgaggagaaggtcattgcactcctgacaaaacccgcatcaatg

SEQ ID NO: 14638 - DNA, 275 bp, Zea mays
  Clone ID: cC-zmpo148073g06a1
cattcacatacgggtaggggtacatttacactcctctcccccgccaaaaccccccccaacaatacataacaccccaatctccgaatgcacccaaaccaaaggcaaccacaaaacccaaagacaaacccccccccaagggaaaaaacatccacggaccgcatcaaacccaaaaacaaaggaaaaaaagggcacaaaaaaaaacaagaccaaaggggagctaaaccaaaaacaagcccacccacctaaaagcccccaaccaagacactctcttcccc

SEQ ID NO: 14639 - DNA, 571 bp, Zea mays
  Clone ID: cC-zmpo148073g06d1
gtccggcacatgagctagctggccagccagccagcagccagcttgcttgtcgcgcccgtccttcttcctcgcctccggggcgttctgttccgtcccgcccgccgccgccgccgcattcagggatggagatgaagaagatcgcctgcgccgtcctcgtcgccgcctcggcggtcaccgtggcgctcgccgcggaggctccggctccgggccccaccagcggctcctccgccgtcgcgcccgccgtcggcgccgccctcggggccgccgtcgcctccttcttcgcctactacatttagtgagccggccgtggtcggtcgcccggaggccgaggaagagacgaagcgggagagagagtgacatggctgcgcgcattccgatgcgtgggcatgtttttgattcgacacaccttttgtcctctatttctttgttccctctttctccttaatttaacgaattgatgcttgccggtgatgttttttcccctgagagagggattaacacctgtatcattccttgccatttgtttgaatccattcaacatttcgatctaatcaatcattgcgatattttt

SEQ ID NO: 14640 - DNA, 590 bp, Zea mays
  Clone ID: cC-zmpo148073g07d1
gtccggcgaaagcgtccgggcctggtgggtccttcgacatcaccaatatgggcgcctccggcaatggcaagacagacgtcacgaatgctgtgcaggaggcatgggcatctgcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgactggcagggcccagccgtgtggagcaagaactcctgcaccaagaagtacgactgcaagatccttcccaactcgctggtgatggacttcgtgaacaacggggaggtgtccggtgtcacgctgctcaacttcaagttcttccacatgaacatgtaccggtgccaggacatgctgataaggacctgacccggaccgcgcccggggacaggcccacaccgatggcattcacatgggcgactcatccgggatcacgaacaccaacac

SEQ ID NO: 14641 - DNA, 384 bp, Zea mays
  Clone ID: cC-zmpo148073g09a1
cacccacaccaccacaccggccccgtttcaattaaaaaaaaaaaacaaccccccccaaaaaaaatccccaagataaaatccccacaaatcaaaaaaaaaacaaatccaaaaaaaaaccgcttgcaaaaatcccaagaaaaaaaggcacccctcttaaacaaaaaaagggaccccaatttgggaggcccccgaaacccaaacccccacaaacggcaaagcccaaacccacccaatcttctccaaaacaaaaccacccccaaacaaaagagcctgggcccccgaagccccaacaaaaaaaagcccctctcccgcgttagacccacaccaacaacaaggccctgctacccaacaaggacaccaaaaaaccccccacccccaaacaaa

SEQ ID NO: 14642 - DNA, 492 bp, Zea mays
  Clone ID: cC-zmpo148073g09d1
cccccgtccgcccacgcgtccgcgcacgcgtccgctttaccaccgaagagtttatcgcgagcaaccagcgatcgccccatgggcgccatggctcgttccgtctccctcgtcgcggcgcccctgctcctcctctccctccttgtctccgccgcggccagcgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaaggggtccgggatggccaccttcgtgcaccgcaagtacagcgacaaggaggacagcgacatgttcaggtgctacgacagctgctccgacgacgtggaggaggccgtcgcccacctcaacggtctcgtccgggagcccaccgacgccaagtttcttgagctcaagtcgtggctcttcttcacgctc

SEQ ID NO: 14643 - DNA, 430 bp, Zea mays
  unsure at all n locations
  Clone ID: cC-zmpo148073g10a1
ancgcanccccaccacacgggcgccgggcgcatgaaacccancaaagcaaatctaatccaccacccatcaacaattagcaagaccgatgaactagcaaggcttattgcaaaaacacttgcccatggccacgtcccgcttgcactccccaccgggaaagctctcctttatgcacacctcggcccatttgtcgctgttgaaacaaaatccctcaaactggagactcggcgataagcattgactctcttccttctccgtgcttttcttctccttcttctccgactcctgctgtttcgctttctccattatcaaggcatgcatgggcatggctactcccattttggcattgatggttcccaccttctgctgcgacgaggaggagaaacaagaattggacagtttccttaaacactgccatccttctctcgtttt

SEQ ID NO: 14644 - DNA, 516 bp, Zea mays
  Clone ID: cC-zmpo148073g10d1
gtccgggatccccccacacgttgagacctgcgttgtcacccaccctttgttgttggggccgccagcaggttcagccgggcctgttcttgataaaacgagagaaggatgccagtgtttcacggagctgtcctattcttgtttctcctcctcgtcgcagcagaggtgggaaccatcgatgccaaaatgggagtagccatgcccatgcatgccttgataatggagaaagcgaaacatcatgagacggagaagaaggaggagaaaagcacggagaaggaagagagtcaatgcttatcgccgagtctccagtttcgagggcttctgcttcaacagcgacagatgcgccgaggtgtgcatgaaggagagctttcccggtggcgagtgcaagcgggacgtggccatgcgcaagtgcttctgcaagaagccttgctagttcatcggtcttgctaattgttgatgggtgcttcattaatttgatttgatgggtctcatggctacgagaaacaaatcatgatctaa

SEQ ID NO: 14645 - DNA, 274 bp, Zea mays
  Clone ID: cC-zmpo148073g11a1
acaaaattttttttttttcccacaaacacaagaaccggaacgaatcatttatcaaatagaaaactcccctcccccattttatttttacaaaaaaaaatacatcaaatctaataattccctgattccaaagggggccacctatatatattttgacggttacctttaacaacattacatttaaggaaagatgggggaacacacatatttttcaaatcaacatctacccttcactcatttcatgttatttcccgatcaatcactttccaaccacatt

SEQ ID NO: 14646 - DNA, 318 bp, Zea mays
  Clone ID: cC-zmpo148073g11d1
gcgtccgcttatgacccattggtctgccattgcaattgaaatgtggtttgatcgtgcttgatcgggaactaacatgaaagtagtgaattgtagatgcttatctgaaaaatatgtgtgttcccccctctttccttccatgtcgtgttgttgcaggtaaccgtcacaatatatataggtggccccctttggaatccggggattattccgtttgctgtatttttttctgtgaaaatgaactgattcctgtcaattttctatatgatttatgattcatctgaaattcctgtataaaaaacacaatttttattattttaattt

SEQ ID NO: 14647 - DNA, 410 bp, Zea mays
  unsure at all n locations
  Clone ID: cC-zmpo148073g12a1
ncnanaatttttttttgaaacagagcaagctctctataggancgatcagatttatacaatttacattgccgactcaagctctcaggctcaatctaacagcattttcttttgcgttgcttactagagtagtagcgacaaaatgtggtaatacgtcatcaattgggacgaaatatatagtcggcacacccaccgggctgtgaaagtgtgaaggcatgccgacggccgagctgtaaatctgcgccagattagaccgtgacgtggcggtggtggaagaggggcttggtgatggccggcttgagcatggaggacacgggcggcctctccgcgaaggagaaagcccaccggaaggcgttctgggaggcccgaccgtagcaccttcagcaccacccgtctttgtactaatggccgcc

SEQ ID NO: 14648 - DNA, 442 bp, Zea mays
  Clone ID: cC-zmpo148073g12d1
gtccgtacgtacgcatcttgtggctcacgacgatagccgaggaatttatggaccgaacgagaagctcctgcgtggggtcaacgtttaccctaccgtaccagctagccaccacacgcgtagcgcgggaaatgccggcggcggcgggccatgacgactaggcggttggtgctggaggtgctacggtcggccttccgcgacgcctttccaggtggccttcttccttcgcggcgaggccgcccgtgtccaccatgcttaagccggccatcaccaagcccctctaccaccaccaccacgacaacgactaatctggcgcagatctacagcacggccgtcggcatgccttaacactttcacagcccggggggagtgccgactatatattttcgtcccaattgaggacggactaccccatttggtcgttacctacttctagaagcaaccc

SEQ ID NO: 14649 - DNA, 412 bp, Zea mays
  Clone ID: cC-zmpo148073h01a1
tttttctttttgattaactataaaagaggtcatttgtatgggaggtatatataatttcttcccctttccctttctctcccctgtaatgcgagcgatcgacacagcttgcgagcaattttcagcgagaaaaatgcgaaacaccacgcacatcatttcatcaatcgggccgcggggcgcgggacgcgtaaggatctttcgcgctccttcaagtcaagctatggccgtggccttaccgcctcctggccagctggaacgtgcgcttcaagaactggttggcggcctcgtcgtcgcggtggcacagcacccggaggatggtgttcgggttcgcggggtcccacctacgcgtcgtgggcggcagcggcgtgcacccgtctgcgccggctcggccgttctcgctgatggagtcccacgt

SEQ ID NO: 14650 - DNA, 563 bp, Zea mays
  Clone ID: cC-zmpo148073h01d1
aacccccgcgtgcgcccacgcgtccgtgaagagcgccttcaccaacatttttgttaatggactcggcgaggttgacagggtgagcatcgaccgcgacagcgaccctggctccgtcctgattcagctcgccagggacacggagcacctggccttgttcgagcgcaggaacttcagcccggtgctgaggcggtggcaccccgcgccggtcgcggtggccgcggtcaccctgcacggctgcttcggcgtcgtgctgaggcagtacctggccaaggtgaccatcctcaccgaggagctcgtccgcgtgctccactcggcaagcaggctggagaaggcactggcgcagatgacggtcgaggacgcggcggactgcgccgacggccgggccaagggtatcgtgggcgacatggagcccttcgaggtggagtccgtcgtgatgggactgctcaaggcctggatggacgacaagcttgggcttggcagggactgccttctccgagccagaaacactgagagctggatacccaagtccaaggaggaaaccgttcgccggttcggcatggagc

SEQ ID NO: 14651 - DNA, 424 bp, Zea mays
  Clone ID: cC-zmpo148073h03a1
tttttctttttgttttacaaaaggatcacattacatttgggcatgcaaaaccatcacgaacagcaggcacacttctccattaaattaaagggatgggatatatataaagaagtcgacaaaacaatttggcaggatcgagtcggataatatatattcggaggcatgcaatagcatgcatgtgggtaggcttggccacactttgcgtatctatatataattatggcaagaacagtagtagccggacacacaatcgagcccttaattagttctcggttttgaccaccttgcttggctggacgcacgcttctcagttcaaccggacgacggccccagcgccggcgccggcgccggcgcatcggaattcgtatcagccatcttcatgtccccgtatacgacgcggcctttcgaactagggctgctgtcg

SEQ ID NO: 14652 - DNA, 465 bp, Zea mays
  Clone ID: cC-zmpo148073h03d1
ccccgcgtccgaaagacatccacgtcctcggcagcgtcgacggcttcatttacggcagcagccccgagtccgaaggccgggtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctacccacatgcatgctattgcatgcctccgaatatatattatccgactcgatcctgccaaattgtttcgtcgacttcattatatatatcccatccctttaatttaatggagaagtgtgactgctgttcgtgatggttttgtatgcgcaaatgtaatggaatccatttgtccaac

SEQ ID NO: 14653 - DNA, 288 bp, Zea mays
  Clone ID: cC-zmpo148073h04a1
tttttctttttgataaccaaatcatatatttcatctcagggttggagaactatttgacacacatagataaattaaatcacgtctatgtaattaacacaacccgtaaccatgcatatctattcatatcacatcacatcaataataatatatggaaacagctgtgcatgtgactttttccaattctaccaccttagctacagtcaccaagaacgatctattcaactgcaatgtcaacttgtgacggatccatcgttttccatgctcgcttacgtaagcactcacactctt

SEQ ID NO: 14654 - DNA, 375 bp, Zea mays
  Clone ID: cC-zmpo148073h05a1
ccttctacaacacttgagtgacttggctgggatgtcatgctttccccaactgtacattaataggcaacacatgaactaccctgactgacccagaccccattaagtttacaatccgacattcacaataggtgaaaatgcgattgcttcgtgtcgcctgttcttccttccttcacctgctggctgcagcaggagggatgctgacccactgcagctgcagctgaatctccccgctctccacgttcctgaggcggaggatcatgtcctgcgcgaacttgccgttcctccagcacacgtggctctcgacggcgaggcagttcgtggcgctcggccgcaccgacaggatgatggcgccgttcctcatgctcgcctccgggc

SEQ ID NO: 14655 - DNA, 556 bp, Zea mays
  Clone ID: cC-zmpo148073h05d1
ggccggaaagaagtctcctggttctttcgatcgaattaggcgccttttttgtcccacgctccgtctttatttgtaatgtgaagcttacaggaacatttgagtggatcatggacggattggtaggcctcttgaaagtccgggtggtgaggggcattaaccttgcctaccgtgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcatggacgacccgatgggggacgcggagatcgacgtggcgccgctggtggaggcggcgaacgctagcccggaggcgagcctgaggaacggcgccatcattctgtcggtgcggccgagcgccacgaactgcctcgtcgacgagagccacgtgttctggaggaacggcaagttcgcgcaagacatgatcctccgccttaggaacgtggagagcgggga

SEQ ID NO: 14656 - DNA, 432 bp, Zea mays
  unsure at all n locations
  Clone ID: cC-zmpo148073h06a1
acnaagacaaaccttttcattttccgccagcatgccttacaattgtgacccggtcaattgatgaaaaacacacatttgcgtgacattacatttggagttccatcgacggtatatttggaaaaaaacaattagcttagaaaatgccagattaataggaatgcaatataattctccatacacatgaattgaatgggtccggaaaaaactatcaagaactttgacttgcgagggattcaaacccatccaatcccactcaatccacatggattgaaggctaaccgaacaagccctaagcagatcctcctgatcaacggatctctacaaaggttcatttgccaacaaaagaatttcagcaatgtctgaggccttcttcatcaaatgtttattccttctggatatatatcatattgaggactgccattcttccaacct

SEQ ID NO: 14657 - DNA, 571 bp, Zea mays
  Clone ID: cC-zmpo148073h06d1
gtccggccacgtttgccctgtatggtgacggtgcggctaaccagtgtcttctctttgaggctctcaacatttcggccgtctggaatctgcccgccatattggtttgccagaacaaccattatggtatgggaacagcggaatggagggcagcgaagagtcctgcttactacaagcgtggcgactatgtgcctggattgaaggttgatggaatggatgttcttgctgtgaagcaagcgtgcaaatttgcaaaagatcatgctgttgcaaatggcccaattgtccttgagatggatacctacaggtaccatggccactctatgtcagatccaggaagcacttaccgcaccagggatgagatttcaggtgtcaggcaggaacgggacccaattgaaagggttagaaagttgcttttggctcacgacttggcaactgctgctgagctcaaggatatggagaaagaaatcaggaaacaagtagatgacgccattgcaaaagccaaggaaagttctatgcctgatacttttgagctcttcacaaatgtttataagaagggattcaacgtggagtcatt

SEQ ID NO: 14658 - DNA, 468 bp, Zea mays
  unsure at all n locations
  Clone ID: cC-zmpo148073h07a1
attgcctcccaaaatggcatgtatggtnagcatttttcttgttttccactctttggaattcggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctagtagaattggacgttggaagtgtagacggcatcgggtctccagttcggcgggatgacgtctttggcgatgaccttcttgccggactcgctggtgaggcggatggagaaggggcccttgagcgccttggcagtgtccatcctccagatggcgccccaagagagctttatgggcttccactcagccgacaacttgtcctggatttccatcagcacgatgt

SEQ ID NO: 14659 - DNA, 624 bp, Zea mays
  unsure at all n locations
  Clone ID: cC-zmpo148073h07d1
gtccgggctgcggctcatgctacgaggtgagatgcaaggaaaaacctgtgtgctcgggcaatccagtcacggtgtacgtcactgacatgaactacgagcctatcgctccctaccacttcgacttgagcggcaaggcctttggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagttcggcaagaaggtcatcgccaaagacgtcatcccgccgaactggagacccgatgccgtctacactttcaacgtccaattctactagactttgaattcccttcgattcatccggcgcggtgggctatggacctgcagcagcnagctaattaagtttatatatattgcatgag

SEQ ID NO: 14660 - DNA, 480 bp, Zea mays
  Clone ID: cC-zmpo148073h08a1
gcgatattaaaatcgcgaggggagggagatgattaaaatttagtatctattttacccactgatattatgcgcttaaatccatactcgttgtcgagcagaatataaacacatgggtgttacagcgccatgccacacaccaccttctgcctagattccgagcctaaaacccccacaccgagacgatctatgcgttgcggaggaaaaatagaattgacaggtaagcttcttaccaaatgggatggcgtaatcactccggtcaccgctcaaagtcgctttgccgctgtgtagattttccggtgaacaatcccagggtcccccggcatcaatccacccggaatgaccacatgatttgcactggagatgtcggcggaatcctgtatctggtcaccgaggccaaatgtggccgcacacccgaattacccagggccgctggattcccaccacgacgacaggatcccaccaacgcactgcacggcacat

SEQ ID NO: 14661 - DNA, 583 bp, Zea mays
  Clone ID: cC-zmpo148073h08d1
gtccgactttgcagagcgattactatgtagagagcgcagagggcttttacctggtccgctcgccgttgtgtccaggcggggcaaacacagagacctcgggagcctgccgcacctccatcgagcggaacggaagaatggtgggagaacagagaaactccaccgccatggcccggcgccgcgccttctctggtgcactggtaccgctgccatgtgccgtgcagtgcgttggtgggatcctgtcgtcgtggtgggaatccagcggccctgggtaattcgggtgtgcgcccacatttggcctcggtgaccagctacaggattccgccgacatctccagtgcaaatcatgtggtcattccgggtggattgatgccgggggaccctgggattgttcaccggaaaatctacacagcggcaaagcgactctgagcggtgaccggagtgattacgccatcccatttggtaagaagcttacctgtcaattctattttttctccgcaacgcatagatcgtctcggtgtgggggttttaggctcggaatctaagcaggaagtggtgtgtggcatgcgctttaacacccatgtgtt

SEQ ID NO: 14662 - DNA, 488 bp, Zea mays
  unsure at all n locations
  Clone ID: cC-zmpo148073h09a1
aatnanaaggaggctcaacgggactgttcttgtataatgatcgtgtgatttatgatacaaatacaatcgtgacgacgctaacagccgtggtaaattagtcgtggagactctgaacccaccaaaaaggctcgaccagttccgtgtactccctcgtatgcaggcggccattcactgccttgacactagtattattaaaatctccctctctctctctctttttcacaagaattacttacacagccattctgctcgttccgacgcagtatcatttgtatcacacagatccgatgagaagcgtgtgctccctctgccgtcgtgctctccgcctccaagcttttaccccgaccgtttcaagtaggccatcacaccgagcccagcaaccagagccgcccctgccgcgacggcgctgtacgcaaaaacccatgctgcgtccttgccagcggactccaagtccgaaggtccacccccttcctttccgcggcaacgcc

SEQ ID NO: 14663 - DNA, 516 bp, Zea mays
  unsure at all n locations
  Clone ID: cC-zmpo148073h09d1
gtccgcctgattcgcgggagccagcgggcgagacaaagagaatccttcgctcctgcgccgccgcggatcagcgccggggccgatcggaggctctcgcttcccccggcgggcggcgcgcgccgggagatggacggcggcgcgggcgcgggcgccggccggaggaacgtctcatcgtcctccggatccaggaggagggtcctgcccgccgagaacgggcacggccatgacgccccgccgccctccaggcggtcctccgtctccctctcccgcggccactccacgtcactgaccggcgagaggaccgtgaaaaggctgaggctgtccaaggcgctgacgataccggatcacacaaccgtgcacgaggcttgtcggaggatggcgtcacgcagggttgacgccgtgctgctgactgactccaacgctttgctctgtgggatcctcaccgacaggacataaccacagggtgattgctcgggagttgaagatggaagagacaccggtctncaggtcatgacc

SEQ ID NO: 14664 - DNA, 540 bp, Zea mays
  unsure at all n locations
  Clone ID: cC-zmpo148073h10a1
annnanttttttttttttaanancnccacnaacaacagggggccggttaatttaaaaaaaccgaccggaccccccccaacaaaaaacccaaaaccaaaaaaaaagggggggccaaacaaacaaaaacaagggaaggacccccgcggggggaaggccccaaccaagaaaaaaaaaaacggcaaaaacccaaacaagcccccagggggcaggccccaacactcatcttcttacaaaaccccagggggctttcaacaaaaacaacttcttattttttctggggcaagggggggggaaaaccccaaaaaaaaaaaaaacccccaatttgcctatttaaaacacacaccaatttggaaaaggcaaacccccgaagtttcaaacaaacaaaaactcggtcccaaaaaaaaaaatcagcccccattctttttatcaaaaaaccccccccccaacaaagcccattttttcccggcctgtccagggacccatttccacaaaaaacccccccccccctttaaaattaaggggccaaaaagaagaaggggg

SEQ ID NO: 14665 - DNA, 560 bp, Zea mays
  Clone ID: cC-zmpo148073h10d1
gtccgcccacgcgtccgaaggtgctctcctggttaatcctcatactttttagctaaaactgtgtgactttggcagctgtaaagttctggtaaaaggcgaaccaaacatcccttacatctgttctagatactacagagctccagagctcatatttggtgctactgaatacacaacagccattgatgtttggtctgctggctgtgtgctcgctgagctgcttctaggacagcctctgttccctggagaaagcggtgttgatcagcttgttgaaatcatcaaggttctgggcacacccacacgtgaagaaattaagtgcatgaatccaaattataccgagtttaaattcccgcaaatcaaagctcacccgtggcataagatattccataaaaggatgcctgctgaagcaataaaactcgtgtccaggcttcttgcgtactcaccaaaacttcgatcgactgctttggaagcattggtccatcccgtctttgatgaacttcgggatccaaacacccgcttaccgaatggtcgttttctttcgcctttttcaattttaaccccca

SEQ ID NO: 14666 - DNA, 341 bp, Zea mays
  unsure at all n locations
  Clone ID: cC-zmpo148073h11a1
atttttttttttttattttnaaagnannannnaaanaggggcngggttatttttaaatttttttccgtcccaaccccaaaccctcataaaaaaaatataaaacccctaccccccctatcaataaaagaaaactgtaaaccaaacccacccccccttccctctaaaaaaaaaaaaaaattttgagcaacctcaccccaaaccccccttggaaaaaaaaaaaggaccaccacaacaaccaaccccaattataaaaacaaccccacccaaaccgggaaccccacccccattaaaaaccccaaccgttttccccccccccacccctacaaaaaaccccacctacc

SEQ ID NO: 14667 - DNA, 131 bp, Zea mays
  Clone ID: cC-zmpo148073h11d1
gtccggacgaccccaacctgcccgactacgtcatccagggccgcgttttctgcgacacctgccgcgccgggttcgtggccaacgtcaccgagtacatcgcgggcgccacggtgaggctggagtacaatcac

SEQ ID NO: 14668 - DNA, 381 bp, Zea mays
  Clone ID: cC-zmpo148073h12d1
cgtccggtcatgtcgagcagagggtgttcaaagatctcctggctaagttgtgtccaaggattgctgctcaccttgaagggatggggtttgatgtttcacttgttgctacaccaatggtttttgtgcctcttctcaaagagcctgccttcagagacaacacttcgggtatgggatatattattcaatgaaggagccaatgttttgttccgtgttgctctcgcaattttcaagaatgcgagaagaatgatctacttgcgcatccaacatatcggggatggaattgttattttgcaaccacccccccttattttttttgaccccttttaactccttgcactttccttttgaaaaaaattggtttaatgcccacaaataccctcc

SEQ ID NO: 14669 - DNA, 594 bp, Zea mays
  Clone ID: cC-zmpo148074a01d1
ccacgcgtccgccatcgcgtgcgtacattaatctaagcgatcttcatccagctttcttttctgctccctcgaaatggaggcgaggagcggggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattttgggatatttgttatcatactatgaaatgactgtgaatcgttgttctgatttgtctttcaccacatgttttccttgcatgaagtaagatacgatatttattgtatttcttgttttcgagaatatagtcaaagtatcttgtgatttgacggtt

SEQ ID NO: 14670 - DNA, 176 bp, Zea mays
  Clone ID: cC-zmpo148074a02d1
cgccacgcgttcgggccgttttccagtggcatttggcattggctggatttgggaacaggacctccaccgcaccaggctggtcggtttttaatgccattttgatcatatcaatttatgatcattctatgctcaatgtaggattcagtaccatcatatataacacttagtttatctgt

SEQ ID NO: 14671 - DNA, 518 bp, Zea mays
  Clone ID: cC-zmpo148074a03d1
gtccacgcgtgcgaggcgacgggggtacagaagatcgtcatcccgctgggctttctacctgacgggcgggctggaggggaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgttcgcgacgactgcatctccatcg

SEQ ID NO: 14672 - DNA, 528 bp, Zea mays
  Clone ID: cC-zmpo148074a04d1
gtccgaaaaaccaccatccgtcgtcgccaaccgtagcaagaacatctttaccttccagcaataatggcgcagagcatgaggagtgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttctcgaccccgtcgaatttttttcctttctattcttctactatactactactatctgtttgtcgcgttgatttcttctcatacatcgatcgaggatcgactcatcgttttgtaattcctgcaatttgtaagtgtaatgacctatatgatttagtctttccttt

SEQ ID NO: 14673 - DNA, 571 bp, Zea mays
  Clone ID: cC-zmpo148074a05d1
ccacgcgtccggggaactacgtgatagcgagcgaggagctggaggacgtcatgtatttttgcgatgcacatcctgtgggagttgagtcagggccgacagggtctagacgacgaccacggcggcgtccgtgctcaagggcctgtcgagcgctcacgtcgagctccaggacccttcggaccatgatctcatggcgcacatccactccacgctacagaagaaggagaagaggctcaaggacctcctcaggaccggcaactgcatcgtgaagaagttcaagaagcccaaggaggacaggtcgaaccagaacctcttcttctcgcaggtggacatgaagcttgtggcgagggtgctgaggatgcctaggatcaccaccgagcagcttcagtggtgcaaggccaagcttgacaagatcgttctggtagataggaagatccacagggaggcttcatttttgttgttcccctgttgagagagcacggatatatacttatttttcttttcgatcgcggttgctcgataaaaagggaatacatttacccatgttatcagtcccacagggggttggattttt

SEQ ID NO: 14674 - DNA, 561 bp, Zea mays
  Clone ID: cC-zmpo148074a06d1
cacgcgtccgcggcgcgtgggcgaggccaaaagtaagctgctgctgttctttttcctttcccgttcgttcgattcgttctttgggccggtggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgttctggctgcctcgccggccgatgaaggatgaacggttgcggccgatgatcgatgtgtccgtcggcatgtcgatcactcattgaaaccccctctaatcctgtgcggtattattttcatggcacctggggccattaaagatccatggacacgtacacgtccaatacatgacttttcacagtttaactaaaaaaaaacaaaaagggc

SEQ ID NO: 14675 - DNA, 289 bp, Zea mays
  Clone ID: cC-zmpo148074a08d1
tgaaaggtgcctattgggaccatgcttcgtcgccgaaggttctgcttatggagacagcttcggctgaaactggtcaggcttgactccgaaggcaccattcatgaagcttcggtattacaacatatccgaagatgaagagtcgaaccgacttaaagatagaatgaccttttagtccataagggcttgagtcaatgttgtaaacttttatgaggggcatggctgtaattcctcacaggctgtgtcctgtgcctataaatagcgaacagtattcctttaaaaaaaaacaaaa

SEQ ID NO: 14676 - DNA, 585 bp, Zea mays
  unsure at all n locations
  Clone ID: cC-zmpo148074a09d1
taatctgccatcctctgcatgacgaagatggcgttcatcagcttcgattttgtgaaggcggcgggcgtggccgggctggttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtctagaacctgtccatcaacggccactgcaccatcgacgggcagggagccctggtgtggagcaagaaccagtgccagcatttttacaattgcacgatccttccgaatagcttggtgctggattttgtgacgaacgtncagatccgcggcatcacgctgctcaacagcaag

SEQ ID NO: 14677 - DNA, 563 bp, Zea mays
  Clone ID: cC-zmpo148074a10d1
ggaaatcatacaggagtttggatccattcaacgtagagctttctttcaatttataacgggttcacctcggggtccagcttgcggcttggctgcactaaatccaaagttcacagttgttcgaaagaataacagcaatgatgttgatcatgacctgccgagcgtgatgacttgtgccaactatcttaagttacctccatactcttcaaaggaaaagatgagagagaaactcctctatgcaattacagagggccagggatccttccacctatcttaaccaataagcgataatgatacttcgcatgcaacaggagtttctctttgtaagtatctcgtaggaaaggaaaacacggtgtaaatgtgggtggttcactgcttattttagctgacagcacgatctggtggagctgattttaggagagaaaaaaacggctaccgctctttgtacatactaggtttcaggtgtgatcaagcagatcactagtgtgcctagttcgctactcttttgttcaactttcggtgtacatatgcgtgcctgcctgatagaagtgccagtgctatctttc

SEQ ID NO: 14678 - DNA, 296 bp, Zea mays
  Clone ID: cC-zmpo148074a11a1
cccacctgcaatccactaattaggtgtggattacattcaatcactgtgagctctcacacttttccaactaacaatgactcttctcacgaacaaatagattatcactgaccgatgaatacaccatacctccctgctctgctcttcccccctactatcatcaacaaaaagcctcatccaaatccaatggacacaatttcaaagatgcattgaaagaaagaaataaacacggtgcgggcccgatgaatagttgtagctactccaactccaacaacaggttcttccccttgacttgtgct

SEQ ID NO: 14679 - DNA, 549 bp, Zea mays
  Clone ID: cC-zmpo148074a11d1
cgtctcctcccctctcgcacctgctcctcccgtgacagcctcggttttcgagggttcaagggatgactaggggctcgggtctatggaggtaacttcaagtgacggatctcaattggagttgacaaaacttgcagcaatatttttcttcttggtggcggcggcgggcgcctccctccatggctccagctggtgatcggagcgccgccgcccggaaccccacaaaataaaacagctcgtcggtgccccaccccacccaccatctcctcctcaccggctttatatatgcactcgccgcgcaccccggcgccagctacccatgccatgtcacacgacacggcatcgcacgttcaccaccaccccgccgcagcagaagaccccggcggcagcgagtgccggttctgcgagatgactcggcagcaccatccttagtgcgcgcggctgctgccgaagcgcatcatcctggtgcggcacggctagagccatgggaacctggacatgtcggcctacaccaccacgcccgactaccgcattccgctgacagcgctggga

SEQ ID NO: 14680 - DNA, 375 bp, Zea mays
  Clone ID: cC-zmpo148074a12d1
ccacacgtccgcccacgcgtccgaaaaaaaaaaaaaaaaaaataaaatataaaaaaaaaaaaaaaaaaaaaaaaagaaaagaaaaaaaaaaaaaaaaaaaaaaaaaccaaaaaaaaaaaaaaaaaaaaaaaaaaaaaaaaaaaaaaaaaaaaaaaaaaaaaaaacaaaaaaaaaaaaataaaaacgaaaaaaccaaaaaaaccaagtaacaaaaccaaattaaatatccaaactaaaataaacccacataaaacaaaaaataaaaaaacccaaaaggaaccacacaaaaaaaacattaaaaaaagaccaaacataacaaacaggacaaaatctgactatcaaataaaacaacacattaaaccggaaaaataaaaa

SEQ ID NO: 14681 - DNA, 398 bp, Zea mays
  Clone ID: cC-zmpo148074b02d1
ccacgcgtccgcttctccattcgtttacctgaagcacaagaataaacgcagctttgcatgggcgaagctaagctcaacaacggggccgggctgctggtggccctcctcctcctgagcagtggcgttcaggacgctgccgccatgccaggcacgttgaactacgacgcgattgtcgccgacgagccaaacggaaagaacaaggacctgtaccgccccgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacggcgtttatat

SEQ ID NO: 14682 - DNA, 424 bp, Zea mays
  Clone ID: cC-zmpo148074b03d1
cacccgtccgcccacgcgtccgaggtggtcttggtggagagcccgcgcaagtgttctgtaccaggtgcaggcggacagggaccgggccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtggctgtaccaaattctgagtgctggattcttgctattgtc

SEQ ID NO: 14683 - DNA, 539 bp, Zea mays
  Clone ID: cC-zmpo148074b05d1
cgaccggccgtcagcgagcagtctcccaattccacccaataactatttttatctcctcgaacgccaggttcctgcacgggtatattcaggagcgacgaagtgatccacccgtcagccatggagatgaagaaggttctctgcgccgccctcgtcgccgccgcctcggacaccgccgagctggcctcggtcgcctccgaggcgccctccgaggcgcccgccggcgcggccggtggtgcggctggccctagcgcaagcggcgccgtcgccgccgccgtgcccgccgccggggcgctcgttgtcttcttcctcgcctactaccttcactgagcgacgacgcgcggggcggcaactttgggatgcatcgcgtttggttcatccgaataattaattgctttttttatttacgtgggttgccaatgcgtacatgtaagtctgttcgttctgttcgaggtcgcgtgaatcgtcaaacggtttgttctgttatttgtgactctcaagcaactttatctcgatcccaattttattttaaaaaaaaataa

SEQ ID NO: 14684 - DNA, 564 bp, Zea mays
  Clone ID: cC-zmpo148074b06d1
accacccgtccgggacgcgtgggcagccatgggcgcctgcgcaaccaagccctttactcttgaggggcaggccccagctgagggcgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaggccaggaaggagaagcaggcgcagcaaagctgaccgactgttcgtgcatgcgcgtgccaactaatataattattggctgatgatacctgatgatcagtgtgtgatcgagcaaggagacgacacttgaattctctacagttggcatagcggcatatgtcgggagagac

SEQ ID NO: 14685 - DNA, 616 bp, Zea mays
  Clone ID: cC-zmpo148074b07d1
gacaaggagtacgtgtacgatgcccgtcgacggcaacttgctttgcaccggcgacctcagcgcgtaccggaggggctggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccatgccacggcatcagcgtcggcagcctggggcgctacaaggacgagaaggacgtggaagacgtgcaggtgacggggtgcacgatcgccggcaccacgaacggtctgcgcatcaagtcgtacgaggacctcagtcgtcgc

SEQ ID NO: 14686 - DNA, 269 bp, Zea mays
  Clone ID: cC-zmpo148074b08d1
ggacgcgtgggctttagtgctgacaatactttaagctgacttttgcttgctatactagattgggttggatccggagcggtgcattacacatgcatgcattggaccgtgatatctatttgctaccactaccctattatgacagtgatgctggcgccaacaatgatggtgtcatcctccttctccatcttcttcatctccatatatagctagagtgagacttcgctgttgtttaaaagatcagagttaagaaatggattgacacgttatat

SEQ ID NO: 14687 - DNA, 528 bp, Zea mays
  Clone ID: cC-zmpo148074b09d1
ccacgcgtccgcggacgcgtgggttcaagcacctcctcctcttccgtttgccaacaactcagccgccgcaacggccaggtcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgtcgccgagaccacgacgacggtggaagcgaagaagaaggacgtcgaggaggccaggaaggagaagcaggcgcagcatagctgaccgactgtacgtgcatgcgcgtgccaactaatataattatt

SEQ ID NO: 14688 - DNA, 350 bp, Zea mays
  Clone ID: cC-zmpo148074b11d1
gtccgcaagaggttgagcatggcggcagcggcaacgttccgcaccattataatgtcagccatgaaggcatataccaaagggacatggatggaacttcagagccatcgcacgacgaggatccatgtgatacttccaactctgatggagcaagcaatgggcatccgaaacaagagaacacaagaacttcggtgcacacaagaagatgaactttcagagcatcccagctcagatgcaacaatccagaatgaggaagtgctatgtttagcttccaaacttaccaagttatgggtgtgcacatgctaaatctgtaactgtaaagcaactaacaatgtccaattaattgagttagc

SEQ ID NO: 14689 - DNA, 597 bp, Zea mays
  Clone ID: cC-zmpo148074b12d1
tccggctagttcgtggatggcggcgccacgacctctcctgttgtcgtcgcttttcgccatgctagcggtggccgccgaggtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaggtgcggtgcgtggacagccccagcgggtgcaagcccgacgcggcggcgctggtggtgacggcgaccgacctgtgcccacccaaggacaagtggtgcaagccgccgcaggagcacttcgacctcagcatgcccgcgttccttcagatcgcgcaggagaaggccggcatcgtgcccatcttctatcgcaaggtggcatgcgcaaagcatggcggcatccggtacaccatcaccgggaacaagtacttcaacatggtgacgatcaccaacgt

SEQ ID NO: 14690 - DNA, 464 bp, Zea mays
  unsure at all n locations
  Clone ID: cC-zmpo148074c01d1
gtccggcggngctcatcggcgactggtacaccaaggaccacgaggtgttggttctccagctcgacgccggcaagagcggggggggtcccgcgggcgtgctcatcaacggcaagggaggcaaggacctggaggccgccgcgcccatgctcaccttcgaggcgggcaagacgtaccgcctccgcgtgtgcaacaccgggatcaaggcgtcgctcaacttccgcattcaaggccacgaaaatgaagctcgtggagcttggagggctaacataccttgcagaacgtgtacgactcgctggacgtgcacgttggccactgcctctccgtgctggtcgacgccgaccaggcgcccggcgactactacatggtggcctccacgcggttcatccacgacgccaagtccgcctccgccgtcattcgctacgccggctccagcggcgccccgccggcgcccaacatgaccgagc

SEQ ID NO: 14691 - DNA, 417 bp, Zea mays
  Clone ID: cC-zmpo148074c02d1
tccggaatatgaggataaactggataaagacatgattgtatatactttggttttaggagagggcgataacccgtgggggggatcggtcgtggatggcaatcgacatttctcactaaagataaagctgttgccgaggaaagggccgcaaagctcgggataaagctagaatggaccgacgacggcgtgaagacggtcatgggccccatccccgcggtgaagtgggacgagagccgaggacggaagatctggttcaacagcattgtcgccgcctacattgggtggaaggacgcccggaacgaccccacgaaggcggtgaccttctgcgatggctcacccctgcctgctgacgtcatcgacgcgtgcggccaggtcctagaggaggagtccgtggccgtgccatggcagcacggcgacatt

SEQ ID NO: 14692 - DNA, 555 bp, Zea mays
  Clone ID: cC-zmpo148074c04d1
gtccggcagagataggcgtcttcgtactcgcctacctccgcggcttttatcctttcccccttctcccaattccctccgggggggggcgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccaacaactttgcccgtggtcactacaccattggcaaggagattgttgacctatgccttgatcgcatcaggaagcttgccgacaactgcactgggctccagggcttcctcgttttaacgctgttggtggaggaacgggctcttgcct

SEQ ID NO: 14693 - DNA, 485 bp, Zea mays
  Clone ID: cC-zmpo148074c05d1
gtccgggcaaagatgtcgtggcaggcgtacgtggacgagcacctgatttgcttttatcgagggccaccacctcgcgggggcgggcatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgactttcaataatagttacaacaaag

SEQ ID NO: 14694 - DNA, 560 bp, Zea mays
  Clone ID: cC-zmpo148074c07d1
tgtgctcgtcgttcggccacatggtgaccccgcccaccgacactttgcttatcacgcccaccaagaagcaggacgacaaggctaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccgatgaagcggcggcggctaccgcggtgccgcctgcaggtgccagtgccaagacctccagcagcaacgatgcccgcgacggcgccatgggcagcgtgcaggacgagccgcggcagcagcgccacgatgactatcaccccgagatcgtccccgagaagatcatacacgaggacgcgttgccggtcgttgctgcagagaaggagaccgtcgtcgtcgtcgtcgtctcgaaggaggaagaggtggagtcgcccaagaaaggagcggctctgtcgcctgtgccggagactatcgtcatcgccacc

SEQ ID NO: 14695 - DNA, 556 bp, Zea mays
  Clone ID: cC-zmpo148074c08d1
cgtctcaccctccgtccctcacacaaataataaggaaaggtttcgtttttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgtgccggcgtcctgctcaccaggaacgttggcatcttcgacagcctgcgccccgtcacccgctaggctacttcaggacgtg

SEQ ID NO: 14696 - DNA, 592 bp, Zea mays
  Clone ID: cC-zmpo148074c09d1
ctacgtgcactccgaggaatcgctgcccgttgtggccgaaaactttgtttcaatggcggggaacgacggcgactggcgggtgttcgtcgacctggagcccgttccggccatcagcaagcggcacggcggcagcgtcggcggcgaccacgcggcgccgtgcgccagggctaggaccatgtccaccagcttcaaggagccgccttgtgtcgccgaacacctccctctctctggccccgtgcagctcgcggcgtccaccggcttctcctgggccaagaagccccggcccgacgccacgacggcggcggtaactgtgacgatgcggagcggctccatggggccagggaccaacaggaacaacaacagcggaggaggagacggagcaagaaccaccttcggctccggcgccaccgtcaccgtcacagcagcggcggcaccatacgaggcggagaagcggaggtgatcaagcagtgggcacaggtcgctgacgccttcagcgcctctgaagcttacaacagcaggttgaggcagacgcttgacgccaagcagctcaagactggaatgatgcacatggggacaggtgacagggtggact

SEQ ID NO: 14697 - DNA, 560 bp, Zea mays
  unsure at all n locations
  Clone ID: cC-zmpo148074c10d1
cacgcgtccgaaaccatagcatcaatcatgtctggtcgtttttggttataatggcgcctctcctggcgtcggtgcggctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccggcgttcctcaagatcgccgaggagaaggccggcatcgtgcccatcacctaccgcaaggtggcgtgcgagaagaaaggctgcatccggtacacgatcacggngaaccagcactacagcgag

SEQ ID NO: 14698 - DNA, 571 bp, Zea mays
  Clone ID: cC-zmpo148074c11d1
atcagcgtcggctgcctaggccgctacaaggacgagattttcgtttgtcgacatcacggcgcggaactgcgggctgggaacaccaccaacggcgtgcgcatcaagtcgtacgtggacgccgagtccgtgctgacggcctcccatctcaccttcgagaacatcaggatggaggaggtggccaaccccatcgtcatcgaccagtacttctgcccgcagaaggtatgccctggcaagcggagcaactcctcgcatgtctccgtcaaggacgtcacgttccgcaacatcaccggcacgtcgtccacgcccgaggccatcagcctgctctgctcggagacgcagccatgcagcggcgtctccctcatcgatgtcaacgtggagtacgccggcaagaacaacaaaaccatggccgtctgcagcaacgccaagggcaccgtcaagggaagcatcgaggcactggcttgcctggtctgatgatgaccttccttttgcatgcatgcatggtatctcatccttgatgatgatctagctcactagttctttttaaatttcgcttcattcgcttttccaaatt

SEQ ID NO: 14699 - DNA, 109 bp, Zea mays
  Clone ID: cC-zmpo148074c12a1
tttcttcccaaacttcattttaaaccggaactggtacacagaaacgcatagtgttgatttaaatttatgtgcaggcccaacacaataaatacctacttaatgaacctta

SEQ ID NO: 14700 - DNA, 588 bp, Zea mays
  Clone ID: cC-zmpo148074c12d1
cttcgactacttcgctgacccgacggtcgagatcgctacttatactttggcggtgctggctgatgggctcgggacgggcaaccctgccactgcagcttcctacttcacgagtccatgcagtgacatgaagctgaacctgagctacacgatcctgcctgcacaacctggcgctctggtcaacctggcatccccgggggcgctggctccggcgggagcgccggcaccgttgctccaacccgctgacgttgtggacccgccgctgcctccagttaaagctgtgatcgccgtcgacgcgccggcgccaggggcggctgacaacacctcctcggcgttcagctccagcgcggggaacggcctcttgtgggctggcatcgctgccctcttgtccctgacctttctgcactgatctttccttggcgtggcttccattcacgttttccttctttctctacgtgtttccctcttactcctcaaatgtagctctaactgtaacataatgttccttaaatagatataaattgtcatcaacctgcacatatatacagatcagaaaagaagtaccgtgcaccagttcaagattggtgccgt

SEQ ID NO: 14701 - DNA, 367 bp, Zea mays
  Clone ID: cC-zmpo148074d01d1
ggccggaggtgctggcgcgccagctcgactccggcaagagcgtgttttcgcttcgcgggcgtgctcatcaacggcaagggaggcgtggacctgtaggccgccgcgcccatgctcaccttcgaggcgggcaagacgtaccgccttcgcgtgtgcaacaccgggatcaaggcgtctctcaacttccgcatccagggccactacatgaagctcgtggagctggagggctcacataccctgcaggacgtgtacgactcgctggacgtgcacgtcggccactgcctctccgtgctggtcgacgccgaccaagcgcccggcgactactacatggtggcctccacgcggttcattcacgacgccaagtccgcct

SEQ ID NO: 14702 - DNA, 542 bp, Zea mays
  unsure at all n locations
  Clone ID: cC-zmpo148074d02d1
cgcccacgcgtccggccgtgctagcggtggccgcggatgtcgtttacttttgccacgccaagcccctgacgcctggcgggcgcgtgttacaccacaaccacggcaagttcacggccgggccgtggaaacccgcccacgcgaccttctactgcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccgcccaacgaccagcagttcgcggacagcggcgggtggtgcaacccgtcgcgggagcactttgacctcagcatgcccgcgttccttcagatcgcgcacgagaaagccggctttgtgcccatcttctacctcanggtggtgtgcaccaagcaggcggcatttggtcaccatcaccggaac

SEQ ID NO: 14703 - DNA, 595 bp, Zea mays
  Clone ID: cC-zmpo148074d03d1
gtccgaagccctggtcccgtcctcttcagggcctcgccgtcgcctttttttttttcccccctcgtcgacggctcctggggacgggctcacagcctcacactcacgcggagagcgctcgcgcgggcgcacacgcggaggggacgttcacaggagggtgagggaggagatgccggggagccagaacggggggccgaggcctcggccggtcaaagccgagaccatccacgatcttgcgcgcgccggcgacctcgccggcgtccggaggaagctgctggagaacccctccctcctcaatgacaaaaatcccgtgatgtgtcaaacaccacttcatgttgctgctggctacaataatacagaaatagtcaagttcttgcttaaccagcaaggtacagaaacagttgatctggaggcaaagaacatgtatggggagactcctctgcatatggcagtgaagaacagttcttgtggatcaacaaatctactccttgaacatggtgcacacatagaagccaaagcccataatggcatgacaccattgcattaagctgtctggcatgcaattcaagctggagacttcacacagttagcgtgtact

SEQ ID NO: 14704 - DNA, 648 bp, Zea mays
  unsure at all n locations
  Clone ID: cC-zmpo148074d04d1
gaaggagcctcgccgaggcgtctgcttagggaggctgttcattgctccgacccgtacaactgtcaccaacggggtgtgggacgccgtacgtccacatgagctgtcagcagcacgtcggcgtagagatgcggttagagggccgaggatagcacaagtaagaggggtcccgtgctcgggcgacgaactcctatcgacaagtgcttggcgctgccgcagagaactgggcgatcggaccggcaagcgcctggtcccgttgcgccagaaggcttcgggcaccgcgactcaccggtcggcctcggcggcaaggatctactgtggtgacacgaccccanccgacgctctgacgtggttgaactccgcagcctccggctacgcttgcgctgtgggcgtcatttcagacccggccccgctgttggatcaatctttcgcnngcggtccatgatacatccaagctcttcgcaaggaagctgcttcatgtagcaagcgaacaagaccattcgacggggcgctggcgcgccaagtgcacattcgccaacgggcgccgtggatcacgggtgcagnctggcgcaaaacgtcattattcacaacctgcacgtgcacgacgtcaagcacaccatgggcggnctcatgcgcgactccccacgcaca

SEQ ID NO: 14705 - DNA, 415 bp, Zea mays
  Clone ID: cC-zmpo148074d05d1
cggccggaccaaccaccccgcgctcccgccccacgcacgccctcgcgtttactttcgccccgcccctcccccacgctgggcggagccgcaatggggtgcgcggcgtctgccgccaacggggccgggccccggcggcgggggtgggcgcgggcgcggatgcggcggtacagcgaggcgtacacctcgggtctgccgccgccgccgccgccgccgcaggaggcggcggagtcgtcgtccgggggcaggaggcgagggcgcaaggtggcgccggagcccaaggagccggcggaggaggggaccgccgcgctgccgccgatgcccggctcgcccagcttcaggtactactgccagaagaagaccgcggccgtcgacaggatcgtggccgacgccgacgccggcgacgccgatgactccg

SEQ ID NO: 14706 - DNA, 541 bp, Zea mays
  Clone ID: cC-zmpo148074d07d1
cggcaccgtcgagctcggctgtggaaacagaacaaacttttcatttatggcgaactcggcgtcggggatggccgggttcgactagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtcagggcgcgagctctctgaagaggaagacgcgcatccgctcgcgcgatcgccatgcatgccccggaacgacagaagctgtttgtcttgcatcga

SEQ ID NO: 14707 - DNA, 538 bp, Zea mays
  Clone ID: cC-zmpo148074d08d1
acgcgtccgctttctgatggttactcgaaagcctaaagtttttaatttaagctcatcccttccccatctgtgggattgtgaaataatgaagccggatataatgggacctgtacattgaccaccaaaagaggtgggagcttgctggagagttgaatgtcaggaagttggacaaatcgagatatatgattgagtttctgtggtgataagtacacatcgactccaaatggataatatgcagcataatttggagcaagctctttcttcttatccctaaaatagtttgctccacggacccggaatgtaccaggatcaatacgagaccaactgttgagcgtatttgtttccagcaagcataactgtacttgagaacctgctagaggcctttccaggaaatccttcgttgatagtagtgtggaagatggatgagcttcccctgacttcttcttgaggaaagcttcaaagaggcatcttattgaatgagtacggctcgagggagttctcttcttctcgttcaccccaacagcagaggcaatgcatg

SEQ ID NO: 14708 - DNA, 589 bp, Zea mays
  unsure at all n locations
  Clone ID: cC-zmpo148074d09d1
tgttgccaaagaattcgctcccctagccgccgccgccgctcgtttcccttagaggtgccgggaccgaggaactgggcgaggtctaggtagagaatcggttttgctcgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctncctccttcatctncagcattgtgttctgattcacctgcttcaatggcttgtctttctgctgctgatg

SEQ ID NO: 14709 - DNA, 613 bp, Zea mays
  unsure at all n locations
  Clone ID: cC-zmpo148074d10d1
aaacacactgcagccggatgaacagcaatgcaaggaacttttgtttaanncgcagggatagcattagctcgtcttgggatgctgttgccatggaccatagaatgaaccagtctaactcaacggcaaaaagctttgtcggaaaggttctcagattgatcaaacatacattctatgtggtgttctggtgtggggcactgcattttttcttcatatatcagaggcgttctgaagttcctggatgcatcgtatcttctgattgttaatcttaagcagtctgaagtgcacactagtattacagtctcatatatgtggactgtttttcatcatgttgtttcccaggattgacgcgtgtgttgaaaatcttattgtataataagatgccccttgttttcgcagccatccatgctgaaacttttgctacaccgcctaaaatctgtatgctagttgatactacctgtgttctcgataaataaaaaagaatagaaagggctagtttggaaacccaattttctcaggggttttcattttcccaaaggaaattaattcattttttttttgggaaattgaaatcccataaaaaaatgggggtaccatactagccccaaaagttaaa

SEQ ID NO: 14710 - DNA, 212 bp, Zea mays
  Clone ID: cC-zmpo148074d11a1
ttttaccattcctaacttttaatatccaaaaaactaaaatcttgggcatattaactatcaaatgacccaatttacacccctcaatttacttgtacatctttgtactgttttcccaatttattaactaacatcattatactgtacatcactactttggttcatcaagattcttccttacttgttcatgttcttctgtttgttttatttaaaat

SEQ ID NO: 14711 - DNA, 396 bp, Zea mays
  Clone ID: cC-zmpo148074d11d1
aacaacacccagatggcagcgtggcggacacggagcatgtattacctttgcaggagcaccccactgatgtgcgggaccacaagctccctcgcggccgtcatggcgcacatgttgtcccatcgggccacacacgtctgggtgacggacgcagagtcggaggaggacggcgtcgtcgtcggcgtggtgggctacaccgagatcttcaatgccgccaccaggagcacctgcccaagtccgacagcatcttgatgcaccacatcgtgctgtacagtatactgctgtcggttgatccgttggtgccccggtgcacgctgttgcactgaactgtacaatgtactttgctcatttgttggtttgtctggagagcttttagtcttttagatattcttggtctgc

SEQ ID NO: 14712 - DNA, 447 bp, Zea mays
  Clone ID: cC-zmpo148074d12d1
tttcttttctctttaaaaaaaacaaacttttaaaaaaaaaaaattttaattttaaaaaaagacacacaaccccagaccagtctccttcaaactaccataccatcccttcccaccactctctcctcctctcccttcccctccttcccttcctctccccttcctccctcttctttcctcccccccccaccctttctcctcccctctttttccccccttcctctcctccccatcccctccccttcccaccctttcttctcttcccaccctttcccctctttcccccctctccctttccctcacaccccctttccactcccctttccctacctttttcctcccttctctcctactttcccccccctttttcctctctctctcttcctctcctctttctccctctccttactctctcccccctccctctttttcccccttccctcctttttc

SEQ ID NO: 14713 - DNA, 429 bp, Zea mays
  Clone ID: cC-zmpo148074e01d1
gtgcgcaagtcttcgctcaaggccaccaagttcctgtaccatttcggtatcatggacaacgtctcctaccccatgatcgtagaccataagtactgccccaacaacatctgcgttaagttcggcgcctccaaggtggccgacaacgacttcttcttcaagaacattcacggcaccttcaacacgccggaggccatcacgctcaactgcgccaacaacctgccctgccagggcgtgcagctcatcaacgtctacattaagtacaacaggtccgacaacaagaccatgtccgtctgcaagaacgccatcggcaagtccattggcattgctaatgagctcgcctgcgcctgaacctacttgcattcatcactcacttttccgtaccctattttttctcactctcgtcgatctttttttacgcctttggcattc

SEQ ID NO: 14714 - DNA, 539 bp, Zea mays
  Clone ID: cC-zmpo148074e03d1
cgcccacgcgtccgcccacgcgtccgcccacgcgtccgttttacttgtccgcggacgcgtgggggcgcgtggggggggaaggacacgcgcacgcaggggtacggcgtgcagacggtggccgtgagcactgtgctgttctgtgacggcgcggcctgcggagggtgctacgaggtgcggtgcgtggacagccctagcgggtgcaagcccgacgcggcagcgctggtggtgacggtgaccgacctgtgcccgcccaaggaccagtggtgcaagccaccgcgggagcactttgacctcagcatgcccgcgttcctccagatcgcgcaagagaaggccggcattgtgcccatctcctaccgcagggtggcgtgcgcgaagcatggcggcattcggtacaccatcaccgggaacaagtacttcaacatggtgacgatcaccaatgtgggcggcgccggcgacattcggcggtgttggtgaaagggagcaagcgtgtaagtggacggagatgaagcgcaacttggggcaagtgtggtagaaccggg

SEQ ID NO: 14715 - DNA, 516 bp, Zea mays
  Clone ID: cC-zmpo148074e05d1
gtgcggagagctcgagccaccgacacggttgtcctttatttttttaatgctgcttcggcaggacaaagtactggcttggacgttttaaaatatgttgctgcccagtcaccttctcagaaatccaggcaacgccttcatcgggaatcacagcagccgccacaacaacagcaaccacaagtgcaggtgcagcaggcgcaaccacaaaaacaagcggcacctgttatgcgcagagcatcatctattgctgctcggcaagcagcaatggcacaacaatctcaggagactaaacccatttcatcttcgcccaagatcaagcgtcaaacatcatcgagatctggttcagtggcatccacaaagcctccggtagctgcatccgcgctaaaacctggtggtagcccaaagaaaggcgaggtcaaacctgctgccgacccagttcaaactccaaccacaggtgccgattcaccgaaacccgagcctagcgccccatcactccctggagccgaaggggtggataag

SEQ ID NO: 14716 - DNA, 541 bp, Zea mays
  Clone ID: cC-zmpo148074e06d1
gagagctcgagccaccgacacggttgtcctttatttttttgattgttgcttcggcaggacaaagtacttgggttggacgttttaaaatatgttgctgcccagtcaccttctcagaaatccaggcaacgccttcatcgggaatcacagcagccgccacaacaacagcaaccacaagtgcaggtgcagcaggcgcaaccacaaaaacaagcggcacctgttatgcgcagagcatcatctattgctgctcggcaagcagcaatggcacaacaatctcaggagactaaacccatttcatcttcgcccaagatcaagcgtcaaacatcagcgagatctggttcagtggcatccacaaagcctccggtagctgcatccgcgctaaaacctggtggtagcccaaagaaaggcgaggtcaaacctgctgccgacccagttcaaactccaaccacaagtgccgattcaccgaaacccgagcctagcgccccatcactccctggagccgaaagggtggataagatggccatcgacgaggcccgtggtgacg

SEQ ID NO: 14717 - DNA, 596 bp, Zea mays
  Clone ID: cC-zmpo148074e07d1
gtccgacaaggagtacgtgtccgtggcccggaacgtgacgatttctggttatggtcggcgacggcgccaccaagacggggatcatgggccacaagagcttcatgatgaacatcaccaccaaggacacggccacgatggaggcgatcgggaacgggttcctgatgcgcgggatcggcgtgaagaacacggcgggagccaagaaccaccaggcggtggcgctgcgggtgcagagcgacatgtcggcgttctacgagtgccggttcgacgggtaccaggacacgctgtacacgcacacgagccgccagtactaccgcgactgcgtcatcacgggcaccatcgacttcatcttcggcaacgcgcaggtggtgttccagaactgcctcatccaggtgcgcaagtgcatggacaaccagcagaacatcgtcacggcgcatggccgcaaggagaggcggtcggtgggcggcaccgtcatccacaactgcaccgtcgcgccgtacccgagttcgagaagagcgtcggccggttcaggaccttcctgggccgtccgtggaaggagcactcgcgcacgctctacatccagtcggagatcggcgggt

SEQ ID NO: 14718 - DNA, 590 bp, Zea mays
  unsure at all n locations
  Clone ID: cC-zmpo148074e08d1
cgtccgcgcctctcccaccggcccggtcgcccggagaagcaagtgtctttgatccgatccatcgtgcgagcatatgcacggcgatggaggcgagagcggccatgagctggtactgcggctcccttctggccgtggccatcgcgctgttcctgtccgtgtccctcggcgtgcgcgccgccggcgccggcgccggcgttgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccgtggagatcgaggaggcgctggaccacctggacgacaccgagggcggcctcgacgacggcaagctccacgacgtgaagctgttcctggacactgcggatgcagacacgtggtcctgcgacgtctgctgcaagcacgcnncatccacgctcgtcaaaaccacgctgctcgccaagaccaggact

SEQ ID NO: 14719 - DNA, 285 bp, Zea mays
  Clone ID: cC-zmpo148074e09d1
cggacgcgtgggcgccgctcatcaggaggcggcggttttgtttctgctgctgcagtgattaaggtttgagggggagctcctgcatgaaattaaccacacgtccacacgtatacactacggaacaagtgtttccatcagacgaccatcagtgaaaaaaaaccatccttctctgtgtgtgtgccgtgtttttgtcatttcttctttccattgctagagaaacgggttatcttttttttcccacatttataagcggcaatacatgcgtgcacctgtagtagtgtgacc

SEQ ID NO: 14720 - DNA, 258 bp, Zea mays
  Clone ID: cC-zmpo148074e12d1
tagttcgtggatggcggcgccacgacctctcctgttttcgtcgctggtcgccatgctagcggtgggggccggtgtcgcctacgccggccacgccaagcccctgacgcctggcggtcgcgcggtacacgacaaccacggtaagttcacggccgtgccgtgtaaaccagcccacgcgaccttctacggcggacaggacgggtccggcaccacggcggtcgctttcgggaacaatgacactcgcgcgcaagggtacagcct

SEQ ID NO: 14721 - DNA, 618 bp, Zea mays
  unsure at all n locations
  Clone ID: cC-zmpo148074f01d1
cacgcgtgcgcgccacgccggaaacatactcgtccgcaagcacgactttttgtgtaggcggaggcatgtcgctggttccgatgggccatggatactgtctgccggagagcttcgaggactgcactttcgagtggctctactggcctcagtgccgggagcccttcagcgacgagacggtggagtacgtgcggtccctggacgcggaggaggacgtgactatgctgaggctccacgggtgggaggtgtcgcgcgagtgcgcgcgcacgctgcgcgtcgccaccaatgctgctgaagaagggtgtggagaggggcctcaccgccttccacatcgggagcatcatgtgcagagagaccctgaccaaggagtccgccatcgaagagatcgtccgtgaggcggcggaacggggaggaggatgcgagactgtcttcttgcaggctgtctcggagatcatggaccgccgtcttgacgacattaaagaacatgttagcctctagatatgcacatggctgacaaaataacgatgtaatcaactcaatggcttatgcanagaatgggtactattttcttccatgacttgttcgaggacaaaagtaataaatctggaaaccggctgctcg

SEQ ID NO: 14722 - DNA, 293 bp, Zea mays
  Clone ID: cC-zmpo148074f07d1
tcagcgctgccctccgcattgcggtagagcttatccagaacatcgattctggccccaagatcaaaggccggaggaggaagaaagggaggcggacatgggatgctttacatgctgatgcgcggcagatgacgacaacgttggcaggaggaagaagcatgactatccctatgttcctatacctgctcatgtttataatgatggacctagccgactaccagacccaaccactgtcatatacactggcagagctcagtcaattgcagtaccggccattcatctggaagaggtgacgg

SEQ ID NO: 14723 - DNA, 224 bp, Zea mays
  Clone ID: cC-zmpo148074f08d1
cctacgctcggtgggggctggaccagatgcccgaggttcgcatcatgggcgacctgctgatccttccggccgagtacctgctcattctgaacggcgcggccaagggctgctccggctggcgcttccgtcggcagcccgtgctgagcccgctcctgtactctccgcgccaggcgcggtgctcgcggttacgggcgcttatgccaaccaccatacttcgcttgtac

SEQ ID NO: 14724 - DNA, 219 bp, Zea mays
  Clone ID: cC-zmpo148074f09d1
agcgatggctggagcctgcgcactgctcatcgattttcgtctttgccgtctcggacctggcctcgcgggccgagttttgcttgcggtggagccgcggccctggccgagatctgcatgaagactccgtaccccgacctgtgcaccatgacggcggtgaagcacgccaacacgtacaatgtgttggacacggtgacggtgctcgatatgcaagtggacacc

SEQ ID NO: 14725 - DNA, 309 bp, Zea mays
  Clone ID: cC-zmpo148074f10d1
ggcgcctccggccgcggtcgctggcgttgccgccttcggttgcgtccgccggccgcacgaggcccgggcgggggcgctctaaggacggtagtcgctccatcatgacccactgcagcgcctcctcattgtccacctcatcggcgccgctgaggcaccgcgacgacgcgcccgagaagtatgggggtggcgtcggggctcgccatgccgtgcaggcctcagctcagcgtctacatgcttgttgcgccacctccgggcctgcggagtggccatgctcccgggcctgactgagctggagctgactcccgctag

SEQ ID NO: 14726 - DNA, 467 bp, Zea mays
  Clone ID: cC-zmpo148074g01d1
gcgacccacccgtccgcgacgagacggtgaacatcaccggtaggatggccaacttcattatgtacggcgacgggtccaaggcgtggcatggggacggtcagcaagaacgtcgtggatggcatcaggatgtggagaaccgccactttcgctgtggacggcgacagtttcatggccatgaagctgggcatccggaacaccgcgggggtggagaagcagcaagcgctggcgctgcgggtgaagggcgacaaggccatcttcttcaactgccggatcgagggcaaccaggacacgctgttcgctcaggcctaccggcagttctaccgcagctgcgtcatctccggcaccgtggacttcgtaatgggcgacacggcggccgtgttccagcgctgcctgcttgtggtgcggcagccccggcggtggcagccggccgtggtgaccgcgcaagcgccgcgagaccaccaacagac

SEQ ID NO: 14727 - DNA, 400 bp, Zea mays
  Clone ID: cC-zmpo148074g03d1
cgcccacgcgttcgccacgcgtccgctcagatctgcctttccttatccggagcgaacgaggtgagccggggcgggaggactcgccaccggccatggagcccgggctgagaatcgagtccggttccgccatccgcgtcgcggtggtccccgtgggcggcccgatcccgccgtcgcgcctgcgcgaatacgcggcgctggtggcgcgcaacgcgcgcgtctacctcgcctcggtccgcacctactacgcggagcaccagaagagcccattccagcaccagccctgggagaccggatgtcttcgtcttaaattcgtgctttcctgctgcttgccttctccctgggatgatttccagtcctctccaaggtgtttgccgtgatcggtttctgccactttccttct

SEQ ID NO: 14728 - DNA, 71 bp, Zea mays
  unsure at all n locations
  Clone ID: cC-zmpo148074g05d1
gggcgggggaacgccacacagggcggcggacncggaccacattatgtttaacagcaaggagaaccggaacg

SEQ ID NO: 14729 - DNA, 365 bp, Zea mays
  Clone ID: cC-zmpo148074g07d1
cggacctaagccaggacaaggaccatggtaatcgttttaactattctacgtagaggataaacctgccaccgcacagggctaaatttaaacttgacgggccgggcccagccgagtggagcaagaactcctgcaccaagaagtacgactgcaagatccttcccaactcgctggtgatggacttcgagaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgacatc

SEQ ID NO: 14730 - DNA, 462 bp, Zea mays
  Clone ID: cC-zmpo148074g08d1
ccaaacacactgcagccggatgaacagcaatgcaagttacttttgcggaacccgcagggatagcacaggctcggcttgcgatgctgatgccatggaccatagaatgaaccagtctaactcaacggcaaaaagctttgtcggaaaggttctcagattgatcaaacatacattctatgtggtgttctggtgtggggcactgcattttttcttcatatatcagaggcgttctgaagttcctggatgcatcgtatcttctgatcgttaatcttaagcagtctgaagtgcacactagtattacagtctcatatatgtggactgtttttcatcatgttgtttcccaggattgacgcgtgtgctgaaaatctcattgcataatcaagatgcccctcgttttcgcagacatccatgctgaaactcttgctacaccgccttaaaatctggatgctagttgatactaccttg

SEQ ID NO: 14731 - DNA, 442 bp, Zea mays
  Clone ID: cC-zmpo148074g09d1
aaaaaggaaaaggagaaaaaaaaaaaaaaaaaaacttaaactcaaaaaaaaaaaaaaaaaaaaaacaaggcaggggaaaaaccaaaaaaacccgaacggaccacaccccaaaaaaaaaaaaaaaaaaacaagaaaaaaaaaaaaaaaaaaaaaaacaaaaaaaaaaaaaaacaaaaaaacaaaaacacaaaaaaaaaaaaaaaaaaaagaacacaaaaaacacaaaaaaaaaaacaaaaaacacaacaaaaaaaaacaaaacaaacaaaaaaaaaaaacaaaacaaaaaaaaaaaaaaaaaaaaaaaaacaaaaaaacaacacaaacaagaaaacaaaaaaaaacaaaaaaaaagcaaaacaaaaaagaaaaaaagaaacaaaaaaaaaaacaacaaaaaaaaccaaacaaaaaacaaccaaaaaaaaaccacaagaacaac

SEQ ID NO: 14732 - DNA, 242 bp, Zea mays
  Clone ID: cC-zmpo148074g10d1
gagatccctaggcagcaggccatgccgtcgtcgctgtcccttccgcggagcgcaagcgagctgcccggcccggcgtcgccgttcagctccaacccggcgcaccacccagtctccattccgaccacgcccggcctctcgtcgtcgtcgtgctcgtcgttcggccgcatgcggtcaccgcccaccgactcgccgacgatcacgcccaccaagcagcagggcggcaagcccaagccgacgccggc

SEQ ID NO: 14733 - DNA, 293 bp, Zea mays
  Clone ID: cC-zmpo148074g12a1
gctggaatcctttaggagcgaacgccatcgaagcggattttcgttatagctcgtgcgccttgtcagccgggcagggattcattaccaccaccctcccgtcccataacatggtcagctgctgcttgcgcggctcgaccgttgtctcctgggcggaggctggtggcttaaggaacggcggcggcggcgtcatctcggactctccggtcgtccgcacgtactgtcttatcacgccgcacgctggtgaaaacctccagctcgcgcttttcctggtcatgccctccatggagctagga

SEQ ID NO: 14734 - DNA, 389 bp, Zea mays
  Clone ID: cC-zmpo148074g12d1
gagtcacacgagtcacggctcgtgcgtgcgtgcgtactttctttcccagggacaccgaccgccgccggggccgggagctcctcctcctcctccgaccctctcatcaaccgcacgtacacgtcctcgctccatggcgggcatgcccacggaaagcgcgacccggcgcttcgccgccgcgtgcggcgtgctcagccagtacgtccggacgaccggcgcgcccgcgatgacgccgccgccgccgttcctgaagccaccagccgccgcccaggagacgacggtcgcgccgcgcacgcagcagctgaccatcttctacggcgggagggtcggtggctgctggacgcctgcccggccgacaaggcggacgagctgatccgcctcgccgtctcggc

SEQ ID NO: 14735 - DNA, 466 bp, Zea mays
  Clone ID: cC-zmpo148074h01d1
gggggacccacgcggccgcggacgcgtggggtccggcgccgaggaggccgacattttgtttgggcggcggccctggaggagaagaggaagaggaacatggccaaactccgcggcggtgcctaggcccagcagagcagatggatcggagcaggtgcctaggcccagtctgccaggccgcgccgcgctcccgtcatcatctattcatctcctcacccagattttgcttccctcgctcgctctctcattcgtttgtgcagctgattacgctaggtctatttacgcaactgtcgtgtgtcgaattttaacagcgacggccatgcaccaaacccccaccccacacaataattttgttctttccttcttttgattcgacgacgcccgtgaatcatgcatgctttcgatcgaggcaaacctgttgtatgttgttatgggggactattcttttttttttttaaagaatttttat

SEQ ID NO: 14736 - DNA, 425 bp, Zea mays
  Clone ID: cC-zmpo148074h03d1
gtccggtctcaccctcctgcctacacaaataataaggaattttttttcccttttcctccgacatccacaggggggagtggaaatcacgtgcattcacccggcggcaataatggcctcggttccggctccggtgacgacgaccgccgacgtaatcctatgcctatgcgtcgtcctctcctgtgccgcggctgacgaccccaacctccccgactacgtcatccatggccgcgtgtactgcgacacctgccgcgccgggttcgtgaccaacgtcaccgagtacatcgcgggcgccaaggtgaggctggagtgcaggcactttggcaccggcaagctcgagcgcgccatcgacggggtcaccgacgcgaccggcacctacacgatcgagctcaaggacagccacgatgaggacatcttccaggtggtgc

SEQ ID NO: 14737 - DNA, 470 bp, Zea mays
  unsure at all n locations
  Clone ID: cC-zmpo148074h04d1
cgggcgagtgcgtgcgtgcgngcagccacagacaggcttttcttgtctccatgtctttcaccggcacgcaggagagggtcacggtttgcgacaagaccgtccacttcatcgacctcctcacggccgacggcgccatctaccataagacatgcttcaagtgcagccactgcaaaggggtcctctcgatgtgcagctactcctccatggacggcgtgctgcactgcaagacccacttcgagcagctcttcaaggagaccgggagcttctccaagaacttcacgccaggtggcaagtcatcagacaagggtgaactgacaagggccccaagcaagctgtcgtctgcattttctggtacccatgataagtgcccagcatgccagaaaacagtgtacccgctggagaagttaactctggaaggcgagtcctaccacaagagctgctttcagtgctcgcacggcggctgcatcctg

SEQ ID NO: 14738 - DNA, 336 bp, Zea mays
  unsure at all n locations
  Clone ID: cC-zmpo148074h05d1
gggcggcggnatccctgctcgtcttccttggcggccgagcttttttatctctgaccactccgcgcttcctcgtgagcaggttcgtctatattgccgtcacctggcgctcctgatgcgttaccatgggccaaacagacaggaaaatgcccagagagaggtagagacagtttggtcgtcgagtcacatggagggtgccctggtggccggggaatccttcacctgcggggtgctacatcaccggactgctgcatcgcggactgactttactaccagggctgactccattgcccgacagccaaaactcttagtcgagtctctgaaggccctctgtccctg

SEQ ID NO: 14739 - DNA, 281 bp, Zea mays
  Clone ID: cC-zmpo148074h06d1
cacccgggcgcggacgcgtgggctttagtgctgacaatactttaagctttacttattctagctatactagattgggttggagccgaagcaattcattacacatgcatgcattgtaccgtgatatctatttgctaccactaccctattatgacagtgatcttggtgccaacaatgatggtgtcatcctccttctccatcttcttcatctccatatatagctagagtgagacttcgctgttgtctaaaagatcagagctaagaaatggattgacacgttattt

SEQ ID NO: 14740 - DNA, 397 bp, Zea mays
  Clone ID: cC-zmpo148074h07d1
tctctccatctggcctttgtgactgcttttcattttctttctgactgtaatggctgcaacctaagggccggttcaactcccttgaccgagagtgtcaaatccggagagcttggacaagatttgagatcttctaggatggatctcgccaccagcttctaatcacatgtatccgacaacctttccaccatgcaccccttaggaggagttgggcaagtacatcattctctattttcaggttgcggtgggcgtaaactttactctttcctatttatttcatcggatctttgactactatggcctctaggttgtgcatatcacgtccaacattatgcttgccctattgaccttacaaattcgtgtgaagccttcatcaatgtgtggccatgtgctagatctc

SEQ ID NO: 14741 - DNA, 410 bp, Zea mays
  Clone ID: cC-zmpo148074h08d1
tcaccgtcaaggatgtcaccttcaagaacatcaccttttatttctccaccccggaggccgctagcctggtctgcactgcctaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttattctccaaataccaaccaaattcaggggtt

SEQ ID NO: 14742 - DNA, 547 bp, Zea mays
  Clone ID: cC-zmpo148074h10d1
atccaagacaaaacatggctgtgaatgtgagaaccatttggctgtcgatgcgggcacatgttgcgatggctggggcgttggtgttcttggtgagcggcgcatggcgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacgaacatgaactatgagcctatcgcggcgtaccacttcgatttagcaggcacggcgttcggcgccatggccaagaagggcgaggaggagaagctacccaaggcgggcatcatcgacatgcagttccgaagggttaagtgcaagtacgacttccaggtcac

SEQ ID NO: 14743 - DNA, 223 bp, Zea mays
  Clone ID: cC-zmpo148074h11a1
agaacattatgagtatcattagggtctttggacttacaaaaacaatagccgactcacccacttgtattgattccccgcacgcccccgctgacttcttacctataataatgaacaatgcgggggcggccgtaatcaatgaattatcaccaacggagtataaatcatgtcatgtaagggaaaaaactaaacatcggtacacacacgcatggccatggggatagat

SEQ ID NO: 14744 - DNA, 505 bp, Zea mays
  Clone ID: cC-zmpo148074h11d1
gtcgcgcaagctgctgaacaaggcgaagctgctgttttcgtctgtcaagagccacctgggcagctacgagggcgagtgccctttctactgctcctactcgggctacaacgacgagctgctgtgggccgcgacctggctgtacctggcgacgaggcggcaggtgtacgcggacttcatcgcccacgaggccatctcgtcgagcgtggccgagttcagctgggacctcaagttccccggcgcgcaggtgctgctggccgagttcaacatgacctcggcgggcggcgcgcagaacttcaagtcgcaggcggacaacttcgtgtgcgcggcgctgccggacacggcgttccaccaggtgttcatcaccccgggcggcgtgatccacctccgtgacggcgtcaactctcagttcgtgaccagcacggcgatcctgctggtggtgaacgccatcctgctgtcgttgactgcgctaaatggtgattttatgttatcatatcttgcctatata

SEQ ID NO: 14745 - DNA, 201 bp, Zea mays
  Clone ID: cC-zmpo148074h12a1
gatcctgtagagccacctcccttttcttatttttattatacttctctcagcccccccccaaccagagtcgatcttttttaaaatttaccacttaaccacctccctcattccaaacacaatatctatatacaacacaacctctcattgttaccaacaatctccaattattaaatcttcactctaaatctacacacacactat

SEQ ID NO: 14746 - DNA, 519 bp, Zea mays
  Clone ID: cC-zmpo148074h12d1
agcgcttcaacgacggcgtgcacagggcgacggcgttctcttcgcggaccctggcgcacagggcgcggggcgggtgcacttcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgccgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgcggagcgcaggtgcacatcgtgggcgcgcagatcacgctgcagaacgtgcgcaacgtgatccttcacaacctgcacgttcacgacgccgcggcgcacggcggcggcgcgatccgggactcgcagcaccactggggcgtgcgcg

SEQ ID NO: 14747 - DNA, 545 bp, Zea mays
  Clone ID: cC-zmpo14820001a02d1
cccacgcgtccggcaagattgctgatgtttggtcatgtggtgtatccctctatgtaatggctgttggtgcatatccttttgaagacccagaagagcctaagaacttccgcaagacaattcagcgcatcttgaacgttcagtacgccattccagactacgtgaacatatctccagagtgcaggcatctaatttcgaggatttttgttggtgatcctgctatgcgaataacaatcactgaaatccggaatcatagttggttcctgaagaaccttcctgctgatcttatggatgatgatagcatgagcaaccaatatgaggagcctgatcagccaatgcagaccatggatcagatcatgcagattttaacagaggccaccataccacctgcctgttctcgcagtataaatgttctagctgatggactggacatggacgacgacatggatgatcttgactccgattcggatcttgatgttgacagcagcggtgagattgtatacgcaatgtgagtaacatctcaggtaccatcttagtttctcaccagt

SEQ ID NO: 14748 - DNA, 533 bp, Zea mays
  Clone ID: cC-zmpo14820001a03d1
ataattttactaatcaaattcttgttaggatatattcctccaattcccctcctcctcccaacaaggcaacaacaatgtgttccggccgccaaacaaaacccaaaaaaaaaacacactgaacccaataatccgatcccacagaaacttttctctcggaccgttcgatcgatcgctgccgtgtcgtttgccagacaccatcagcacccaaaaccatggcctgcaacctgtctcattgcgccaccgccgccgcggcgaccgtagcgccccgcacccctcgccctgctgcgtccgcgtccgtctccttctccgcgaggaagccggcgggcggcagcctgcggctgcagcggcaggcgtgctgcgagccgtcggtggcgccgtctcgggcggtgttcgcctgccgggccgcggcgtccgggagcgcggccgacctggcctccgggggcaggaggtcgtccggcgtgccggtgttcgtcatgatgccgctggacaccgtcaaggagtgcggcaccgggctgcaccgccgcaaggtggtg

SEQ ID NO: 14749 - DNA, 429 bp, Zea mays
  Clone ID: cC-zmpo14820001a04d1
tttctttttttctttttttcttttttttctttttgtttctaggtttatggtgtctttctcttcgattgcccatcagaaagccgccgtcacgcccgtcgagctcgtacggccagcccgtcgctgccagggcgcaagcgccccgcgccggctacagttacggggacttccacccctatgatcactacgacaacctcagcagcaggaacgtgccctcccgaccgccgagctcgcacggtcacgcgccggcctgctggttacgattaaaacccctaccagcactacaagaagatgagcgccatgtacatgccgccctcccggacgacaatctcgcacgcgaacacccacgcgccagcgactgagccctaacaaaggacgtaccatcaccagcatccggaccccgggcacgggcaccaccgccggaccgggagc

SEQ ID NO: 14750 - DNA, 496 bp, Zea mays
  Clone ID: cC-zmpo14820001a05d1
aaaatggcaaaggctctcctaggtggcctatcggcgatcctcgttttggcggtggtcgtcggtgtgggcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccgccgacgacctgaagggcatgctcgagatggccggcggcgacatcaaggtgctgttcagccggtccgacgacctcgagacctggctcacgggcgtcatgacgttcatggaca

SEQ ID NO: 14751 - DNA, 557 bp, Zea mays
  Clone ID: cC-zmpo14820001a06d1
gtcgagcaccatgcgaggaaataacatgccgcggcacacgtcgttgttactttttgccttgttggcgaccctgctcagcgtcggcgacgcgttggtcgtcgacggcctgcaggtggggttctatggaaagacgtgcccggcggccgatggcgtcatcagcgacatcgtcaacaacgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtcgggctcagaaccatcgacatcgcctagtgcaccgtagagggcatgtgccccggcaaggtctcgtgcgcagacatcctggccttcgcggcgcgcgacaccgacgtggccgtggtcctcccgagatacgatgtcgcggcggggcgccgcgactgcatgcgctcgaacatggacgacctcccgggctacttccccgtgcggggcaccacgtgccgcgcctaccgagctc

SEQ ID NO: 14752 - DNA, 301 bp, Zea mays
  Clone ID: cC-zmpo14820001a10a1
ggaccaaatcaacatatttctctctaaaaatattaaatacatattgtatttcaatttatataaccgtattaacccaacacaacaaggtgcacgaagggacatgtaacataacttatttcttgggtggtgtggtgccataaaataaccatagaacaaaaattaaatattagctcgctggcacatggatcagatgagctctttcaaaatattattcctcataagaggatgatcagatgctgagggtggtcttgtaggtggtgtcggccttaaaattttcagggatgacatcatcggcgatgcg

SEQ ID NO: 14753 - DNA, 448 bp, Zea mays
  unsure at all n locations
  Clone ID: cC-zmpo14820001a11a1
aaggaaattggcgtttccttttctatatgtaaaaaagtgatacataaggcacacaaatcacactctcttacaacttgccgcctcatgtagtgtagttagttcacacatacacacgtccgtacatatgtatgaataagaatatactcacacgtgcacgtgcaaaagaaaaaacaatttcacacacgtttacagtgttttacatgtagcagtttgtctgcgcgtgtgaccttatagactgttcccttcatgcttcatcaaccatgtctctgtggcgcttaatacccttggaactgagggggaggcggagatgcgtacttgttggccatgataggtggaaggatgatgtcatcgaatgatgggggaggctgggattctgctggtggtggcaatgactgctcttctttcttcggcggngcaggggtgacaaccggaggaggtgagcttactg

SEQ ID NO: 14754 - DNA, 532 bp, Zea mays
  Clone ID: cC-zmpo14820001a12a1
gcagtacgaacagttcgttctactataacatccgagtaacgacatgcagacaagaataaccgacacccggttgccattttttcatattaataatgcgcggtcactccccccctcagctcctccgctcctgtcgcgtgcaatattatacatgtccagagatagaacgcgcacgcgtctgcttaatttctccgccaccacgaagacgaagattcctgccagcagccgtacgtacgtgacgtgctcccgagctccacgcccctcctctacaggacgatgtcgcgccgcttcttggggttggacggctccgggtctcctttcctcatcatcgccgcgaactcggtgtagttgatccgcccgtcgttgtcggcgtccacttccgccacgatctccttgatgtctcggccgtccagcaggcccttctccctcagggcttgctccagctcttccatcgtgatgtacccgctgttgtccttgtcgaagtactggaacgcggtgtagaggtgctcgtcgcgatccatccggttcatgtgca

SEQ ID NO: 14755 - DNA, 374 bp, Zea mays
  Clone ID: cC-zmpo14820001b03d1
accaatcataccaagtgcgatcacccgttgatccattttgcctttatgcctgcgtggcctccgctcttcgtcttcgggagcccgagcacgctccgggcggccccggcccaccacatcacgttggggtggagatgaaaacggtcgactgcgccgttctcgtcgccgacgcctacgtcaccgggggcctcgacgtcgaggtcccggcgcccgacccctccagagcctactcgggcagagtacccggccgtgggggccgcgctggtggaccgccgggtctcccttttcgattactacctgcggtgacacccaaggacgaccgctgggcgagggggttggctgccagcgtctgtacctgggcgaacgccgcatatata

SEQ ID NO: 14756 - DNA, 594 bp, Zea mays
  Clone ID: cC-zmpo14820001b05d1
gtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggctagctcgagcgctccatcgacggggtgaccgacgggaacggtacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtctgcatcagcgacaacctgcgccccgccacccgttcgctacctcaggacgtgccgctgccatctgcgcctgctgctcaacagttgactcggcgacgacgacgatcataatagc

SEQ ID NO: 14757 - DNA, 463 bp, Zea mays
  unsure at all n locations
  Clone ID: cC-zmpo14820001b06d1
gtgcgacaaggcgtacgtggcgaaggcggccgaggtcaccaatgtctgcagcgtcacctgcgccaaggagaagaagccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttttccaaatataccgtcgatggaactccaaatgtaatgtcacgcaaatgtgtgtttttcatcgattgaatgggtaataataaaaaggcatgctggcagttactactaaaaaataacatacttggagaannnaagccg

SEQ ID NO: 14758 - DNA, 406 bp, Zea mays
  Clone ID: cC-zmpo14820001b10a1
gggtaaaatgaattggggaaccgggcccaacaaatggcaagccatgggccagggggccacccccctctcgagggaaagaacaaataacggggccccaaatttaactggtccctcaccgattcccatttgtttaatgaaaatccgaaagggggaagggaaaaaaccaaccaaagggagaccaaggggggcccctggcgggcccaatcaaagcacaccccccccccccttgggaatgcccgggagcaataaaacaacgcaacgcaacccattttttcccccccttgggtttttcccttcgggagtccggcttctcgtccggggggtcaatgaatgtttctccccaaaaagggggccacgggggcccccacgatggggggtgccaccccggaggaacccctggtggggg

SEQ ID NO: 14759 - DNA, 514 bp, Zea mays
  Clone ID: cC-zmpo14820001b12a1
gttggtcagcaaccaatccataccatcacggggtgcaaccgaaacaagacgaagggatacgacaacaacttaagatgaaggttcaggcacacgacttgccgtgaaatttagagacagcttacaaccccatgcaggacgggaagtttgccacagagaaatcaaccatgcgcacaaagcattgcacggggtacacacatgaaatgacaacggttgttcacgattcagacatagcacgcagcaggcaggggaggataactttggtgagcgcaccagcacgggcatcagttgccaccgaacaggtagcccagggaagagccaccgccaggagcagcgtggaccttggttgaaggacggtccgtaaggaagttgccagtgttctgaccatcagccctgtggtagttattggtttggctggtaaccccagcagcaacctgcttggccgcatcagtctttgcagcagatggtttctcaacaggtggagcacttgcagctggtgccactgctggtttggggg

SEQ ID NO: 14760 - DNA, 597 bp, Zea mays
  Clone ID: cC-zmpo14820001c01d1
gaaatcatcaatggtctacggccagcaaacactgcaggttgcagttcatcaaccgatgcacctaacatcccacatgatggcacatctgtaattgaattgttgtctgatagcatgaaccaactgtccattaagaatgagaatcacttggactttcttttagatgaaaaccacagcctgccagagattgatagtgatagtgttggatcacgattgcaggataaaagaagtaggcgcaatgaggagtcattttcattcacatgctctaacagagaaagctggggcagatgttcatctttaggagcagccagtgatgaatcattctcaggcgataataatgataagcagaatttgacagtcaaggctttggctacgcctgtaagacaaaaccagaggcacagccagaggaaaccgattgagaaagctaagcagaagaagattcaagccctatggaagaagattaagcgcgaaaaggtggagatgggggacagcctatcttcgcgtttgaagatgtgcctagggcaatctccgcagcacaagaggaatagatcgtctggaaccattacaacttcatagctctgacaactctactgaaccact

SEQ ID NO: 14761 - DNA, 210 bp, Zea mays
  Clone ID: cC-zmpo14820001c02d1
gtgcgacccacgccgtccgctgcaagtccatgcaaaggaaaatatctgccatcctacaatggttggctttccgatgcccaccgacagatattgaatgaaagacacgcgcggatggatgatatatgactggatgaagagagatagccatctgctaatgctaacttgactgcactgtcatattgtgctgatgccctgatgatgcatatgcgc

SEQ ID NO: 14762 - DNA, 532 bp, Zea mays
  Clone ID: cC-zmpo14820001c03d1
gggtgcgaccacgcgtccgctaccctcgtcgtcatctcactcaccccgccttcacgcctccctctccaaataaggtcccgcccttttccgacattcacaggggggacaggaaatcagcggccatggcctcgattccggcgacgaccttcgccgtcatcttatccgtcctcttctgtgccgcggctggcaccgtcgtcgacaacgacctccccgactacgtcatccagggccgcgtctattgcgacacctgccgcgccgggttcgtgaccaatgtcaccgagtacatcgcgggcgccaaggtgaggctggagtgcaagcacttctgcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcatgcggacagggaccgcgccggcgtcctgctcaccaggtacgtcggcttcagcgacaacctgcgccc

SEQ ID NO: 14763 - DNA, 642 bp, Zea mays
  unsure at all n locations
  Clone ID: cC-zmpo14820001c04d1
ggaattctctcgggtcgatcccacgccgtccagctcatgctggcttcctatgctggagggtggctctctatccgtttcgagtatcgcagtcaatcccggcagctcttcnctcgccaaagcggcgaggagggatcgtgcaccgctccgctccctctgatccctgacgacacaggtgagctcgccgcgccagataccctgctgagcaatcggtttcatggtgctacaatcctgttcaagagcaatctgcgaggaccttcgcgatatactgcaagactggccttcttgtcgctgagcagggcgttgtcgggcagagcgggcaggctatctccatcatcggtggacctctcgccgcggtggtctcgaccccattccgcttggttaccacgaacatctatgggatggcggtgatggccgtcggggtgtactgcgcgagcaggtatgcagctgatattggcaaccgccgtgatgtggtgaaaatggaagtcgaggacctgacggccggactggccagcggcaagatatgtgctgtggagaacatcgcccagctggtggctccggaggcagaaggcccggccgatgccacggccacggccacgctggctgcttaacggaccattgtgccattattgctgcgacagagat

SEQ ID NO: 14764 - DNA, 77 bp, Zea mays
  Clone ID: cC-zmpo14820001c05d1
ccccctcgcttatactaactaacaaaaaaaaaattaatttaaaaaaaaaaaaaaaaaaagggggtctggttttttcc

SEQ ID NO: 14765 - DNA, 480 bp, Zea mays
  Clone ID: cC-zmpo14820001c06d1
acccacccgtccgcgcccctgctacttaaacacgggcgtgatggtcatggtcgtggctcgctggcggcggggagggtacacccggcgggtggaggagtggatggcggtgcagaagcggaagcggatctaccacctggggtcgctgcctccgttcctgctggtgctcgccggcgacatcaggcccgtggaccaccgttggaaccagcacggcctaggcggcgacaacgtctagggcaggtgccggagcctgcacccgggccccatcagcctgctgcactggagcggcaagggcaagccctggctgcgcctcgactcccggatgccctgcaccgtcgactacctctgggcgccctacgacctctacaaggccgcggccaccgcgctggaggagttgtagtgacccgtccgtccatgctaagcaagcttcactggaatgcggaggtcttggcggccatgcatgggtcatcgatcgagatcgac

SEQ ID NO: 14766 - DNA, 392 bp, Zea mays
  Clone ID: cC-zmpo14820001c10a1
ggcccatcaaaataacaatctatttctatagataatatatggggggataaaaaagcataccgggaccggcccgacaatttgtttccccacccagccccccatgggtgggtcccaatcgatgtctccgggcagatcatgggcccatgggacagcagccgcctcagcaatgaaaaatgaaagatgacgggggggaacaagccgaggcccaagcccaccactaccgaaattactgggcgggtctgggcgaccccttggagcacttggcctgcaccgcaagcgtggcggtggtgcccgggcaattggcgtcccccccgtaaacctcgggggacacgggcagggtgcaaatgcgcttgccgagggaggcctttttcaccagctccttggggcccggg

SEQ ID NO: 14767 - DNA, 453 bp, Zea mays
  Clone ID: cC-zmpo14820001c11a1
cggataatatatattcggaggcatgcaataccatgcatgtgggtaggcttggccacactttgcgtatctatatataattatggcaagaacagtagtagcctgacacacgatcgagcccttaattagttctcggttttgaccaccttgcttggctggacgcacgcttttaagttcaaccggacaacggccccggggccggcgccggcgccggcgcattggattccgtatcaaccagcttcatgtccacgtaaacgacgcggccttcggactcggggctgctgccgtcgttggagccgtcaacgctgccgaggacgtggatgtctttctggtgggcggaggccgtggtggcaaggtggcaaatgaacaagcccactatggccacgctcagcaaggccacgctgatcttgttgccggacgacatcgcgtctccaaaaggcacacggttgcttgctt

SEQ ID NO: 14768 - DNA, 447 bp, Zea mays
  Clone ID: cC-zmpo14820001c12a1
gcaatattggcttcgaaatggcactgcctacacggagtgactgtgacaccgtactcaccgagcagctgtactcaccgagcactgtctagagtagtttacatggagtaagagaacactggcaccggcggtgcaaaaaacggcacacgggtacatgcaaaggccgccggtcgatgatgcaagacaaacagctagcactgctctgtcggttccggggcatgcatggcgatcgcgcgagcggatgcccgtcttcctcttcagagagctcgcgccctgacaatgtccatgctcatctcgctggggtcggtggcctgcagctccagctggatgccctccagctccctcttgaaccggtccttggagctcgcgtacagcatcttgctcctgaccctcgaggtgtccggggaccaggagatgaacaagatcttgctcttctggcagttctcgtcg

SEQ ID NO: 14769 - DNA, 60 bp, Zea mays
  Clone ID: cC-zmpo14820001d01d1
atcccacccgtccggtgtgtcacctgaacacttgtttgtactgatttggatgctgccttt

SEQ ID NO: 14770 - DNA, 254 bp, Zea mays
  Clone ID: cC-zmpo14820001d02d1
gaattgttgggtgcgacccacccgtccggtaacgagcagtggaaaactagatccttctacgacattcttgacttgggccagatcgtcgccgtcgtggagtatttgccacgtgtcacctcagaagtttttttttccagttgtttttgaaaactcactctggagagcacgacaaagtgaatgctgtggagatttggcttgaaaataagcataaccatgtgtgaacaccagcttgtgttgaattgtcttttcttgtc

SEQ ID NO: 14771 - DNA, 602 bp, Zea mays
  Clone ID: cC-zmpo14820001d03d1
gcgggagaggccgaggaagcacaagaagaggggcccgtgccggtcgacgaaccctatcgacaagtgctggcgctggcgcagagactgggcgacggaccggcagcgcctggcccgttgcgccagaggcttcgggcacgcgaccaccggcggcctcggcggcaagatctacgtggtgaccgaccccaccgacctcgacgtggtgaacccgcgccccggcacgctgcgctggggcgtcatccagcccggcccgctgtggatcatcttcgcgcggtccatgatcatccagctctcgcaggagctgctcatgagcagcgacaagaccatcgacgggcgcggcgcgcaggtgcacatcgccaacggcgccgggatcacggtgcagctggcgcaaaacgtcatcatccacaacctgcacgtgcacgacgtctagcacaccatgggcggcctcatgcgcgactcccccacgcacatcggctcccgcaccagggccgacggcgacggcatctccctcttctgcgccaccaacgtctggatcgaccacatctccatgtccaactgcgaggacggcctcatcgacgtcgtgcagagctccacggggatcacca

SEQ ID NO: 14772 - DNA, 478 bp, Zea mays
  Clone ID: cC-zmpo14820001d05d1
gtggacccacccgtccgcgctgacacccgcggcctcgcactccacgtgaggctccgcgcccttcgtctatacctgggcgatcgcgacatcggggaggtgtttgtgcccatcgacgacctcctggccggcgccgacaagggtggcgatccgaggcccgtgagctaccaggtgcgcaagccgcactctggccgcgcccacggcgtcctctacttctgctataagttcaccgaggtccccgccgtctcttgtgtctcggaaccggaaagcaaactagtccagtacgccatgaagtacgtgcaggactccaagaacacgacggacaagactatggtgccgcccaccgtgtacccaccgccgcaggccatggcgtccggatacccgccgcaacaatattgttcgccggacgcggcgtacccgcggcagccttacgggtaccctgctccgccaccgtacgggtacaatgctgcttccccacaac

SEQ ID NO: 14773 - DNA, 616 bp, Zea mays
  Clone ID: cC-zmpo14820001d06d1
attcttttttccacccacgcgtccggaagagcatagactccctccacgtcgatggctacgccttcttcgtcgtcgggatgggccccgggaagtggtcgccggaggtgatgaagacttacaacctgctggacacggtgagccggcacacgatccaggtgtacccgcggtcatggacggcattcatgctgacgttcgacatcgcgggcatgtggagcgtgcattccaacatctgggagcggttctacctcggggagcagttctacatcagcgtcgtctcgccggcgcgatcactgcgcgacgagtacaacatgcccgacaacgccctccgctgcggcaaggtcgtggggctgccgctgccgccgttctacgcccccgcgcgctaagacgacgaatgcctcgttttctcctcgtggtctgaccatccattcctaactcaaaagaacaaattcgaaagaagcgttgtgaaggggaacaaatgaatggatatatgtaatcttgagaggcatgccctttcaatcactgtactggggttctccaaaaaatcattgtaatggaagttatatttataactttttctcaccatttatttaattaatattgttttacccttctttta

SEQ ID NO: 14774 - DNA, 455 bp, Zea mays
  Clone ID: cC-zmpo14820001d10a1
ggaaacaaaattaactcagattcttgtgtacgtttttaaaatttatgggcaaatggagggattctgcaataacaccttaaaactagtgccagatcgacagaatcaagattgcattgtactttggagttgtcttccctcttggagtttggggagagcgttatactatacgctggggtttggggaaagggtgcattttcatggcagccttgttaccatccatccatcatctatttgccgatttgctttatctgcagagagcaaggatcccgcaaaagttcctcggcctagtaaccgccttccactctcagaattcgtcggcgtggtcctcggcagctcacttcctcctgctggtggtgatggtgaggcgctcgaagctgcggaacgtcctgttgtcccgcgaggcggagcctcccctcccggccgcgttccgggccacggtggagcgcggggaccac

SEQ ID NO: 14775 - DNA, 423 bp, Zea mays
  Clone ID: cC-zmpo14820001d11a1
ggaaaaaaacacgccctttgggcctaattggggggggcattttttttccatgggcctgaaccggccaaattttttttatatttataggggggggaccccccgctccatcaccggggtcctttttcacctggggtcacgtcccgtcccccaagcaacggaattaattttttgaaacaaagaaaaaaccccccctcgtgccccggtgataaaattaaaacagggcccctccgtccggggaacgaaatgcgggggcgaaaattagatttccctttccctttttcccggccttgggggcaaccttttgcgggggggggaaggaaacacccaaacctcttggacaccaaaggggtctttttaggggggcgcctaaagggggggccctccgggggggacgggacccccggaacaaccggaaccccggac

SEQ ID NO: 14776 - DNA, 487 bp, Zea mays
  Clone ID: cC-zmpo14820001d12a1
aataaaagatgtatataattaataattgacaaaagagaagagaaaaaagattgggaaatcgaatactagagtacagtggacatattagtgggctgggccgggggtgactcgctgaagtgcaggtccagtccaactgatgttaggtggtagtagtgagtgagtgaagcaggctggaagatgatcagtgtgtcctgcctttttgctcctgcggcagcaatcccgggatgaacggcaccccgaacttggggatgaactgctgcccctggatgaaggtctccacggtgaactccttctgcgcctcctcgtaggtgacggtcttgatgcctccccacttggcgcgcttgctcatgtcggcgccgtcgccgcggttgtccacctccgcgtagaagagcgtctcgaggccgaagtcgccgttccactcgagccagcccttggggtcgatgaagccgccaatgtcgctctggatgtagatcgtccgggagtactc

SEQ ID NO: 14777 - DNA, 606 bp, Zea mays
  Clone ID: cC-zmpo14820001e01d1
tgggtcgtctccacgcgtccgcggacgcgtggggcagtcaactcgctgctgggggcgggatcccggccgagctccatgcgaggaaataacatgccgcggcacaggtcgccgttactttttgccttgttggcgaccctgctcagcgtcggcgacgcgttggtcgtcgacggcctgcaggtggggttctatggaaagacgtgcccggcggccgaaggcgtcatcagcgacatcgtcaacaacgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatcctggccttcgcggcgcgcgacgccgccgtggccgcgggcctcccgagatactatgtcgcggcggggcgccccgacggcatgcgctcgaacatggacgacctcccgggcatcttccccgtgccgggccaccacgtg

SEQ ID NO: 14778 - DNA, 583 bp, Zea mays
  unsure at all n locations
  Clone ID: cC-zmpo14820001e02d1
aacacacacatccgtgaaagaaacaagcacatagaatctaatacttcgctagctcgccaccaacaatggcctcaaggtactctatcctgcttgccacaacgacactggctatgttgctcgcattcggttcgtgcaccaccccactcaccttccaggtcggcacgggctccaagcctggccacctggttctcacccctaacattgccaccatctctgacgtggagatctaggagcatggcggcgacgatttctcctttacactcaaggagggcccagctggcacttggacgctcgacaccattgccccgctcaagtaccccctctgcatccgctttgctaccaattccggcggctaccgcatcgccgatgatgtcatccccgccgatttcaaggccggcaccacctacaagaccactctcagcatctgatgagcctgtgatgagcgatgacaaataatatttccagtccacgtgtcaacgagccaatatttaattnttttcctatgtttattttgtggcacaacaccatctcttcatgtgcctttgtgcgctggattgattttattacatgaattgaatacact

SEQ ID NO: 14779 - DNA, 424 bp, Zea mays
  Clone ID: cC-zmpo14820001e04d1
cgctcaaggagtgcggcgccctcctcgagaagtacgatctcaaggacgcctccgagacgccatgatcgtcctccgtcctgtgcatgcctgcatccattgctgccctgcccgctcgcccaagaattgaagatggtagctgccttccgcgttttttgtattgtgtatgtctatgcactgcattcgagggcagcgataatgggcctggcctcgtaagcaaacgttcgatccgcttcttttgatgggcctaaatctgcatgcatgcagatgtactgctacttctgctcttttatattgcttttttttttaattttattaacttctcgttttctccctcatccctcgtcgaggaggaagggtatccgttttgtttttatgatgcaaaggtatccgttttgtttgtatagcacagtatctcatctatttg

SEQ ID NO: 14780 - DNA, 506 bp, Zea mays
  unsure at all n locations
  Clone ID: cC-zmpo14820001e05d1
ggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcnttanataaaaaaaaaaattttataataaaaaaataataaaaaaaaaataaaaatattatttttatat

SEQ ID NO: 14781 - DNA, 546 bp, Zea mays
  Clone ID: cC-zmpo14820001e10a1
ggtcgtaaatcttggggtgattattgtttgtgggtagtgttacaagaatccgggcaaccccagtctgtagctttctgcatttatgcatcatagagatttgactattaaattaaacagctgttctggtgcagagaagaagggactgtgatctgtatctatggccaaaacctcgctgggtggccacttcttgatcatggaatcttgctgttgaggatccagcatgtggtcacgctgcatctttatgaaaattcgtttgattcggttcaatctttcatcatctccttcgaagcttgctgtactgatagctgttgcaggccacggacgcatcagcattgaagcaagtactgattcctcttcagggctttgttgtgatagtcgatcacgctggaattctggcctcaaggaaatggttgttggaggatcatctgctcccgcaccaagtgtcaactcaatctcgttctcaggcaaagttggtaacccatctttcttatcttcatcagcttgaaatccaaatggtagcattgtagctgccacaaaaaatgcttg

SEQ ID NO: 14782 - DNA, 405 bp, Zea mays
  Clone ID: cC-zmpo14820001e11a1
gggcaaaaccggacgggggagggggcccaccccaagggggcggggggaccccaggggtaaccccccccccgggggggaaaaccccaggggggggccccaattccttaaattagggggaagggggggccccaaaaaaaggggccccagggggggggaaaaaaaaaaccccccccccccctggaaggcccccccccctgtcaccccccccccccctttgttttttccccggcccccggggaccccccccgggccggctccctttttttttttggccaaaaaggggggccccgcccccccccgggccgcgggggggtttgccccccccccttaaggggtttggacccccaagacccccgcccggggggtttaaaagcccaaccccccttgggggtttcagggtaaccc

SEQ ID NO: 14783 - DNA, 656 bp, Zea mays
  unsure at all n locations
  Clone ID: cC-zmpo14820001f01d1
gggtcatccacgcgtccgctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccgtggacgacgactaggggggatacgcgggtgatgatccaagaggctgcggcctcgtataccaactttcggagatcaaactaacatgccgaaaagtagtctgagctcaattcgcgtaagatcaagcggcggtcgatccatgtatacgtatatgaactcagaaagggcacatgcatgcattggggagtgtcacgtacattagcattctcaagagtgggtgtgcacgcacaaacgccattcngttctctggttcttctctaaactggtatactgagctgcattttttcaccggtatcttgtcaagattcatatatatata

SEQ ID NO: 14784 - DNA, 193 bp, Zea mays
  Clone ID: cC-zmpo14820001f02d1
gtgacagtaagatagagcttcctccctttctctaattttttttttttttttttatttatctccctctttgggctttgggttattttttccaaaaaaaaccaaccctttcctttttttttcaattattagaccctgttccctccaaaacctttatacaaaccatcccctttttatttttccctctcctccctaa

SEQ ID NO: 14785 - DNA, 566 bp, Zea mays
  Clone ID: cC-zmpo14820001f03d1
acgcctccagctacctcaccttcgggcccaacccggcggtgatgggttcgggcaccatggagacggacatcctgtacaacgtggacgtgaagcctgcatacggggccaaggtgacgggcgtcttggtgggcggggagcggctggacatcccggacgaggtgtgggacgccgagaggtttgtgggcggcggtgtcatcctagacacgagcacgtcggtgacgtcgctggtgccggaggcgtacgcgccggtgacggcggcgctggacaggcacctgtcgcacctgccgcgggtgtacgagctggagggcttcgagtactgctacaagtggaccttcaccggcgacggcgtggacccggcgcacaacgtgacgatacccagcttcacggtggaaatggcaggcggcgcgaggctggagccggaagccaagagcgtggtgatgccggaggtggagccaggggtggcgtgcctggccttcaagaagcttgtacggtgagggcccgggatattgggcaacgtgttcatgcaggagtacatctgggagattgaccacggcgacggcaagatc

SEQ ID NO: 14786 - DNA, 485 bp, Zea mays
  Clone ID: cC-zmpo14820001f04d1
cccacgcgtccggtgatttgaaataattgggaataaattgttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgcttgccatgcatcgacaacctattcttaataacgttcattatctcgttcttatttatgacgaatgtcatgtatgttctggtgactgtcatgtatattctgatgactgccatgtatcttgttcatgtatgctcaaggctcattatcttgttcatgt

SEQ ID NO: 14787 - DNA, 489 bp, Zea mays
  unsure at all n locations
  Clone ID: cC-zmpo14820001f05d1
ctgcggctgagccggcgggagcacatggaccaccaccacaaggtggagtcggaggacacactgtggaagaagggcatcatcctcggggagaagtgcaggatcccgggcgagagggaggcggagaccggcgagcccgtcgaccccgccgacgagatcgccgccggcagcttccgccggtccagctactcccggcccgtgtcgcggtcgagctcgttcgccgtgtaccaccaccaacagcagcagcaccagcacgacaccccggccgccttgcatgcctcggattcttgacagcccctcgagacccgagtataaatgtataatactattacgtacgtgtgtaggcgtcgaaggggagaaggatgctactatgcctacgggatgtaatgtgcattcaaattcagatgtaattgctctataattctactaggtgtgtgcccgtgcgttgcaacgggaacatatttntnaaaaaaattcccccttttatttata

SEQ ID NO: 14788 - DNA, 422 bp, Zea mays
  Clone ID: cC-zmpo14820001f10a1
ggggaacccgccccccccccccccggggaaaccagaaccccccccttgggggtattgccccggcccaaaaccccccgggccccagaacccagggggcccccccccaaaccggttgaggggaaacccccggccccaacccagggcaaaaaacctccggcccccggggggccccccggacaacccacccctggggggggggggcccccccccaaaaaaagccccaaaacccccggtttttccccggggaaaccccgggggccggccccttcccccgggggcgggtctttaaaagggggggccccccctggcccccggggggggagcccctccccccctcggtgcccccggggggggaaaaaaggcgcccccccgggaccgggtccttaaaccagaggccttttccccccgggtccccccggggg

SEQ ID NO: 14789 - DNA, 120 bp, Zea mays
  Clone ID: cC-zmpo14820001f11a1
gtgaacaaaaaaaatttgactttcatatttttaaaatgtgataccgggccgagaaatggttcccctagctgaccaggaacgagaaattggccgaggaaccagacttttcggtcggtaatt

SEQ ID NO: 14790 - DNA, 552 bp, Zea mays
  Clone ID: cC-zmpo14820001f12a1
aaacacatgtgaaactttgtttatattactatagaaaaaaagtcgagtacatgcatattatgtattttctgctgggagtaaaaggtgttgtaaacccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggcggagacgggggcggggcttggagcaggtgactcggacacggtatccttggccaccttacccttacccaccaccactgcttcgacgggcttgcgcgggatcatgttggaatcctcatgggttgccgctgatggcttgatcttgcgcttaccacccttgccgcggcggccgggcgccgcgacggtggagggcaacgcggcccggcaaatgggctcgctgatctccatgatggacacagagtacg

SEQ ID NO: 14791 - DNA, 301 bp, Zea mays
  Clone ID: cC-zmpo14820001g01d1
cgcatcgccgatgatgtcatccctgaaaattttaaggccgacaccacctactagaccaccctcagcatctgatcatcctcttatgaggaataatattttgaaagagctcatctgatccatgtgccagcgagctaatatttaatttttgttctatggttattttatggcaccacaccacccaagaaataagttatgttacatgtcccttcgtgcaccttgttgtgttgggttaatacggttatataaattgaaatacaatatgtatttaatatttttagagagaaatatgttgatttggtcc

SEQ ID NO: 14792 - DNA, 215 bp, Zea mays
  Clone ID: cC-zmpo14820001g02d1
ctaaaaacaatatttcggcggggacctggttcctttttacaaaattctacggctccgggtttacggaaaaactacattccacgagattgtaaataaacaggaataaattagcgccgtgtgcatgcaggcttacgtgccctggggtggccgacatgatacataacatctaatctattattttacgcgaaaacgcaactttttgtggacacgacttc

SEQ ID NO: 14793 - DNA, 624 bp, Zea mays
  Clone ID: cC-zmpo14820001g03d1
gaaactggaagcattgattgctgctgttaacagcagtgatagctttcacattgttcatatccctcctggtgaaaatgccctctctgatgtcctcctaagcactcctatatttactggtgaagaaggtggaagcggttttgctgcttccgcagcagctgccgcagctactggagcatctggatttgaatttggtgtggacccaaacgtagatccagaattggcacttgccctgcggttgtctatggaagaagagcgggcaaggcaagaggctattgcaaaaaaggctgctgaagatacttctaatacagaacataacaatgtcccaagctcaaacagtgattctgttatggctgaaggagaacctgcctcaaatgctgctgctggtgacaaagaacaaccaaaggatgatgacgatctactacagcaggcacttgcaatgtcaatggagggtggtgcttcaggatctgcagctgtgactgactctgctatggcagaagctggtgcagttgaccctgacttggcattggctcttatatgtctgtccaggatgcatacatgtccagtgacactgatatgagtataggtgttgaagacagaacgtttgtgtcatctatccttaattcg

SEQ ID NO: 14794 - DNA, 619 bp, Zea mays
  Clone ID: cC-zmpo14820001g04d1
gaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggag

SEQ ID NO: 14795 - DNA, 587 bp, Zea mays
  Clone ID: cC-zmpo14820001g05d1
cacgtcgacggcgtcgcgcccggacttctacgacttcctcgaccgcatgcgccgccccgccgccgccgacctcttccgctccatcaagagcttcctcgtctccttctccttccacgcgcccaacgccgaggaggacggcagcaaggtccaggccttcctcgcggagatggagaacgccattagggaccacccgctctgggccaacgccaccgaccaggagatcgaccacgcgctcgagggcctggagaagtatgtcatcaccaaattgttcgaccacacgtttgggacttccactgaggatgccgttaccgacatggacatctcggagaagattggtctcttgcagcagtttgttaagcctcatcacttggatatacccaaggtcctgcataacgaggcatcgtggctgcttgcagtgaaagagctgcagaagattaattcctttaaagcaccacgtgagaagcttctgtgcatcatgagctgctgtcaagtcatcaaataactgcttctgaacatatcaatgtcaaatgatcgaacattatctggggctgatgagttccctcctattcttatctatggtactatca

SEQ ID NO: 14796 - DNA, 478 bp, Zea mays
  Clone ID: cC-zmpo14820001g09a1
ctaataggaaatcgatatattccccggacaaactccggcgatggccggagcctgaaacgtgacaaaacatctttgtcctcccctccctgctttccctcccggcttggtcacaatacaatctcatctacgccggagctgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggcttccgttcggtcccgtcccggcccggccggtcagctccgcagcgcgacggcggcctcgtgcaccagcgacccggtggcctgcgcgacgccgtgcgcctcccgctccgcggtctcccggcacgacccggcgccgttcatgcggcgcacgaaggcggcgaagcgccgccagttgtccgggtggaagaggtcgggccccatg

SEQ ID NO: 14797 - DNA, 467 bp, Zea mays
  Clone ID: cC-zmpo14820001g11a1
ccccccaacggcataaaaaatactcagggggggaggggaaaaaaaccaaggggaccggtgtaaggggggaaaaaaccccccccgagggggaaaacccgggggggccgggggcagcccaaaaaaggggggggaaaaaagaaacaaaaaaccccgggggagggggggaaaaaaataaaaacccccccccacccctgcaaaaaagggggaaaagggcacctccaaaaagagggcggcgggggggggacctaaaaaaaaccgcccggggcggggaaagccaccagaaggggcaataagggcggcgtgggggcccccacggggcgccccagaaaagggcgcccggggggctaactattggaaggggcaaaaaaggggggccggggggccaaggggggggagggcccacagggaggaaaagagggaaagccctggaagggccccaagcccacaaccccacccaataaccccca

SEQ ID NO: 14798 - DNA, 395 bp, Zea mays
  Clone ID: cC-zmpo14820001g12a1
aaaaaaaaaaaaagcaattttaaagagccgaagtggcagttcctttgcctgcatgccgatttaggcccatcaaaaaaagcggatcgaacgtttgcttacgaggccaggcccattatcggtgcccttgaatgcggggcttttacctacccaattcaaaaaacgcgggggggagctaccatttttaatttttgggcgagcgggcagggcaacaatggatgccggcatgcccaggacgggggaccaccatggggtctcggaggcgcccttgaaaacggacttctggaggggggcgccgcactccttgagcgggtccttgcggaaaaaggcaaaggggttggcgtaacggaccccctgcttcttgatgcccttgttggaggtgaacgggacccgggccc

SEQ ID NO: 14799 - DNA, 542 bp, Zea mays
  Clone ID: cC-zmpo14820001h01d1
ccacgcgtccgagcagacgcagcaggtggtggtggacaggctggggcagccgggctacacctacgacgacttcaccggctccatgcccgagagcgagtgccgctacgccgtcttcgatttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtcagggcgcgagctctctgaagaggaagacgcgcatccgctcgcgcgatcgccatgcatgccccggaaccgacagagcagtgctagctgtttgtcttgcatcatcgaccggcggcctctgcatgtacccgtgtgccgttttttgcaccgccggtgccagtgttctcttactccatgttaactactctagacagtgctcggtgagtacagctgctcggtgagtaccgtgtcacagtca

SEQ ID NO: 14800 - DNA, 186 bp, Zea mays
  Clone ID: cC-zmpo14820001h02d1
gctgcgcagggagctgtcgacggcgtcccgcgccgagtttctccggtgaccgggcttctaggtgctttttagagtctagaagcggcggaactcgggtttctgtgcctactgcggaaggattctcaagcgttctctggactctggtggaggagaaagaaacaccgctgatgtgaaccatgtgatgtc

SEQ ID NO: 14801 - DNA, 334 bp, Zea mays
  Clone ID: cC-zmpo14820001h03d1
gcagatcaagaaggacatcaaggagttcaaggaaaaatacaaggtggacaaggtagtccctcccccggggtcctgtgtaaattctgtatccatcccttcctttacccttcttcattcttcacctaaaattacataaatctagtccttcctcccatattgactcactaaaccaccttctgtgatctgtttctatggccaaaacctctctgtgcggccacttcttttcatggaaacttgaagttgacgacccaacatctagacacacttgctgttattcaaaaaaactccccccacccctactttttccactccccctatatttctttctccactt

SEQ ID NO: 14802 - DNA, 549 bp, Zea mays
  Clone ID: cC-zmpo14820001h04d1
cgacggggccaaggccgacatctggtcctgcggcgtcatcctcttcgtgctcctcgccggctacctcccgttccaggacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtcgagcacccctggttcaagatggggtacaggccggccgtcatgctggcacagccgcacggctccagcagcctcaaggatgtccaggtcgccttcagcaacgccgaccacaaggacagcagcagcaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccataagccggcgtcggcgatagtgtcaaagctggagcagatcgctgagacagagcgcttcat

SEQ ID NO: 14803 - DNA, 634 bp, Zea mays
  Clone ID: cC-zmpo14820001h05d1
ctgccatcctctccatcacgaagatggcgttcatcagcaatgtctcagtgaaggcggcgggcgtggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcatggcgtggaagaacgcgtgcgaggcgacgggggtacagaagatcgtcatcccgccgggcaactacctgacgggcgggctggagctgatgggcccctgctagtcctccatcatcatccgtctcgacggcaacctgctcggcaccggcgacctcagcgcgtaccaaaggaactggatcgagatcgagaacgtcgagaacctgtccatcaacggccacggcaccatcgactggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcatcatcttcgagtgcaagtacgtgctgatcgacaaagtgac

SEQ ID NO: 14804 - DNA, 108 bp, Zea mays
  Clone ID: cC-zmpo14820001h09a1
gcaatcttcacttctgtagaatcattattcatgtgcgacaacggtcttgtcaatagttttacgaccatcctgtaccttctctgggggccctggcccctcattctgttc

SEQ ID NO: 14805 - DNA, 260 bp, Zea mays
  Clone ID: cC-zmpo14820001h11a1
aaggactgcagaaacgcttttcatgccctgcattttatcaaaagtagttttgtttctcgtagccatgagacccatcaaatcaaattaatgaagcacccatcaacaattagcaagaccgatgaactagcaaggcttcttgcagaagcacttgcgcatggccacgtcccgcttgcactcgccaccgggaaagctctccttcatgcacacctcggcgcatctgtcgctgttgaagcagaagccctcgaactggagactcggcg

SEQ ID NO: 14806 - DNA, 306 bp, Zea mays
  Clone ID: cC-zmpo14820001h12a1
ggggggaaaaaaaaatgggaaatgggctcccgtctcattccaaatgccgggcttttgcttcccggaaaaccagggccccaaaaccccaaaccggtccccacccccaagcaagggttcccccccccccgggccttccggagcccctgccccccttccccgtgccagtgccacggccggggctttttcaaagggcccgcgacttgaccatgtccctgccccttttcctcggggcggttgcttgtagccccccccgaatgccctcccgctcccttttgaacccggccttggagctcgcgtacagaattt

SEQ ID NO: 14807 - DNA, 72 bp, Zea mays
  Clone ID: cC-zmpo14820002a01d1
cgtcccatcgcgtccgcttaattattttcttttgaagaaaaataaaaaaaaaaaaataaaaaattttaattt

SEQ ID NO: 14808 - DNA, 570 bp, Zea mays
  Clone ID: cC-zmpo14820002a02d1
ccacgcgtccggaagagagaaacgcgagcaaccagcgatcgccccatggccgccatggctcgttccgtctccctcgtcgtggcgccccttctgctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctc

SEQ ID NO: 14809 - DNA, 575 bp, Zea mays
  Clone ID: cC-zmpo14820002a03d1
gtcgatcccacgcgtccgcccacctccgcgatgccctcagcccccttccgctctcagatttcggcatctcccggactccctggcgtccttccctcctcccgcgcagatgctttgcgccggcggcgaaccggatccggccgctcgcgccttctgcgacgcaccggccttgcgcgcggatgcggtggccaacgggacgcccagcccgcaggatcacgccgagaaggatccgcccaatgtgctagacgttgctatcgttggtggaggcatgatgggcttggctgttgcttgcgcaatgtgtagggattgctgttcgtgtgctctgacctgttttaagccaatatgccgttaacgaaacaccttagagtcgctattatcgatagcaatccagcgctgaagtcaagaagttacctgggcaaaaacagtatacccgattctagggtcagcaccgttacccctgcaaccatttccttcttcaagggtgtcatatcgccttcaaggggttgcagcagcccccaactgacttttttctatgctctgctagcgggagatatacagtgaaatctcttatagagaag

SEQ ID NO: 14810 - DNA, 456 bp, Zea mays
  Clone ID: cC-zmpo14820002a04a1
aaccaaacagaagttgtgttcatgcaacttataaaaacagcaaaccaaacaagggctatgggcatcctggttaattgcaatcaaagcaaccaaacaagagctctcaatgtacttgcacaagcctacacaggctaggcgcagcttgcatttgagctgagaaccagtcttttagcatccaacaaccaaacacattgtataactacagagatgggtcaatggggggtctagaagcatgcgagcgccttcaggcaacccttggcgctgcccttagcgttcttgcatacagccatggtcttgttgttggtgccactgtagttgatgttgacgtcgtccatggtgacaccggtgcatgggatcttggcggagcaaaacaagttgacggcctccggggtggaggaagtgcccgtgatgttcttgaaggtgacctccttgacggtgaccttggaggcaccattg

SEQ ID NO: 14811 - DNA, 585 bp, Zea mays
  Clone ID: cC-zmpo14820002a04d1
gcgtccgaacaagatggcatgtatagacaatgcaatgagagccttgttccttctagcgctcttctgcaccgtgcatggtgagaaggcaaagtcaaaggacaacgattcaaaagcgtccgggcccggtgggtccttcgacatcaccaagttgggcgcctctggcaatgggcaagacggatagcacgaaggctgtgcaggaggcgtgggcatcggcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaagatccttcccaactcgctggtgatggacttcgtgaacaacgggaggtgtccgggatcacgctgctcatctccagttcttcacatgacatgtacagtgc

SEQ ID NO: 14812 - DNA, 514 bp, Zea mays
  Clone ID: cC-zmpo14820002a05a1
gggtgacagcagcaagtgaatcaagcactctgatacattttttattttccttttcttccttttctttccgtagatactgctatccatgccatgcgttcgctctgtatcgttgtagttttgtgcagcatgtccgcgacgccgccgtggtatagtttactggtcgtcgtcgtcgtccgagtccagctgcttgagcagcgcggcgcagacggggagcggcacgtccttgaagtagcctagcgggttggcggggcgcaggctgtcggagatgccaacgttcctggtgagcaggacgccggcgcggtccctgagcgcctggacctcgtcgcagtccttgcgcgggctggccaccagcaccacctggcagatgtcctcctcgtggctgtccttgagctcgatcgtgtaggtgccggtcgcgtcggtgaccccgtcgatggcgcgctcgagcttgccggagccgaagtgcttgcactccagcctcaccttggcgcccgcgatgtactcggtgacgttggtc

SEQ ID NO: 14813 - DNA, 489 bp, Zea mays
  Clone ID: cC-zmpo14820002a05d1
cggacacgtgggttgccaccctcgtttcaccctccctccctcacacatataataaggaaaggtcccgcccttttcctccgacatccacaaggggggaggggaaaacacgtacattcacccggcggcaataatggcctcggttccggctccggtgacaacgaccgccgccgtcatcctatgcctatgcgtcgtcctctcctgtgccgcgggtgacgacccgaaccttcccgactacgtcatccagggccgcgtgtactgcgacacctgccgcgccgggttcgtgaccaacgtcaccgagtacatcgcgggcgccaaggtgaggctggagtgcaagcactttggcaccggcaagctcgagcgcgccatcgacggggtcaccgacgcgaccggcacctacacgatcgagcttaatgacagccacgaggaggacatctgccaggtggtgctggtggccagcccgcgcaaggactgcgacgaggtccaggcgct

SEQ ID NO: 14814 - DNA, 522 bp, Zea mays
  Clone ID: cC-zmpo14820002a06a1
gccacaaattactaaattttttattcaaatgtcacttgaagggtttacaaactctaggaaatgaggggaatcccaaggggagtttggggttgtttgggagaaaagattaaaagggcacattcctattcaaatttgaatagcaagaggattttatcctcctcaatccccttcctcacaaacgtacccttatgttttcaaactagacatgaggatttcatccttggtgttgatgagcttcggggggtgtcctaattgacgctgatgagcttaagggcgcattgtctgatgagaacctgcagttgcaagaggttgcatcggtacactttgttgctatgtcgcacaaggtaacttggtgctgcaaaaccatcatcagttcatcacatcacatatcatggaagaacttgcaggttttgacgccgatgcatgcaagggcacctatgaccaagaagaagattgcgacagcagagcggagcattttcacagcacactgcaaccctaggttattagtcatcgtttgtcttg

SEQ ID NO: 14815 - DNA, 558 bp, Zea mays
  Clone ID: cC-zmpo14820002a06d1
ttgacccacgccttcgctgacgcgcgggcggacgcgtgggttgaaggatctcctgactctctttacgaagaaagcaacgcttcgagcaacgggagcgcgtatctcgagaggaactattgcgtgctggaaccttcagacgggagcctcgctgacgatgtcgaagggggaagctctctcgagaacgtaaagagacagcttgagctcaacaggaaggccatggctgctctacacaaagagcttgaggaagaacggagcgcgtcggcagttgcggctagccagacgatggccatgatcaattggttgcaggaggagaaggccgcgatgcagatggaagcactgcagcacctgaggatgatggaacagcaggctgaccacgaccacctagcgatacaggatctgcattgattcgctcacagagagggagaaagaattgctcgacttggacgctgaacctgcacactgcatgatgcttctgcagaacgacgatccgttcaatggcgacagatttgatggcactgattatacaacgaacaacaacacggattttgtggggagcgc

SEQ ID NO: 14816 - DNA, 516 bp, Zea mays
  Clone ID: cC-zmpo14820002a07a1
ataagagcattcgttcaaataaacaaatcagagaagtctgattttacaaggtacgaactgcagacttacaagttcataattaatgaacatttctgccactcctgcgctcgagacatgcagacttttgcttgcctgtatccaagtgaacagcgacgacggaaggcgcaagcaggcaagccggccgcatgaccacgcctagccgaagcgcctgcgcaggggctgcgcgccctcgcgccggaaaagccgcacgcacgcgctgctgggccagcagcgtgcccacgccgccagggccacgccctcgcgctggaagggccttgtgcccgcgcgtcggggggccacgcccgagtctgcctgccgccagcaggggtgctcgatccgcagggactggccggagcgcccgccccgcccggggcctctgcacccgcgccgctgtggcacgcccgcccgcaggggaggcccgccccccgtggggggccgtgacccggtcgccgcgccagcgcaccgttgagcaccgcg

SEQ ID NO: 14817 - DNA, 393 bp, Zea mays
  Clone ID: cC-zmpo14820002a08a1
gggggggaaaaaaaggggaattttttttttttttgggggccttaaaaaaaaaaaaaaaaccgggggggggggggcacccgggaaaatcggggggggacccggggggggaccaatttttccaaaaagggggggaaaaaaaaaggggggaaaaaaagggaaaaaagggttccggggggaaaaaggttttccctcaaaaaaccaaaaaaaaaaaagggggggaaaaaaaaagggaaaaccgggggggcccaaagggggggccaacccaaaaaaaaaggggggggccaaaagggccctttacaaaggggaaaaaactggggggcccacttaaaaaaaaaaaggcccaccccggggggggagggggttttttatttgggccccggggggttttttttt

SEQ ID NO: 14818 - DNA, 468 bp, Zea mays
  Clone ID: cC-zmpo14820002a08d1
gtctgtgtatactgtgtaaaggtcctaaaggaaagagaagatgcacatattcaaagccaaaaaaaaaaaaaaaaaaaaaaaaaaaaaaaaaaaaaaaaaaaaaaaaaaaaaaaaaaaaaaaaaaaaaaaaaaaaaaaaacaaactttttctccgttgggatatctcccactaattaatcatcatgggggggggcccttttaagggtccaaattttcctcccgggggctgccaacaaattattttttttttgggggcccttaattcaattcaagggcccctattttaacacggttaggacgggaaaacccgggggttaccccaatttatccgctgggaaaaaatcccccttttccccagggggggaaaaagaaaaagggcccccccgaacggcccttccaaaaatttgcgccccttaaatggcattgggacccccccctttcagggccattttagccggggggtttggg

SEQ ID NO: 14819 - DNA, 513 bp, Zea mays
  Clone ID: cC-zmpo14820002a09a1
aacaaaataataaatattgagttattcataacatacttaatacatgaacaagataatgaaccttgagcatacatgaacaagatacatgacagtcatcagaatatacatgacagtcaccagaacatacatgacattcgtcataaataagaacgagataatgaacgttattaagaataggttgtcgatgcatggcaagcgatcgagcgatcttgtttagcactgcctagtgcagatgcagcggcggcggaaggtgctgcacctgccggccaagaagccctcaccgcggcacacattggcgcagttgtctgcgatcatgcatgccccaacaaatcgctcactgtacttctcgcattcccttgcctgtgccatatcggtggacacaatgagcaggagaagcaggatgacggccggctggaacctgcgtgacgactccattacctttatcttggcaggaatatatatatgcacgcttcagggattcacgaactatttattcccaattatttcaaatcc

SEQ ID NO: 14820 - DNA, 420 bp, Zea mays
  Clone ID: cC-zmpo14820002a09d1
gcgtacgatttaaataattgagaataatagttcgcgaatccctgaagcgttcatatatatattcctgccaagataaagggaatggagtcgtcacgcatgttccagccggccgtcatcctgcttatcctgctcattgtgttcaccgatatggcacaggcaagggaattgcgagaagcacagcgagcgatttgttgaggcatgcatgatcgcagacaactgcaccaatgtttgccgcgccgagggcttcttaggacggcaggtgcagtaccttccgccgccgctgcatctgaactatgcagagctatacaagatcgcttgatcgctagccatgcatcgacaacctattcttaataacgggcattatctagttcttatttatgacaaatgccatgtatgttctggcgactggcacgtatattc

SEQ ID NO: 14821 - DNA, 338 bp, Zea mays
  Clone ID: cC-zmpo14820002a10a1
gggaaaaaaaggcccccaaaagggggggggtttttaaacctttgggtgggttcccccttttgggaattcgccccggacccccaacaaaggggttcctttttcttaaattgggggggcccaatattttttaggggggggggggggggcccccaacttaataagctgggggggggggggccataccccggggggccgggggaatgggggggaattcaaagtttttaaaaattggccgttggaagggtaaacgggtttgggtttccctttcgccggggggacgttttgggggaaaacctttttgccggcctctcttgggggggggatggaaaaggggccct

SEQ ID NO: 14822 - DNA, 451 bp, Zea mays
  Clone ID: cC-zmpo14820002a10d1
ggagctacgcgtacgctgcggacggctgagtggaagcccctgacgctctcttggggcgccatctggaggatggacactgccaaggcgctcgagggcccgttctccatccgcctcaccagctagtccggcaagaaggttatcgccaaagacgttcttcccggtgaactggagacccgttgccgacgacacttccaacgtccaattctactagaccttgaatccccttcgattcatccggcccagcgcgctatggaccttcagcagcaagctaagtaagtaggctgcatgcaccgttaaccgtatatactactgagacttccccattctagtatatgtgacccctctggtcgggttcatgatcgactgccaaacagtggatgccttgcagaaagctaaatatacactgccatgcttggaggcatttttttccatccagaagaccttagctttg

SEQ ID NO: 14823 - DNA, 408 bp, Zea mays
  Clone ID: cC-zmpo14820002a11a1
gagggggggcatcaaaaacccataccataccatacaaaaaatttgccgagaatcatgggtaagtacatagtcaggactcagggaaagacctaattcctgcacggtgacatggccagcgaagttgtatcaccacttattagaaggcatacagcaatgcgcaaatgaaaagcagtaagctcgctgcattctttgagtttggggagcttgaggctccatttgctgaaggggcatctgcagctgtgtcgggtttttcctccgctgccgctgctggttcgtcgggaggcgtcggtgcaggtgccgcaacgggcagcggcagcgggggttggtctgcacgactccagccagcaccgagcagcaggagatccccggcttcgacgccttgctggagatgaaatccatgcacggggc

SEQ ID NO: 14824 - DNA, 603 bp, Zea mays
  Clone ID: cC-zmpo14820002a11d1
cgcgtacgagcgaaagtgctcaacatcgcttagtgcagcctgcatcgatcgactagggctgtacgaacgatggggtccgcctgcgcctcagtgatgacgaccagcctgctggcgctggcgctggcagagctggctttcgacttcaggagccagcggtgcaaggcaacggctgttccagcgtgatgatgaccctggccccgtgcatggacttcatctccagcaaggcgtcggagccggggatctcctgctgttcggagctggctggagtcgagcagaccgacccccgctgccgctgcccgctgcggtacctgctaccgacgcctcccgacgaaccatcattggcagcggaggaagaagccgacacaggtgcagatgccccttcagcaaatggagcctcaagctccacaaactcaaagaatgcatcgagctcactgcttgtcatctgcgcattgctggatgccttctaataagtggtgatacaacttcggtggccatgtcaccgcgcaggaatcaggtctttccctgaatcctgactatgcagttacccatgattctgggcaaaatttttgcacgggatgggatgaggttttgatgtgccacatc

SEQ ID NO: 14825 - DNA, 387 bp, Zea mays
  Clone ID: cC-zmpo14820002a12a1
gaatcaacatgtactgtcatatatttcaattagtcataaaaaatatgtattctattaaaatgtagccatgcatgataaagttaggattacgtaggagatacatggacaacacaacattcatggatccttttataacaaatgaaggcctatcaaatatttcattaggcacttattatataacttgtcaatccatttcttaactcttctcttttaaacaacagcgaagtctcactctagctatatatggagatggagaagatggagaaggaggatgacgccattattgttggcgccagcatcactgtcgtaatagggtagtggtagcaaatagatatcacggtccaatgcatgcatgtgtaatgcattgcttgggatccaacccaatct

SEQ ID NO: 14826 - DNA, 533 bp, Zea mays
  Clone ID: cC-zmpo14820002a12d1
atccaagacaaaatatggctgtgaatgtgagcaccatgtggtcgttgatgcaggcacaagttgcgatggttgtggcgttgtccttcttggtgagcggtgcatggtgcggtcctcccaaagtcccccctggcaagaacatcacggccacctatggcaaggactggttagacgctaaagcaacatggtatggcaagccgacgggtgccggtcccgacgacaatggtggcggctgcgggtacaaggacgtgaacaagccccccttcaatagcatgggcgcgtgcggcaacatccccatcttcaaggatggtctgggttgtgggtcctgcttcgagatcaagtgcgataagcctgtggagtgctccggcaagcccgtggtggtgcacatcacagacatgaactatgagcctatcgcggcgtaccacttccatttggcaggcacggcgttcggcgccatggccaaaataggtgaggaggagaagctgcgcaaggcgggcatcatcgacatgcagttccgaagggtcaagtgcaagtac

SEQ ID NO: 14827 - DNA, 547 bp, Zea mays
  Clone ID: cC-zmpo14820002b01d1
tcagcgaaccaagagagcagggtgtgggcgaagagaccccagccagtcgatcgttcaagataaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggtgagctgagcgcgatggggttgctggcggcgaatggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcatcggaagccgaccaaccgtccttaacttcgctgggcttggcgccggaccagtggccgtgcaccaggcgcggccggtcctactacagcaactgcgaggcgcataaggccgccaacccctaccgccgtggttgttccgacatcacgcgctgtgcccgaacatgaactgagcccatcgc

SEQ ID NO: 14828 - DNA, 550 bp, Zea mays
  Clone ID: cC-zmpo14820002b02d1
gaaacaacatgactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacgacggcatcaagcagagcggcgtccgctacgccaaccccatcgccttcctccgcaaggagccgctccccaactgcggcgagctgctccgcgcctacgacctctacacgagacgttcgagaattctaagcgtccaacaaaagtttctcgctcgcttttttt

SEQ ID NO: 14829 - DNA, 455 bp, Zea mays
  Clone ID: cC-zmpo14820002b03d1
tccatcgcgtccgcccagtggcagctggacgtccggcatgcctctgttagttccccaaccttttgcctttctgccagtgcctgcgccccaactgggagtagttcggtcgcctcgtattggctcactttccccgctatgattgatggtgcccaattgcgatctgacctttcggataccctctattgttcttcaaggcattttatattatacagccacttgcacatgcattctgggatattcgatatcatactatgaactgactgtgtctcaatattaaccataatctaaaaaagtcctcagattatcggaaggtatatatgttactcccccgcgggggggtccgatatagaggatcctaagcttctttcccgttgcatggaacgtcaaaatttttctattgtgccacccaaaataaacttacttgaccgatttttacaacccctctaatggttaat

SEQ ID NO: 14830 - DNA, 330 bp, Zea mays
  Clone ID: cC-zmpo14820002b04a1
caataaaaatcattttcattggcatatctattatgagcccgtgatgatatattatcacaaatgttatgctactagtacagcgtccctatgacagtgacaaatcatttgccagccacccttaatagtaacaatatgtttaacatcatgtttttagggaaccataagtgccaaaattccactgcaaatttttttatgcagaggaaatcatggacgttggttggttgcctgcctcagcgccggcggcagcaagggagtaggaggcgaatcactgccctgccacgaccatacaatgtcacctaacgatggcttcagttcctgcctgtagaactc

SEQ ID NO: 14831 - DNA, 332 bp, Zea mays
  Clone ID: cC-zmpo14820002b04d1
gagttctacaggcaggaactgaagccatcgttaggtgacattgtatggtcgtggcagggcagtgattcgcctcctactcccttgctgccgccggcgctgaggcaggcaaccaaccaacgtccatgatttcctctgcataaaaaaatttgcagtggaaattttggcacttatggttcactaaaaacatgatgttaaacatattgttactattaagggtggctggcaaatgatttgtcactgtcatagggacgctgtactagtagcataacatttgtgataatatatcatcacgggctcataatagatatgacaatgaaaatgatttttattgc

SEQ ID NO: 14832 - DNA, 310 bp, Zea mays
  Clone ID: cC-zmpo14820002b05a1
ggggggaaacccaaaccaaaaaaacccctttttaatttttccccccccccccccccccccttgttttaaaaaaaccccccccagggttttttgggcccccgggggcccccccggaaatcccgccccggccccggggggggcccccttttccccttagggggggccataaaaaccggggggaaaaaggggaaaagggggtccccgggggaaaatggtttcccctcacaaatccccccaaaaaaaaagccgggagaaaaaaagggaaaccccggggggcccaaaaggggggcccccccccactaaagggggg

SEQ ID NO: 14833 - DNA, 419 bp, Zea mays
  Clone ID: cC-zmpo14820002b05d1
gcgacccatagcgtacgaacaaatccttgttagggtatttctaatacatatggattggatgagattggaaaaaatcaagaagaagtttaacgtgtttgcgattcacactaaaaatgaaaaactagcaaagacgaaaaaggaaaaggttccatgtgaactggacttgcacactgggttttcctattcctaaggaactggggaaacccgacttataacaaaggggggggcccttttaggggtgccaatctttctaccccttcccgggccggtacttgttttttttttgggacccttaaattaaattcatgggccggggttttccaagggatgagctggaaaacccggggggcgccccaccttacttggattggggcaaatcccctttttggcccctgggttaatataaaaaaggcccctcc

SEQ ID NO: 14834 - DNA, 351 bp, Zea mays
  Clone ID: cC-zmpo14820002b06a1
acacaacccacggtcaccttggaacattaagaaacaatacgtatgcatgtatatatataactaacccaacatctgtaacagcttatacatggtaccaggaagttcccctctgttgttggcacgacaaaaaaactcagtgtctggtagcagtttacgagtagaactggtacgttttcgcgtccattatgatctgccgaagccctccgattggcgacagaatcatcaggatcaccccgagaatgatgcagatccagttggtgaaccacgagaggctgaacctcttgggcttgtagatcgcgagccacatgacgcagggaaggaaataggtcgtcggtgcaaaggcgaatccgc

SEQ ID NO: 14835 - DNA, 351 bp, Zea mays
  Clone ID: cC-zmpo14820002b06d1
gcggattcgcctttgcaccgacgacctatttccttccctgcgtcatgtggctcgcgatctacaagcccaagagggtcagcctctcgtggttcaccaactggatctgcatcattctcggggtgatcctgatgattctgtcgccaatcggagggcttcggctgatcatattggacgcgaaaacgtaccagttctactcgtaaactgctaccagacactgagtttttttgtcgtgccaacaacagaggggaacttcctggtaccatgtataagctgttacagatgttgggttagttatatatatacatgcatacgtattgcttcttaatgtcccaaggtgaccgtgggttgagt

SEQ ID NO: 14836 - DNA, 488 bp, Zea mays
  Clone ID: cC-zmpo14820002b08a1
agcaaattcagttaacattttgtcaaaactgaaaatttccataaccaactttacagaattaactgaatgcctaggcctacttgctgggggaaaatcaaatatgcctctgcagctgaagattcacttccaactgaaaatttacagaatatggtgatggctccacggaggaaaacacgagccatttagtcagaaacaggttgtttgcagtcgcgaagtacaaacacaaatgggaggaaatttacatcacaacagaattactggcattagaacttgtggtctcattggctatagacctttgccgtaggtccatcgtcttgagaacctaacgtgccatactacgagctattcattggtccagtgaacttgagaaaaatcaggttttcagttgaggaattttcttcgacaaatcatcgactgtttcatccacgctctctaaaacagattctccatctttgacatgcgttcggtttttcacctatacacttgga

SEQ ID NO: 14837 - DNA, 598 bp, Zea mays
  Clone ID: cC-zmpo14820002b08d1
gagctccagaattatgtggctcctttttttcaaagtacactcctgccattgatatttggagcgtagggtgtatatttgctgaattgctcacagggaagccactctttccagggaagaatgttgtgcatcagttggatcttatgactgatctacttggtacaccttcagcagagtctatctccaagataaggaatgagaaagctcgacgatacatgaacaatatgaggaaaaagcctcgggttccctttactaaaaagtttccagggatagatcctatggctctccatttgcttgaacgtcttcttgcttttgatcctaaggaacgaccaagtgctgctgaggccctggcagatccatactttaatggattagcaaataatgaacgtgaacccatagcacaacctatctcaaaacttgaatttgagtttgagaagcggaaactggccaaagatgatgtccgagaattgatttaccgagagattttggagtaccatcctcaaatgctacaagaatacctacaaggagcagaccacaatcagatgaccttcatgtatcccagtggggtggatcgctttaggcgccaatttgctcatttgga

SEQ ID NO: 14838 - DNA, 571 bp, Zea mays
  Clone ID: cC-zmpo14820002b09a1
ggccacggccatgcccggtggcggcggctcgatgcggaagcccggcacgctgtcctcctgcgagctgtagtggtggctggtgctcttctggttggcgcgcgcctgcctgtgcctccgctggtagtcggcaatggcgtcctgagctggcgcggcgcccttggcgtcgtctctccccggtttgacggatacagagcccttgcctccgaggcccgctgcgttttgcctgctgacctcctggcctcggagcttggcgtcgtactccttgcacggcgggtacttgggcaggctcgccggatcacacgccagcggcttggtcctgaagaactcgctgtccagagcagaggccaccgtgccccgtgccgacggctcgatggcgagcagcgtgtccaggagcgccagggccgagggcgggaagtccttgaacgtctcggcgatcttgcgccggtacggccgctgcggcttgaagagcgtcacgtccggtagcttcgccttggcccagtagtcctcggacggcgagccacaaagcttgaagatcttgtgcagctgctcgatcttcgccgacgcgtgggtc

SEQ ID NO: 14839 - DNA, 483 bp, Zea mays
  Clone ID: cC-zmpo14820002b10a1
aatgtggatcatagtaaagatggcctttttttattgcaggcggtcgtgatcacaatcccaatcagagacgggtgaatgaaacatgttaaaacaataatgtcaaaaaataaagcaaaaaaggacggaaattcaagccatctttgggctcaaaccctcaacacttggccatgcatgcagcattcttgggtgggtcgtcgatcagtggccgccggtcacggtgtccttgacacccgccgccgcgccggtcaccgtgttcgtgacgcccgccaccgcgccggtcaccgtgttcgtgacgcccgccgccacgcccgccaccgtgttggtgacgccaaccgccgcgcccgccaccgtgtccttgacgcctgccgccacgccctggcccgtctgcgccacctgctcaacggtgccggtggcgcggtgctgctgcagctgcgcgctgtcggccgcggctcggcggtgtccttgacgcactgcgccgcgtgc

SEQ ID NO: 14840 - DNA, 543 bp, Zea mays
  Clone ID: cC-zmpo14820002b10d1
acctacgcgtacgcctggtccaagtgatcttgccaagttacgagcagctagcagagatcagatcatccatcggcaatgtcgaacatcgggcagtccttccaggccgtcaaggcggaggcccatggcgagtaccaggcggagcacgcggcgcagtgcgtcaaggacaccgccggagccgcggccgacagcgcgcagctgctgcagcaccgcgccaccggcaccgttgagcaggtggcgcatacgggccagggcgtggcggcaggcgtcaaggacacggtggcgggcgcggcggttggcgtcaccaacacagtgagaggcgtggcggagggcgtcacgaacacggtgaccgacgcggtggcggacgtcacaaacacggttaccgtcgcagctgcgggtgtcaaggacaccgtgaccggcggccactgatcgacgacccacccaagaatgcttgatgcatggccaagtgttgaaggtttgagcccaaagatggcttgaattttcgcccttttttgctttattttttggacattattgttttaacat

SEQ ID NO: 14841 - DNA, 234 bp, Zea mays
  Clone ID: cC-zmpo14820002b11a1
ggcgtcggacgcgggagccggggcgggggcctcggcggctgcggcggacgccacgagcgcggcggccatggcggcgacggcgacgaacttcatcctgaggccggccatctgcgagtctgtagtaagccgggtgtttattgggccgcgccggatctctcttcgagggtacgaagctctagagagatggcgcccaagcggcttgctggctggcccacgcgtccgcccacgcgtccg

SEQ ID NO: 14842 - DNA, 247 bp, Zea mays
  Clone ID: cC-zmpo14820002b11d1
acccacgcgtccgcggacgcgtgggcggacgcgtgggccagccagcaagccgcttgggcgccatctctctagagcttcgtaccctcgaagagagatccggcgcggaccaataaacacccggcttactacagactcgcagatggccggcctcaggatgaagttcgtcgccgtcgccgccatgggcgccgcgctcgtggcgtccgccgcagccgccgaggcccccgccccggctcccgcgtccgacgcc

SEQ ID NO: 14843 - DNA, 325 bp, Zea mays
  Clone ID: cC-zmpo14820002b12a1
ggagggggggggatcgggtacttaaaaaacaggatcctatcacttgacttcaattatgatgcatgtcctcccaaactttacaaagccatccggcattatctcccctacgatcgaatcgaagcaacatgaactaccctgaccccgtgcttaagagagttcctgttcctgccaccaggaggcaatggcgacaggaacagcagctaccatcgatcaggtcacctggttgttgccgcagccggagccggaccaggagggaagttcacccactgcagctgcaggtgtatctccccgctctcgacgttcctgagccggaggatcatgttct

SEQ ID NO: 14844 - DNA, 598 bp, Zea mays
  Clone ID: cC-zmpo14820002b12d1
ggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggtgagaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccacgtgtgctggaggaacggcaagttcgcgcaggacatgatcctccggctcaagaacgtcgagagcggggagatacagctgcagctgcagtgggtgaacttccctcctggtcctgctcctgctgctgcaacaaccaggtgacctgatcgatggtagctgctgttcctgtcgccattgcctcctgct

SEQ ID NO: 14845 - DNA, 589 bp, Zea mays
  unsure at all n locations
  Clone ID: cC-zmpo14820002c02d1
gcgtccggcatcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcatggcccagccgtgtggagcaagaactcctgcaccaagaagtacgactgcaagatccttcccaactcgctggtgatggacttcgtgaacacggngaggtgtccggngtcacgctgctcaactncaagttctccacatgaacatg

SEQ ID NO: 14846 - DNA, 421 bp, Zea mays
  unsure at all n locations
  Clone ID: cC-zmpo14820002c03a1
ttttttttttttttttttttttttttttttttttttttttttttttttggggttgtggttttttttttttttttttatttttttttttgatttgttaatttcttattttgttttccaaccaaccccaccccccaccaatggccaacgcttgaagcggggcgaggggcgcgccccggaaaacccgccaagggcagggggggggacccgcgttttacaaagggggggggcgcacagggggcagggaaaaagggggaggggggaaagggggggaaaaggaagaaccaaaagcnnncacccaaaggaaagaaaccgggcgggaaagccgaagggccgggggcccaaaggagggggccaaaaccaatttagggggggcgagcgaagagggccccaaacccggggaaacggggggcacccattnccc

SEQ ID NO: 14847 - DNA, 92 bp, Zea mays
  Clone ID: cC-zmpo14820002c03d1
tcgcgtccgcggtcgcgtgggcggacgcgtgggcggacgcgtgggaaaactaaattttaactttagaaaaaaagaactcaaaaaaccaaggg

SEQ ID NO: 14848 - DNA, 315 bp, Zea mays
  Clone ID: cC-zmpo14820002c04a1
gagagaatggggtgttttctcaacaatttccgacacgcaacccacagggaaaggcaaggtaaaaaatggcgcggtcccagagaaaagccaaacaaaggaaaaaaaagttggccgggggaaactggaacacaaaaaccaatcccaaaaaaaaaacagaaaggagtaaaaaacgacaaagcagacggaccaaaagaaaaaggagaacgggccaaactcggtgtcggagaagaagacattatcggccaaacaaaagccgccagacgtggtaataaaaaggaagcccacccggcgcaaaaggcggaccaagaaaacccc

SEQ ID NO: 14849 - DNA, 546 bp, Zea mays
  Clone ID: cC-zmpo14820002c05a1
gaatcaagcactctgatacattttttattttccttttcttccttttctttccgtagatactgctatccatgccatgcgttcgctctgtatcgttgtagttttgtgcagcatgtccgcgacgccgccgtggtatagtttactggtcgtcgtcgtcgtccgagtccagctgcttgagcagcgcggcgcagacggggagcggcacgtccttgaagtagcctagcgggttggcggggcgcaggctgtcggagatgccaacgttcctggtgagcaggacgccggcgcggtccctgagcgcctggacctcgtcgcagtccttgcgcgggctggccaccagcaccacctggcagatgtcctcctcgtggctgtccttgagctcgatcgtgtaggtgccggtcgcgtcggtgaccccgtcgatggcgcgctcgagcttgccggtgccgaagtgcttgcactccagcctcaccttggcgcccgcgatgtactcggtgacgttggtcacgaacccggcgcggcaggtgtcgcagtacacgcggtcctggatgacgt

SEQ ID NO: 14850 - DNA, 503 bp, Zea mays
  Clone ID: cC-zmpo14820002c05d1
cgacccatgcctacgtgccaccctcgtataaccctccctccctcacacaaataatattgaattgtcccgcccttttcctccgacatccacaaggggggaggggaaaacacgtacattcacccggcggtaatattggtctcggttccggctccggcgacgacgaccgccgccgtcatccctatgcctatgcgtcgtcctctcctgtgccgcgggtgacgacccgaacctccccgactacgtcatccagggccgcgtgtactgcgacacctgccgcgccgtgttcgtgaccaacgtcaccgagtacatcgcgggcgccaaggtgaggctggagtgcaagcacttcggcaccggcaagctcgagcgcgccatcgacggggtcaccgacgcgaccgggacctacacgatcgagctcaaggacagccacgaggaggacatctgccaggtggtgctggtggccagcccgcgcatggactgcgacgaggtccatggcgctcaaggaccgc

SEQ ID NO: 14851 - DNA, 550 bp, Zea mays
  Clone ID: cC-zmpo14820002c06a1
gaaccactgaatatggattgaatgaatctggttaatatatacagggattggactaaatgcctgtcctatccgaacagcgctactcgtttacacatcagagcagctcgtctacaggcaattctgcttcccaggttcattcattaataatgtggtgaatggctaccgaatcatgttctgatgatggcaacacaggcgcctctgtaggccagcagtggagggagtttaggccgaggtaccgccaagctgtgtggccatgcgaaccatttttatcatccagccacaagggcccgttgatccgaactaatgaagccactgcatgctggatgttgacatatatacaggtgacgtggacaccgctcggtgctttggtgatcatgacgcgcctaccgccatttctggtggtttctcttgtgcctcatccttgcccagcaatgcgtggtgtgactgaaacaacaccgatcagggatagcagtgctatcgactgggtgtcgtaaaggtcactcagcgaagttaactcttcaagagcaattccagccctgacagtcacata

SEQ ID NO: 14852 - DNA, 544 bp, Zea mays
  Clone ID: cC-zmpo14820002c06d1
gcgcgaggaactccaaatgctcactggccaccttgagaactattctagtgtctacaccctacaggtgttggtaggttgttgcgctgtgtacatcttcatgcagaccttcatgatcccagggacaatattcatgtcactgcttgctggtgctctgcatgggcaactgcgtggccttgcgctggtggtctttgctgccactgcaggtgcttattcgtgctatttcctgtcgaagatgattgggaagccactggtgttcacactgtggccagataagctcagcttcttccagagacaggttgctaaaagaagagagaagttgttgaattacatgcttttcctcagggtgaccccaacattgccaaataccttcatcaacttagcttcacccatagtagatgtcccctaccatatattcttactgggaactctcattggtcttatcccagctgcttatgtgactgtcagggctggaattgctctcggagagttaacttcgctgagtgacccttacgacacccagtcgatagcactgctattcctgatc

SEQ ID NO: 14853 - DNA, 432 bp, Zea mays
  unsure at all n locations
  Clone ID: cC-zmpo14820002c07a1
gatccagaaaaaaaagtctcaacttaaaagtgtcacgggatgcagaaagacccatttccttctctggacaagttacatggatcagggtctgtttatacaacatgggtagatatgatgaaatcgaattcaaggacaggtggttctcttaggccagatagcgatacatcttcctgtctgtcttgtcccgctccaggaagtcgcgttcgatgagcgactcgatccgcttcttgatcaccacgggattcggcatgaaacgcggctgcagctgctttgtcacctccgtcatgatgctgttgtggtcgaggaccctcctcgacttcatgatccgcacaatggccgcctcgatctgcggcttcctgtcctcctccacccgctgccgcgtntttagcttctcggggtcggtctccttctgcgccaccacggtgccgatct

SEQ ID NO: 14854 - DNA, 531 bp, Zea mays
  Clone ID: cC-zmpo14820002c07d1
gaactttataaacttaaacaacagatcacctgagttcatatcactgtttgttgatgacaaactgcggaagggggtgaaagaggccaatgaggaggatcttgaaactgtcctggacaaagtgatgatgctgtttaggtatttgcaagaaaaagatctatttgagaaatattacaagcaacacttggcaaagcgtcttctttctgggaaggctgcttctgatgattctgagagaagcatgcttgtgaagctgaagacagaatgtggctaccagtttacttcaaagttggagggcatgttcactgatttgaagacctctcaggatactacacaagggttttatgcatctacttcctcggagctgccggcagatgcccccacaatgtctgtccagatactcacaactgggtcatggccaacgcaaacctgcaatacctgcaatctcccccctgaaattgtttctgtctcagagaagtttcggtcttattaccttggcacacataatggcaggaggctaacatggcaaacaaacat

SEQ ID NO: 14855 - DNA, 601 bp, Zea mays
  Clone ID: cC-zmpo14820002c08a1
ttttttttttttttttttttttttttttttttttttttttttttttttggtttttttttttttttttttaatttattttttaatatttattttttttttaaaattttatttaatttagttttaaaataataattcaatagaaggagaatttattggtaaattgtttataaaaaagagggggaagggataaaaaaaaaaaaaaaaaaaaaaaaagaaaaagaaaaaaaaaaaaaaaaaaaaaaaaaaaaagaaaaaaaagttgacaaaaataaatgcaaaaacggttgaataaaaaaaaaatttagcaacaaaaaaatcaaaaaaaaaaatgtagaaaaaaaaaaaatgcatggccgggcaaaagaaagagaagaagaccataaaaaaataggggggtgggatactaaacatgctttaaaaaaaaaaaaaaagccgattgggctttattataaaaaaaatcacaaaatgccggaagaaaaaatgtgtgttactaacgagcaaaaaaatttgttttttttatggggaggaagaaagaaaaatctgtatttttcattagggcgtgcacaaaaaaaaaaaaaaagagacttaaacaaccggtgcc

SEQ ID NO: 14856 - DNA, 318 bp, Zea mays
  Clone ID: cC-zmpo14820002c08d1
tcgacccacgcctccgaaaaaaaaaaaaaaaacaaaaaaaccaaaaaaaaaaaaaatttaaattttaaaaaaaaaaaaaaaaaaagaagcaaggcggggtggaatttgataaggagcaagccctggttaccgcgttcgctgttgataaagctgcccctatgagctgttcatcccgcctaggttaatgtcttcgcgtcaccgtccatcggcaccgtgtggtaccacggccctcgcccgttagttcgtggtctccctcttcgagctccgctctcgctacggcgtgccgcccatgaattgggacaggacgctgacgcggct

SEQ ID NO: 14857 - DNA, 324 bp, Zea mays
  Clone ID: cC-zmpo14820002c09a1
agatcaaaacaagattattgatgcatataaaccagcatatacatctgatagctccattggtacactccaaggaacaaagacaaacagacatgaacagatattttgctatctccggcaacaaaacaaatttgcaaaaaaaaagtacttattacagaaccatgaatggactggataaataggaccacgttgcccctggcttgcaatataccggcaatgcttgggtaatatgtacaaagagcatcaaggagagcttttcccgacttgcttctttcatcaaacctgaacagaggcttattgcatgaattgcactccttaatatggtag

SEQ ID NO: 14858 - DNA, 244 bp, Zea mays
  Clone ID: cC-zmpo14820002c09d1
ccacgcgtaccgctaccatattaaggagtgcacttcatgcaacaagcctctgttcatgtttgatgaaagaagcaagacgggaaaagctgtgcttgatgctctttgcacatattacccaagcattggcggtatattgcttgccatgggcaacgtgggcctatttatccattcccttcatggccctgtaataagtacttattgtgatcggaaacatggtttgctgccggagatagcacaaaatcta

SEQ ID NO: 14859 - DNA, 464 bp, Zea mays
  Clone ID: cC-zmpo14820002c10a1
atataagtattatatttatttttagaccaatcgcaaacagaggtggttcatgttatacaaactgtatacgtagatacacgcgtgtgggattaaatcaatccctacttcctctgtgggaaaaaaaatgaccaaactgtactgtgatgtgtaacaatgccacaacacagtacttgaaggcaaacgtagattaattagcagaacgacaacctgtgatccatccttgctttcttccatgaaatgaaacgcagccatcgcgacctggcatggccaggccatgagctagaagaagcagcctctgacgcccaccggccggccttcagcacggcttgcccgtgcagcaggacagtgtgccggagaagcgggtgagccttgtaacgtaggttcctggcttgggcttgacccactcgttggtgtcgacctgcttgggggcgccgccggacggattgaagatggcgccgttcatg

SEQ ID NO: 14860 - DNA, 429 bp, Zea mays
  Clone ID: cC-zmpo14820002c10d1
gaaaaagtcagcacattgcaagcaataataatggagacgacgactaagctccggtggagccggcccggctccttcctcctcgtcggcgcggcgctcctggcgtccgccgccgcgtacggcgtcaacgtcagccatttctactaccacttgcagaagcggaagagagctcgccaaggcgtcagggaaggaggcgtacaggcccgacccattcaacgtgaccaacaaatttaacgccgccgatcacagagctgccaccatcgaccgggtgtgagatgcgggagaggcccaggatgcctaagagccgatggagcttctggcacaatgacaacaacgactacaggggctcgctaatgtacaccattggcggaggaaacacgccaaccatcatcaggcaagagctccgcttcatagcaccaccaaacattggac

SEQ ID NO: 14861 - DNA, 546 bp, Zea mays
  Clone ID: cC-zmpo14820002c11a1
atcaatcatcaatcacattgttaaatatatcacatacattttttattattacattgcatgtacgtgacattgttgtagaatagaagagaagtatttccccttccaaacaaacaaaaaagaagggaaaacgaagttcgtaatcgtagtatcgaacacacaatcatgtttccctttcctcgatcctctcttcttcccgcggaaaacgaaggaagcccacgcatcgccggaggagcttgtggatagctcgctcgcgggcctgtcccgatcacctgtcgtcgttgtcgtccagctgcgacgggctcctccaaaagccggtgccgtagaacctcgcccacacctccttctccagctcccccttttcctccagctgcaaggcgggcttcacgggcagcgccaccgcattggcggcgccggcatccacctcgacgacgccggtgtcgtccacgaggagctcgtatatctccgtggcctggcccgcggaggcagagcgcctgcggcccttgcgcacgcgggcgggcttgcggcacagcgccgcgggcgcgcgca

SEQ ID NO: 14862 - DNA, 544 bp, Zea mays
  Clone ID: cC-zmpo14820002c11d1
cacgcgtccgtcaacatcagggagcaccgctcctgcagcgaggcggccggcggctccgcggctgtctgcgccgctgtgtgctgctgcttcccctgcgtcatggtggaggtcgcggagctcgccacggtgcgcgcgcccgcggcgctgtgccgtaaggccgcccgcgtgcgcaagggccgcaggcgctctgcctacacagaccaggccacggagatatacaagctcctcgtggacgacaccggcgtcaaaaaggtggatgccggcgcccccaatgcggtggcgctgcccgtgaagcccgccttgcagctggaggaaaagggggagctggagaaggaggtgtgggcgaggttctacggcaccggcttttggaagagcccgtcgcagctggacgactacgacgacaggtgatcgggacaggcccgggagcgagctatccacaagctcctccggcgatgcgtgggctatcttccttatccgcgggaagaaaagaggaccgaggatagggaaacatgattgggtgttccatactactattacgaacttc

SEQ ID NO: 14863 - DNA, 365 bp, Zea mays
  Clone ID: cC-zmpo14820002c12a1
acttctcaagataaggaaacaactttcaacttggggatttacatagcgcaattgcaatacacagatgaggttggtaattctctctacagaaaacaaaacaagaacgaaaaactctgggcctctattttctttacaattgctgaagcacctccccccctcctcttcctcagatggatggtagtagcagtccggtagtcgacacaggaaaccagattagtaccagctgttcatatatagtacacctgaaagaaaactagcgttacgggtttgatcctggccctggacctctcaaaatatcttgtcctccgcttggagcttttgaagcgctttctttgcattaaaaagggaaacacccaggggaagtt

SEQ ID NO: 14864 - DNA, 529 bp, Zea mays
  Clone ID: cC-zmpo14820002c12d1
ggaatccctcgggggacccacgcgtccgattacccatacatagctggttccatggctggaaccatacatgaaactttccttgcaatatacagtgggaaacttctacagagcttggctgtagcaactagccaagggtcattcttgtcggtggatcagattatctacaatggaatcggctttacaattgctgcaacttccactgctgctatcactatttatgcaaagaaagcgcttcaaaagctccaagcggaggacgagatattttgagaggtccaaggccaggatcaaacccgtaacgctagttttctttcaggtgtactatatatgaacagctggtactaatctggtttcctgtgtcgactaccggactgctactaccatccatctgaggaagaggagggggggaggtgctccagcttttgtaaagaaaatagaggcccagagttgttcgctcttgttttgttttctgtagagagaattaccaacctcatctgtgtattgcaattgcgctatgtaaatccccaaggtg

SEQ ID NO: 14865 - DNA, 564 bp, Zea mays
  unsure at all n locations
  Clone ID: cC-zmpo14820002d01d1
ggtaccaggacgatgaagtccggtcgaccgaattttgtagttccttgattgttgcttccttagtcctttgtactgatcggcgctccggtcggctcctcgcgcttgcgggttccccgtccccaccccacgccgggggcaaagagaatgggaaacgcggggggtgcctccgggaggtggttggaaccgtttcgaacgccgggcggtacggtaaacattacccggtggccagcttcaagggcgcgcctgggttgngggaaaaccttaaactttcccacatttcgcgtggtgcagcagattgattaggagtgtttgaacttcgatcggaatggcaccatgaacttcgaagagtttttggctcttaacaaatccctacagaaggtgcaaaatgtgttctccaccctggataggggccgtggattcctaagtctcgaggaggtgtaccaggcattaatcaaacttggtttctcgttggattcaccaaccttctatactgtttgtgagagctttgacaagagcaagaagggcatgattcaattggatgagtttatatcactctgcattttt

SEQ ID NO: 14866 - DNA, 421 bp, Zea mays
  unsure at all n locations
  Clone ID: cC-zmpo14820002d02d1
gcgtccgccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccactcgatcgagagatcgatcgatgcttggtattatatttgnattccacattatatataag

SEQ ID NO: 14867 - DNA, 474 bp, Zea mays
  Clone ID: cC-zmpo14820002d03a1
aagcccaattagaacatgttgtttcatcagaagaactccgtggaggaaaataatgggagacatcgaagaaggttagtttgttacatggtgtggccagtcgagagtgtctctcccgacctatgccgctatgccaactgtagagaattcaagtgtcgtctccttgctcgatcacacactgatcatcaggtatcatcagccaataattatattagttggcacgcgcatgcacggacagtcggtcagctttgctgcgcctgcttctccttcctggcctcctcgacgtccttcttcttcgcctccaccgtcgtcgtggtctcggcggcggtggcgaccttttcctctgcattggcggctgccgctggcttctcctcctcgacgacggtcttctccacggcttcctcctccttgtgatcgggctcggcgacggccgcctctggagcgaccacctcattagccttctgatgctcaacgtcg

SEQ ID NO: 14868 - DNA, 598 bp, Zea mays
  Clone ID: cC-zmpo14820002d03d1
cgcgtccgagcacctcctcctcccccgccggccaacaactcagccgccgcaaccgtcacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaggccaggaaggagaagcaggcgcagcaaagctgaccgactgtccgtgcatgcgcgtgccaactaatataattattggctgatgatacctgatgatcagtgtgtgatcgagcaaggagacgacacttgaattctctacagttggcatagcggcatatgtcgggag

SEQ ID NO: 14869 - DNA, 477 bp, Zea mays
  unsure at all n locations
  Clone ID: cC-zmpo14820002d04a1
accgccgccgtcgtggcctcgtcgctcgtcggcgtggccaccgcgtccgaggcaccgggcccatcccccgccagctccaccggggccgccgccgccgccgtcaccggcccggcgctcgctgccggcacgctcgctgtggccgccgttgggtacctcttcagctgagctcctccggctgcagggccggccgcgcgcgtgttgccgcccccggtcccggagtgatacataataatatataccagttcatcgcttcttgtacttgaattttaccagtattttcatcttgggtgtgttttgatcgcttcacgcacgcgagtcgccagttgggagagtgtgtgtgtgtgtcttgggttgttgattcatgtgtactctccaacgatcaacctgtttacaccgctatatatattaaaaaaaaaaaaaanaaaaaaaaanagaaaaaaaaaaaaaaaaaaaaaaaaaaaagggcgggccgttcgc

SEQ ID NO: 14870 - DNA, 147 bp, Zea mays
  Clone ID: cC-zmpo14820002d04d1
gcggccgcctttttttttttttttttttttttttttttttttttttttttttttttttttctaaaaaagggagcggggaaacaggtttttccttgtagtgtccccttaattatcttcgcaatacacacacccccctttttccaactt

SEQ ID NO: 14871 - DNA, 437 bp, Zea mays
  Clone ID: cC-zmpo14820002d05a1
aacaatggaaacgcgtgtcagtacttaggcaagaaaaaatgatcctcgtccagtacagtgtgccatgaatcaaaattcagcgttacaagatgtgtatacatgcatgcatgcatgcttgatcgatccagcagtcgatcgtcggatcagtagtagtacgccggcagccagtccttgccgttgatgaagtcgatggtgaggtacttggccgcgtcgtcgggagagaacctccgcgaccatggcacgcggttcgtcacgtcagcgcccggcccagtgcagttgaactccgcgagcgtcaccttgtcggtgctgccgctgtagcctatggttgtccagccggccgggtggatggtcttggagaggtaaggtgtcggcgaagatgacgcgcgagtccggcgcggtgacgcggcccaggtacaccttcccgacgccgtacacct

SEQ ID NO: 14872 - DNA, 496 bp, Zea mays
  Clone ID: cC-zmpo14820002d05d1
ccaggaccaggacgacgatggcccggtcgcgccttctcctttccttcttgctcgccgcggcggccgtgctgaccacggtgcccggcgtctcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttggtgaggggcaacggcaaaggccggacctccatcttccacgagtccggctcttccgacatcgccgagtccgtcgtgttcaccgtgaactcggacaacgttatcgttttcggcgtcagcttcaggaacagcgcccgcgttggtctgttgaacgacccggagatccgttccgt

SEQ ID NO: 14873 - DNA, 203 bp, Zea mays
  Clone ID: cC-zmpo14820002d06a1
aacccctaaatttggttggtttttggagaaaaaattttataccctcaaattcagggggttacaccggcgaacataatatagctggcggatgtctggcgttttactggtgggcgttaccaatggatagcatttaatgggcaatgcaagggcgagagaaaaatttttacttgagagatgggtcagtcgatggggggtttaaaaac

SEQ ID NO: 14874 - DNA, 205 bp, Zea mays
  Clone ID: cC-zmpo14820002d06d1
gcttctatgaccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaatttaggggttt

SEQ ID NO: 14875 - DNA, 400 bp, Zea mays
  Clone ID: cC-zmpo14820002d07a1
ccccgttaaacagtaatcagccaaacttaatgaagcgtaataaagtccaattagcagggaaaggataatcagctaatacattatgaccacattcctacaccataatcgaaagaagcaagaaaaaacacgaaagcagaagataagctttacccacagcaaacaggaattcctctgccaccggctctatactgtatgacctgtcaacccaatgatccacatcaatctcggatagtgggttcacgatagacctcgaccgaacgtgcagggagctcacatcgcaaccgaatgtacagggagctcacaggccaaacagttctgctcagcgcaggtggccattaccattcggcttgaggtctgatgatccaaaaacgcagtgcccgttgcgcttgggtgagtcaac

SEQ ID NO: 14876 - DNA, 538 bp, Zea mays
  Clone ID: cC-zmpo14820002d07d1
cccacgcgtccgcccacgcgtccggcagagagggagcttaactggaaagcaaaatacggtattgaagagatgtgccgcgaccaatggaactgggccagcaagaacccttatggctatggatcacctgactctatcaagcagaatggtcaccaaacaaacggatccgctgactcctccaagcagaatggccaccgcacaaacggttcaactgactcacccaagcggaacggccaccatgcgtatgggtctgctgactcacccaagcgcaacgggcactgcgtttttggatcatcagacctcaagccgaatggtaatggccacctgcgctgagcagaactgtttggcctgtgagctccctgtacattcggttgcgatgtgagctccctgcacgttcggtcgaggtctatcgtgaacccactatccgagattgatgtggatcattgggttgacaggtcatacagtatagagccggtggcagaggaattcctgcttgctgtgggtaaagcttatcttctgctttcgtgtcttttcttgcttc

SEQ ID NO: 14877 - DNA, 529 bp, Zea mays
  Clone ID: cC-zmpo14820002d08a1
aattggtaatgctttgctgcaaagcaatgggggaaaacacttgtatagacccgaccaaaaacaaaatggttaataaaaaatgagaatgcacacacatacaatagtgcttcatgttcaagtcttaacttgcagtgcacgcaagtttccagccaaccagaacacaacctctgtgcggggccgcgtaccatagaacttggcaaccaaaccgctcacattttgttgcctattttattgaaggaacttcgatggcaatagcggacttcactgtcgattgtacagcgcaagcagctccttcagctttgctgcttcagggctgaggctgtcgaagccaacagagctcggtatcctccacctccagtttcctttctgggtagctggagtattcattctagcagaactgtcaaggccaagaatgtcctgcatggttaccacggaagtcctcgcgacggaagagagggcagccgtaatcagtgtccatgttatgtcaatattctcggcttctggtagatacttgatcacaattttcttt

SEQ ID NO: 14878 - DNA, 546 bp, Zea mays
  Clone ID: cC-zmpo14820002d08d1
ggctggaccaaggaatagcttttttgacacgctcttcaaagctgttggtagaatagatataatagcagaagatctgggggtaattactgaagatgtcgttcagctaaggaaatccattggggcccctgggatggcagttctccagtttgctttcggaggtggttctgacaaccctcatttgccacacaaccatgaaatggatcaagttgtgtacactggaacacatgataacgatacagttcttggctggtggcaaaatttaccagaggaagaaaagaaaattgtgatcaagtatctaccagaagccgagaatattgacataacatggacactgattacggctgccctctcttccgtcgcgaggacttccgtggtaaccatgcaggacattcttggccttgacagttctgctagaatgaatactccagctacccagaaaggaaactggaggtggaggataccgagctctgttggcttcgacagcctcagccctgaagcagcaaagctgaatgagctgcttgcgctgtacaatcgacagtgaagtcc

SEQ ID NO: 14879 - DNA, 141 bp, Zea mays
  Clone ID: cC-zmpo14820002d09a1
gattattatatatctatgcttgggcgaattatatcttgtacaattaattgatctcagtataccttcaaaattatcatcactacaatatataattttgaaggtatactgagatcaattaattgtacaagatccatgcttggc

SEQ ID NO: 14880 - DNA, 422 bp, Zea mays
  Clone ID: cC-zmpo14820002d09d1
cacgcgtacggccaagcatggatcttgtacaattaattgatctcagtatacctttttaattatttatcgccgggatgataattttgagggtttacgtgagacccctccctcttacaatatatacatcgcccgggcttatattttttttgaacaccgaattagattttttggctggcgcctacaggacccaagcttactggcgccggcatgcgacatcagaacttttctatagagtcggcttaaatcactacactggacttttctcgccaacgtaatgactggcaagtcccaaacgaaacccaccttaattaggtttcagaacattcccctttccacaactgtcataatgccttataagaccccacccttcatacttgccaacagcttgggcccaccccaggaattatatggaacgcgccctt

SEQ ID NO: 14881 - DNA, 561 bp, Zea mays
  unsure at all n locations
  Clone ID: cC-zmpo14820002d10a1
agcccaggtagtaggagttggtattaaaggtaagtaaactacaccctatacgcaatggtacaaaaaaataaagtattgacaacttatattccagtaacatctcctataactccccccatcaagaactggcagaaatatacatccaggcagaggggtcagtagcagatgactcctatatcagtgtcggaaggatgccgatcttcttgatgacatggaacctgaccttgatgtgatcagcgcatcagcaaatttatggatctcaacatcctcaggtatggccttgctactatcaaggccaatgctgggaccgaatgcatttaccttttcctctctagaagatacactcttcaccacagaatggtcacttctttcacctacaatttctgtgccaagaggactagattttgcgctgtccaaagaagaatgtgtaccaaagccatgatcaccatgccgtcgactatcaggcatgtttggttctgccatgaacgaagaatagctatcatgtgaatcccttncagtgaagtcatcgaagaacaacttgaaatagccgacgcgtgggtc

SEQ ID NO: 14882 - DNA, 174 bp, Zea mays
  Clone ID: cC-zmpo14820002d11a1
aatataatctcaaaccggattaaatttaaatacgaacagataatatctgtaccatttacatccttttgtaccatttacatccttaatagaaggcgaacgccttttcatctcaaccgacagcagatcattctgcagttcttattatataggatgattacgaaggtaacatgtttg

SEQ ID NO: 14883 - DNA, 194 bp, Zea mays
  Clone ID: cC-zmpo14820002d11d1
cggaaagactcacgcgttcgcaaacatgttaccttcgtaatcatcctatataataagaactgcataatgatctgctgtcggttgagatgaaaaggcgttcgccttctattaaggatgtaaatggcacaaaaggatgtaaatggtacagatattatctgttcgtatttaaatttaatccggtttgagattatatt

SEQ ID NO: 14884 - DNA, 317 bp, Zea mays
  Clone ID: cC-zmpo14820002d12a1
gggaaaaggggggatcttcggtaaaaattttagcgggccaaatcatagccccttctggggggggggggtaccggaacccagggggggaacattaaacccatttcctgccagggtttgggcaaacccccaagcccccaacgggggccctacgtaccggaccccagtaaccccccccacaccctaccttgtttggaggggcagtttccggtgtacccccccttctgggcggggccccccccgaccacccgggggggccccttatgtatgagtaaggatagggcccccccctcccgggggggaatgggagggggcccccc

SEQ ID NO: 14885 - DNA, 571 bp, Zea mays
  Clone ID: cC-zmpo14820002d12d1
cggacgcgtgggcggcgcgagggcgggtggagcacggagtacggggagttcttcatgagctggtactcgcagatgctcctggagcacggcgagcgcatcctgtcggcggcgacgggcgtgttcacgggttcccccggcgtgaagatctcggtgaaggtggccgggatccactggcactacggcacccggtcccacgcggcggagctgacggcggggtactacaacacccggtcgcacgacgggtacgcgcccatcgcgcgcatgctggcgcgccacggcgccgtgctcaacttcacgtgcgtggagatgcgcgaccacgagcagccgcaggacgcgcagtgccgccccgaggcgctggtgcagcaggtggccgccgcggcgcgggaggccggcgtgggcctggccggcgagaacgcgctgtcgcgctacgacgacacggcgcacgaccaggtggtggccacggccgccgacagggccgccgaggaccgcatggtggccttcacgtacctgcgcatggggcccgacctgttccagcccgacaactggcgccgctttgccgcgttcgtcaagc

SEQ ID NO: 14886 - DNA, 522 bp, Zea mays
  Clone ID: cC-zmpo14820002e01d1
gtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacagggcgacggcgacgcggtcgcggtccctggcgcacagggcgcggtgcccctgcacggtgaccaaccccatcgaccagtgctggcggtgccgtcgcgact

SEQ ID NO: 14887 - DNA, 552 bp, Zea mays
  Clone ID: cC-zmpo14820002e02d1
ccacgcgtccgggcgcacaaggataaggagattacggatgcgctggagggggcgggcgtgcagcccacagagtctgaggtggcgcatgaggtagcgctcatgtccaagaccaacatgtaccgtccagggatcgacgtcacgcaggcagagctcgtgccgcacttgaattggcgccgccaagagaggacagaagccgtcgggcaatggaaagccaaggtgtatgacatgctgaatgtcctggtcaccgtgaagtctaggcgcgtgcctggggcgatgacagacgaggagctgtttgccatggatggggaggagaagaatgggaggggcgcagagcttgatgctgagttagacgaagtgttgacagccgaggagaggaagcaacttgattctgcgcttagtatggggaacaacgaagaggaatctgaggagaggggcgacgaaggtgatgctggtgctgatcatacggatgcgagtggcgtgaccaaagataagaagggatggttcggttggggcgccaagaaaggtgccaagggcgatgacaagccatcaaag

SEQ ID NO: 14888 - DNA, 612 bp, Zea mays
  unsure at all n locations
  Clone ID: cC-zmpo14820002e03a1
ggtgcaaagatttggcatctcatgtcggttcattttaacagttccacaatgcaaaatccatcacatgtacatctacataataagtgatacgaaatatacaggggcatcagtgaaaatcaatgctcgtatgggtgactgacaagaggtctcctctactatgtatttcatcatggcattgtttgttgtcccatgcaactatcaaccatcataatcataatttgtctcgatgcttgctttaggagttagcactaacccagctgaaaggtcttcggatagctcgttggttcaatgtgaagcttaacccaaacatttccttgatggcttgccccttctccagatgttctaccaattttatgacaagagcggcactttccctcacatgttccatgtcagtctgtgtccagatgcggcgagatagttgcagccttcgttgtttagaattcagatcaattccccatttgctataaagggctctctctttctagaagatggagtctcctcagcatttgcttgtagagcatgtctcttcatgccgaagatttctcaagcttgatgtaacagtaacattaggctcacantccgcaatgaaagaactgtgaatgaaggacaatt

SEQ ID NO: 14889 - DNA, 581 bp, Zea mays
  Clone ID: cC-zmpo14820002e03d1
ctgcatcacaaaggttaaagagaagcaagaagactattgtacatcccaactagagggcaatcaggacaacgttactgcagaaatcttggacatgaaacatgcaaaaaatattgacaaagatatatttgtggccaatattgactccccttcacggtggcctattaattttgagaaaaaacagaaagaaatcattgagttatggcatgaatgcaatgtctctatagtacacagaacatatttcttcctcctcttcaaaggagtcaaagcagacaatatttatttggaagtggagcacagaagattgtccttcattcacagttctttcattgccggatgtgagcctaatgttactgttacatcaagcttgagaaatcttcggcatgaaagagacatgctctacaagcaaatgctgaggagactccatcttctagaaagagagagcctttatagcaaatggggaattgatctgaattctaaacaacgaaggctgcaactatctcgccgcatctggacacagactgacatggaacatgtgaggggaagtgccgctcttgtcataaaattggtagaacatctggaga

SEQ ID NO: 14890 - DNA, 246 bp, Zea mays
  Clone ID: cC-zmpo14820002e04a1
attattacacataaatattctttttccctcaaaataagaaattgtttggaatgttttcccgggcccagaaggagccccccagaaagtgggagcgggaaccgggagagaccaaaacaccccccaaagaggaaaaaccaaaacggggggaaaccaaacgaaaaagccgacccacggagaaaaaaaataaaaggccaaacttgaccccaaagaaaacacggagagccaaaacgcgaaagccgggggggc

SEQ ID NO: 14891 - DNA, 365 bp, Zea mays
  Clone ID: cC-zmpo14820002e05a1
ggggaaaaccccccaaaaaaaatttgggtttcctttcctttttcaaggacaaatttggaaaccaagggaaaaggatttggggtttaaagccaaccaatttggaaaaaatggggggggggggcaaaaaaaggctaaaaaaaaataaacgggggcggcaaaggggtattaatgaacggggggggcgccccaaaccaaatttttgaaaaaagagggccaaaagggcaacggcccctcctttaaggaacccaacgggttgggggggcccaagtttttttttatgcccacctttctgggaaaaaaaaaacccgggcgggcccttttcccctgaaactgggggaaaatcttggggggggttttcaacaaaa

SEQ ID NO: 14892 - DNA, 323 bp, Zea mays
  Clone ID: cC-zmpo14820002e05d1
acccacgcgttcgctaccctcgtcgtcatctcactcaccccgccttcacgcctttttcaccaaataaggtcccgcccttttccgacattgacaggggggacaggaaatcatcggccatggcctcgattccggcgacgaccttcgccgtcatcttatccgtcctcttctgtgccgcgggtggcaccgtcgttgacaacgaccttcccgacttcgttattcagggccgcgtctattgcgacacctgccgcgccgggttcgtgaccaatgtcaccgagttcatcgcgtgcgccaaggtgaggctggagtgcaagcacttcggcacc

SEQ ID NO: 14893 - DNA, 432 bp, Zea mays
  unsure at all n locations
  Clone ID: cC-zmpo14820002e06a1
gcagaaacgcttttcatgccctgcattttatcaaaagtagttttgtttctcgtagccatgagacccatcaaatcaaattaatgaagcacccatcaacaattagcaagaccgatgaactagcaaggcttcttgcagaagcacttgcgcgtggccacgacctgcttgcactcgccaccgggaaagctctccttcatgcacacatcggcgcatctgtcgctgttgaagcagaagccctcgaactggagactcggcgataagcattgactctcttccttctccgngcttttctcctccttcttctccggctcctgctgtttcgctttctccattatcaaggcatgcatgggcatggctactcccattttggcatcgatggttcccacctctgctgcgacgaggagaaacaagaataggacagctccctgagacact

SEQ ID NO: 14894 - DNA, 548 bp, Zea mays
  Clone ID: cC-zmpo14820002e06d1
cgacccactcgtccgcccacaccttgagacctgcgttgtcacccacccatcaaggttggggccgccagcaggttcagccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggtgaaggaagagagtcaatgcttatcgccgagtctccagttcgagggcttctgcttcaacagcgacagatgcgccgatgtgtgcatgaaggagagctttcccggtggcgagtgcaagcaggtcgtggccacgcgcaagtgcttttgcaagaagccttgctagttcatcggtcttgctaattgtcgatgggtgcttcattaatttgatctgatgggtctcatggctacgagaaacaaaactacttttgataaaatgcagggcatggaaagcgtttctgcctt

SEQ ID NO: 14895 - DNA, 381 bp, Zea mays
  Clone ID: cC-zmpo14820002e07a1
atcccgggggtcggccaaaaccaacgcttgcctactccacgttggggcgtcccaacggacgagggttgcaatcaacccctctcaagcggtccaaagacccacttgaataccacgggggtttgttttcctttcactatcccgtttgcaaggaatctccacaaattggagtctcttgcccttacaagtttttgatcacaaatgaaacacagagttagggggggaagcaacacacaaatccacagcaaaagcgcacacacacgggcaagaatcgagctcacaagactatttcagagttctcacttagaacagagctcgaatcacttagaaacacaaacgaatgcgcagagacttagtgtggatgatcaagaatgctcaaagggt

SEQ ID NO: 14896 - DNA, 526 bp, Zea mays
  Clone ID: cC-zmpo14820002e07d1
gtcgaggttccgagcgctcgtcggtaccgagcataggccgattgagtgaggatagggagagggacaaccactctagccatctcatgatcatgccatggttcagacgtcgattggtgccatagagaagtcgtcgtcgcttgagaagtttgtgggtagcactatgggacgcgagggtcgaccagagtatgatgagttgcttgctgaaattcgtcgaaccatggtgcaacatcgctgacactcgtcgttggttcaaacaccgaaaagcgaggttacgaggaatctgaagtccaaacttggagaagtgcttggagttaagccaaaaggcagttgtgtcctttatcacattctttgaccttataatattaccttttatgttctcacctaattcactgttaagttaacttgatgggaccttatgttattgaaagggaaatgtgcccttgggccatctctaagtattttggtgattgagtgcaaacacaagggcctaaatgtgaatctatgtacatggatgaacaaggtgaaa

SEQ ID NO: 14897 - DNA, 465 bp, Zea mays
  Clone ID: cC-zmpo14820002e08a1
gctggattacaggggaagactggaagctcgaaaaatatagattcacagcaagtctgctggtacacgagttatacgttcatcaaacaacctggacatacatccttccagacacaccaagaaaaaaaaaagagaacttgcaaatccgagcaaagtgtgtccttatttcagatgtgacaagcaggtcaaatgcaaagaaaacatagcgaccgagaaatagcaggagcatgcttcacttggtccaccagtgaaggaaatccttacgcctgttgatcttcttttggagctgaagaacgccgtacagcagtgcctcagcagttggtgggcacccagggacgtagatgtccacagggactatacggtcacatccacgtacaacagagtaggagtaatgggtagtatccaccaccgttggcacagctgcccattgaaataacccacctaggctcaggcatttggtcataaacc

SEQ ID NO: 14898 - DNA, 556 bp, Zea mays
  Clone ID: cC-zmpo14820002e08d1
cccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccaacaagatggctccggccctccgcaaggtttatgaccaaatgcctgagcctaggtgggttatatcaatgggcagctgtgccaacggtggtggatactaccattactcctactctgttgtacgtggatgtgaccgtatagtccctgttgacatctacgtccct

SEQ ID NO: 14899 - DNA, 106 bp, Zea mays
  Clone ID: cC-zmpo14820002e09a1
gcaaagtcgctcgaaatctccccatcaatttgggaccccataataagggggaaagattaaaaaaaacgggggaacgaaattattagcaactcacgggacacacggg

SEQ ID NO: 14900 - DNA, 186 bp, Zea mays
  Clone ID: cC-zmpo14820002e09d1
acccacgcgtccgcccgtgtgtcccgtgagttgctgatgattccgctcccccgttttttttaatctttcccccttattatggggtcccaaattgatgcggagatctcgagcgactctgcaaatttcataaaaaacaaaacctgactattatttattaaattccttataaatcagtgaatacaaaca

SEQ ID NO: 14901 - DNA, 223 bp, Zea mays
  Clone ID: cC-zmpo14820002e10a1
gccggcgggcgcctcggagggcgactcggaggcgacctcggccagcacggcggtggcggaggcggcggcgacgagcgcggcgcagaggaccttcttcatctccatggctgctggtgctggccgggtcgcttgctgctggattggtccaaggaagccggcctcgcgctcgaggagatgttattagttattcggtggaattgggagactgcttttcgacggtgat

SEQ ID NO: 14902 - DNA, 244 bp, Zea mays
  Clone ID: cC-zmpo14820002e10d1
cccggggaagacctacgcgtacgatcaccgtcgaaaggcagcctcccaattccaccgaataactaataacatctccttgagcgcgaggccggcttccttggaccaatgcagcagcaagcgacccgggcagcaccagcagccatggagatgaagaaggtcctctgcgccgcgctcgacagcgacggctccgccaccgccgtgctgggcgaggtcgcctccgagttgacctgcgaggcgcccgccg

SEQ ID NO: 14903 - DNA, 184 bp, Zea mays
  Clone ID: cC-zmpo14820002e11a1
gacgggagaggcatatatatgtcacatccatacaaaatcaaattcactgtcagacaggaagaagcaactattctaggggactcggaagacacaaatttccaaccttaggaatgcatataatatctatggtatcatcttaaaggttgctaaatgatgatatagcaaagccaaaggaactactttg

SEQ ID NO: 14904 - DNA, 197 bp, Zea mays
  Clone ID: cC-zmpo14820002e11d1
acccacgcgtccggaaagttgttcctttggctttgctatatcatcatttatcaacctttaagatgattccatagatattatctggattcctaaggttggaaatttgtgtcttccgagtcccctaaaatagttgcttcttcctgtctgacagtgaatttgattttgtatggatgtgacatatatatgcctctcccgtc

SEQ ID NO: 14905 - DNA, 470 bp, Zea mays
  Clone ID: cC-zmpo14820002e12a1
ggtctcgcgtaatttttctagctggaaacagcatatgtgtactttctaaagctgcacatgttatatcacaaactcacaacaagccaggcaaacaaacaaggaaaagcacacgaattcagagtaccggattaacattttacaaaattcccctgtatgcaatggatggatggagcaaggatgcgtggttccttagcatacatctgcaatgaggaacagatcaggggaaccgtgtccaggtccaggctaattctgtcgtctgggttgatcaggactgtggcgcggctggagctgccggtttgggcgcgttcagaagaagcgtgatcgccttcaccacgatagtcatgtttggccggaagtcggattcgtactgaacgcacaacgccgcaactgctgccagcttcgcaacggccttcggagggtagtcactgtcgagctttggatcaacacactgcttcactttgtcttcactc

SEQ ID NO: 14906 - DNA, 302 bp, Zea mays
  Clone ID: cC-zmpo14820002e12d1
ccacctttcccgcggaaagaggagctcccaccgctaatccatcgtcctcgtccctccctacccgcggccggccacccacgccgttgctgctgttctggcgcgccctccacctcttcgtctctcgtaggtgccgtcgtcggagcttgcttttggggaggtcgtgcggcatgatctgctgaccgccccaaatcaacccggccgcgcatcgaccgtcgtcatccagtccgacgaggaggaggaggaggagatggattgcttaccccccaatcgaacaagtgtggggtgaactgttgtttcttttt

SEQ ID NO: 14907 - DNA, 510 bp, Zea mays
  Clone ID: cC-zmpo14820002f01d1
atcccacgcgtccgagctcgcagagcaaaggccaagagttaagggacaatttgtaagccaaaagctgaactcagctacaacaacagacgcagaagctgactcgtgaccggcgtcaagtcatcactgtaacttattcttcccttcccaccaggtgtgggcaatcggacttgtaagactgaaggctggcagaagttttttcccttccatggttagcctttctgcacaacgggtgaactcttgtgtcgggtgtttggtgccgttgtggccttatttttgtaaagtgcatcaaattgacaaatgttcagaggggaatgggttgggggtttaggaaaacggtgcagctgccagatttcgcctctgtacttagatgtttgtgggggtgagaaagcagagcatgtacagcttattcacccattttgttgccattacactagtagtgacttgtactatgacaacagtagacattgttgtacagccttaccagtcagcgggtctttctcattttaaaaa

SEQ ID NO: 14908 - DNA, 636 bp, Zea mays
  Clone ID: cC-zmpo14820002f02d1
gcgttcggagcaagccatcttcttcttcttccccgaccttctcccttaaggcctcaaccatgcaaaggtttgattttacataccagagtaacggacccagcgccagctggaacaacgaccagagactccggcatccagtcgaccaacgtacaatgggtttcatccaaggaaggacctccaagcagacgagcagggttaagacccttctatggcttgccttgtcccgccttgccgctgcccgccgtccccgcctcgctcgcaagtcgatttcccgcagcgatgttggacagctactagcactcggacacattgatcgtgctctccaccgtgcagagcagctcatagaggaggacaacatgctggaggcgttcaacataatagagctacactgcaatcgcctcattgagtgcgcaaagcagctagacaagccccatgaatgtggtgatgacattcgggaggcagccgccgggatcatgtttgcagctgggaggtgcggcgacctgccggagctgacgtttgcacgaaccatactgacatacaagtttggaggcgagttcgcagagatggctaatgagggcgctggcgtcgtcgacccatgttggtatgtagctactagcacaaaggagacatgagctc

SEQ ID NO: 14909 - DNA, 529 bp, Zea mays
  Clone ID: cC-zmpo14820002f03a1
aaccaaggaaatgggcattttagattaaagtacaaaacgcaagcattgataaacaaccaacagcagtgtaccatattcctcttatccaccactatacataagcgtacactgaagaggagtcgacagaaccacttgttgtatgaactgggtaagctggcgcgtcagcttacagtccagcagaaggtgatggcggcacagaagtttacaggccggcagagaccaatccatgcagtgtgatgattccacacacgacgttgttgtcgttcacaacaggcaagaactgcacaggtgaaggtggtgactccatcttctccatggcttcaacagccattgcgtctgcagtgattgttcttggattcctgttgcacatctctccaactgtgagactaaagatagctggcccgcttgcttcagtgtccggcggagatcaccatcagtgaaagtcccaatcaaatgatgctcttcatcaaccacaagcagacaaccacaacctttactggtgagctcggtgagttggtccattatcata

SEQ ID NO: 14910 - DNA, 610 bp, Zea mays
  unsure at all n locations
  Clone ID: cC-zmpo14820002f03d1
ctcgacatgtcgcaggcggcggcgttcgcgcaggtgctgctcgacgcgccgggcgccgtcttcttcacgggcgtcggcaagtcgggcatcgtggcgcgcaagaccgcgcagacgctggcgtcgctgggcttcgcgcgcgccggcttcctcgcccccgtcgacgcgctccacggcgacatcggcgcgctcttccccggggacgtgctcgtgctcctctccaagtccggcgcctccgacgagctgctcgcgctcgtgccctgcgcgcgcgccaagggcgcctacctcgtctcggtcacctccgcggcctcgggggccgactgcccgctcgccgcggcctgcgatctcaacgtccacctcccgctgagggggaggtgtgccccttcggcctcgcgcccgtcacctccaccgccatccagatggtgttcggggacaccgttatcgccgccatcatggaggcaaggcgactctccagggaccagtacgcctccaaccatcctgctggcaagatcggcaagaccctcatnttcagggtaaggatgtcatgaagaaacagaatgaacttcccctgtgcaggagggagatatgataatgtaccaactcaccgagctca

SEQ ID NO: 14911 - DNA, 329 bp, Zea mays
  unsure at all n locations
  Clone ID: cC-zmpo14820002f04a1
caaactaatgattttaaaaggaaatatcatatatattgcatcacaagattacagaacgacttgacgcgaacacatgaattttaaatagtaatgtctacgtaataataataattaaataacacaacccgttaccatgcatgcatagatattcatatcagaccagtagtactatatgggaacagcgttgcaagtgacgtcgtccatgcatgcatagatgttcaacagtccatgcatgccaatgccatgcgcgcgtgcgtccgtccgtccgcttagtgcaggtagtngccgaggagggttaacacgatcgcgttggacgctgcatgcagggc

SEQ ID NO: 14912 - DNA, 145 bp, Zea mays
  Clone ID: cC-zmpo14820002f04d1
gcgtacgcttagatggctaaccagcggcctccattttaagccagcacatttcaattttaaccgagagaccatagtcctcttgcgggccgtgcgccttcgtacctcccctccaacctgtgagaaagatggagatgatcaagatgat

SEQ ID NO: 14913 - DNA, 351 bp, Zea mays
  Clone ID: cC-zmpo14820002f05a1
ggggaaaaccacccaaaaaaaattttgggttcctttcctttttcagaaacaaatttggaaaccaagggaaaaagaattggggtttaatgccaaccaatttggaaaaaatgggggggggccttaaaaaacggctataaaaaaataaacgggggggggaaagggctattaatgaaaggggggggcgccccaacccaaatttttgaaaaaccaggggcaaaagggccagggcaccctctttagggaacccaacgggttgggggggcccaagttgtcctttatacccacctttctggggaaaaaaaaacccggccgggccctttccccccgcaactggagaaaattctttggggg

SEQ ID NO: 14914 - DNA, 360 bp, Zea mays
  Clone ID: cC-zmpo14820002f05d1
acccacgcgtgcgctaccctagttgtcgtctcactcaccccgccttcacgcctctttcacctaataaggtcccgcccttttccgacagggacaggggggacaggaaatcagcggccatggcctcgattccggcgacagaccttctccgtcatctttatcgtcctcttttgtgccgcggctggcaccgtcgtcaactacgacctcccccgacttcgttattcagtgccgcgtttattgcgaacacctgccgcgccgggttcgtgaccaatgtcacctagttcatcgcgggcgccaaggtgaggctggagtgcaagctcttctgtaccggcaagctcgaggctccatcgacggggtgaccga

SEQ ID NO: 14915 - DNA, 509 bp, Zea mays
  Clone ID: cC-zmpo14820002f06d1
gtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctttgctcctagcaaggatgcccccatgtttgtcgttggtgtcaacgagaaggagtacaagtctgacattaacattgtctccaatgctagctgcacaaccaactgccttgc

SEQ ID NO: 14916 - DNA, 429 bp, Zea mays
  Clone ID: cC-zmpo14820002f07a1
ggttgtcatacttatacattaatcatcaaaagttgagccacatacatcagtatacacctcagatatgcgaagcaagaaacatcagttgccatgcatacagtaacgatcgacgaccaatgtataatgcatgtgtgtaatatatacacacacgcggcaccacacgctaaggcctggtacctgcacgcgcgtgcgacattgacattgcgcgcacatcgaccagagagatatgatcagccgcgacagccggtgatcgggttgcagccgcgggtgtagtcgttggcgggtttccctgggcgggaggcctcggggcccaggttcttatcgcagttgcccagtaccttgcagctgatcaaattgtcaaatgacaccatcccctcggcgctgacggccccctgcggccctgtcgctaatagaaggcacagaaccacc

SEQ ID NO: 14917 - DNA, 509 bp, Zea mays
  Clone ID: cC-zmpo14820002f07d1
cggaattgctttgtcgacccacgcgcccgagcttgctcctcgatccatcaattgcaagaggagcaagataccacctccgtagcaccacacgcaggtacgaagaaggcgacgaacatggcgaggctggccttggtagcggcggcggttctgtgccttctattagcgacagggccgcagggggccgtcagcgccgaggggatggtgtcatttgacaatttgatcagctgcaaggtactgggcacactgcgataagaacctgggccccgatgccttccgcccagggaaacccgccaacgactacacccgcggctgcaacccgatcaccggctgtcgcggctgatcatatctctctggtcgatgtgcgcgcaatgtcaatgtcgcacgcgcgtgcatgtaccaggccttagcgtgtggtgccgcgtgtgtgtatatattacacacattgcttacacattggccgtcgatcgttactgcatgcatggcaactgatgtttcttgcttcccatatc

SEQ ID NO: 14918 - DNA, 557 bp, Zea mays
  Clone ID: cC-zmpo14820002f08a1
gtaaataaatgataacaatagcatcatggactaagttaacatgattacggatcacatgtagaacttcacaacaacagctcccaagctatacagcatcacatccaaggttcatcaagaacacatactatggatgagcacaagctgctgagaccatcctccgactgttttttttctacaacacatctaaatatcataacacgcacagaactgtgtatcacacgcctatgctgccgagccagaagaacagggggaactgcactatcgccatgaagaggaggaagtaatgctgccgcgacgagtgcctctcgctgctcctcatctccgtgaagagcaccctcttcatcgtcctcaccaggaacacccccatgcacaggctcatccacggcatcatcacgtaatacgagtacgcccaaacgagcctcgcgacgacggcgagcgagagcccggcgaataaatagccaccgtacgctaccaggtcgagcagtggcacctcgccgccacccattgagtagagcaggcctttcaggaccgtgagctggaagccccatccgatgagc

SEQ ID NO: 14919 - DNA, 536 bp, Zea mays
  unsure at all n locations
  Clone ID: cC-zmpo14820002f08d1
gacccacgcgtccgcggacgcgtgggcaagttgaaagtcatactgttcccgttctttcacagggggcactggactcgaataagcgagccggtcggtggacggttgtcctacaagcctccaatatatgacataaatgcgccggatctgtacatccctttcatggcatttggaagcttcatcattctttcagggtttacattgggtttcatgggaaagtttactccagaagctataaacctgcagtttacaagggcgctcatcggatggggcttccagctcacggtcctgaaaggcctgctctactcaatgggtggcggcgaggtgccactgctcgacctggtagcgtacggtggctatttattcgccgggctctcgctcgccgtcgtcgcgaggctcgtttgggcgtacttcgattacgtgatgatgccgtggatgagcctgtgcatggnggtgttcctggtgaggacgatgaagagggtgctcttcacggagatgaggagcaacgagaggcactcgtcgcggcagcattactttct

SEQ ID NO: 14920 - DNA, 450 bp, Zea mays
  unsure at all n locations
  Clone ID: cC-zmpo14820002f09a1
aacgaaaatagaccggaacaatatatttcacccaaaagaatcttaaataagcagtgtatttcaattcatgtaataaaatcaaccaacacaacaaggcacaggaagagatggtgttgtgccacaaaataaccatagaaaaaatttaaatattggctcgttggcacgtggactagatgagctctttcgaaatattattcgtcatcacttatcagaggctgattagatgctgagagtggtcttgtaggtggtgccagccttgaaatcggcggggatgacatcatcggcgatacggtagccgccagacttggtagcaaagcggatgcagagggggtacttgagcggngccttggtgtcnagcgtccaagtgccagctgggccctctttgagtgtaaaggagaaatcgtcgccgccatgctccttgatctccacgtcagagatggtggcaatgta

SEQ ID NO: 14921 - DNA, 519 bp, Zea mays
  Clone ID: cC-zmpo14820002f09d1
cgggaggacccacgcgtccgcttccatgtggggaagggctccaagcctggccacctggttctcacccctaacattgccaccatctctgacgtggagatcaatgagcatggcggtgacgatttctgctttacactcaaggagggcccatgtggcacttggacgctcgacaccaaggccccgctcaagtaccccctctgcatccgctttgctaccaagtctggcggctaccgtatcgccgatgatgtcatccccgccgatttcaaggctggcaccacctacaagaccactctcagcatctaatcagcctctgataagtgatgacgaataatatttcgaaagagctcatctagtccacgtgccaacgagccaatatttaaattttttctatggctattttgtggcacaacaccatcttttcctgtgccttgttgtgttggttgattttattacatgaattgaaatacactgcttatttaagattcttttgggtgaaatatattgttccgggctattttcgtt

SEQ ID NO: 14922 - DNA, 374 bp, Zea mays
  Clone ID: cC-zmpo14820002f10a1
gggagcttggcatgcatattatcatcacaagcgagcacaaaaagatcttattcaacaccaacaacaacaacattgttgtctagttcaggtagaggcgtagagcaaattctggttgcatgaaacctgaaaaccactacagcagcttccatttgagctcttccctgatggcatgaggccgactcgtttgtctgtccccggccctgaaaaaacacctgctcatcaggagagctagctcacgggccaactcctttgatatgtttccagcatctttttttgctctggggtaagtacgtgcaaatctgatgggcgtttagttgtgtccatgccgggtctctgccatcagtgctcgaggtactccaaaccaggtaaatgga

SEQ ID NO: 14923 - DNA, 418 bp, Zea mays
  Clone ID: cC-zmpo14820002f11a1
gacttggcttgaatttcatgctgtccccaactgtacattaatagggcaacacatgaactaccctgactgaccctgaccccattaattgctggtttaagttgttacaatccgacattcacaaagaggttgaaaatgcgattgcttcgtttccttcacctgctggctgcagcaggagggatgctgagccactgcagctgcagctgaatctccccgctctccacgttcctgagccggaggatcatgtcctgcgcgaacttgccgttcctccagcacacgtggctttcgtcggcgaggcagttcgtggcgctcggccgcaccgacaggatgatggcgccgttccttaggctcgcctccgggctcgcgttcgccgccttcaccagcggcgccacgtagatctccgcgtcccccatcgggtcgt

SEQ ID NO: 14924 - DNA, 336 bp, Zea mays
  Clone ID: cC-zmpo14820002f11d1
tgggggacccacgcgtccgggacgaaagaagtgatctaattctttggaccgaattatgcgccttttttcgtcttacgctccgtctttatttgttatgggaagcgggcaggaacatttcagtggatcatggacggatcggtaaagccctcgaaagtccggttggcgaggtgcattaaccttgcctaccgagacgcacgaggcatccgatctcgtgtgtcgaactacaacttggcaagaacaaacttaatacgagcgtgaagaagagatatgtgaaccccatctgggacgaggagcttactcggtccgtcatatatcctagcctagctttgaagctgg

SEQ ID NO: 14925 - DNA, 423 bp, Zea mays
  Clone ID: cC-zmpo14820002f12a1
gtattcatccgtaaatgttattaccgtgaatgtatcaatgctgaaagagatgcaacacagatagagaggcagcagcagggaacactttgagcagttacgagggtaatatacacacaagaaccggattggaagtaaaagcagcagcagcagcgtctcggcccaccctttgccgtggatctccctaccgacaacccagtccgccgcaaggcccgcgttgtcccccaacccggcgatgtcgttctcgtcatcgaagagccagctcctcaccagcctccacgcctcgtcggtcactagcacatcatcatcgcacgtgccaactcccggagcgttggaatagtgccgtgcggtgcaagggtacgcgcccccccagactttgctctggccgatgtcgagcagggcggcgttgacagagtcgattaggag

SEQ ID NO: 14926 - DNA, 601 bp, Zea mays
  Clone ID: cC-zmpo14820002f12d1
ccacgcgtccggcgagaaatcccccatttcatcagaaagcgcgattactgctaaactagagcctctatccaggtctataccaatcggatcgatcgcgaggaccttatcatgggacgacgcttcccaagaggctcctccgcagtgttctaccaaaggagacagcaaccacgagcaggagcagcacgagttcgtcgagaagacgctggcatccgctggcttctgcaacgagaagacccaggacatctttgcccggtggcattcgctcgaccggcccttggaccccgccgtggtcgagcagctgctggaacgcaaggtggaggacgccaagtgccgagagaggcggtcgaaccagaggctcctaatcgactctgtcaacgccgccctgctcgacatcggccagagcaaagtctgggggggcgcgtacccttgcaccgcacggcactattccaacgctccgggagttggcacgtgcgatgatgatgtgctagtgaccgacgaggcgtggaggctggtgaggagctggctcttcgtgacgagaacgacatcgcccggttgggggacaacgcgggccttgcggcggactgggttgtcggtagggaga

SEQ ID NO: 14927 - DNA, 589 bp, Zea mays
  Clone ID: cC-zmpo14820002g01d1
atcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtttcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaaccatcacgt

SEQ ID NO: 14928 - DNA, 541 bp, Zea mays
  Clone ID: cC-zmpo14820002g02d1
cacgcgtccgcgcagctgcttcgcttcttcttctttctatatacatatatagacctaataagatcaaagacgtacgataacctgcttattttgcgacccatcccgttcccacgcaaaggcgccgagcgtgatctccgtccgtgccgccatggcctttgaccgggcgctgatgatgctgctcctcgccgccgtgctcgtcgctgcgctggcctatgtcgcatccgtcgacgacgccaacgccatgcccaccatcctgacccccgtggcgcataccccgctggggtccttcgacggtgacaagccggcctctgacgacgacgccgttgacgacgacgaggacgccgcccctgtcggcgcgcccaacggggccaccatgactgagcccagggacgacgtccccgccccgcccggcgccgaagcaaccgtgggcggcgccgacggcagcaacgcgcccgtcgcactcgccagcgccgcggcgcgcgtctgctccgacgtccgtgtcgccgcgggagccttcgccttcttctgaggagcggagact

SEQ ID NO: 14929 - DNA, 469 bp, Zea mays
  Clone ID: cC-zmpo14820002g03a1
aattgattagggggcggggggcaatcctgggagacaggaagggagaccggggggagaaaaaactgctccaaaggggaagcaaaaaaaaacgggggagggcaaaaaaaaaaaaaaaacgagggagaaaaaaaaaaaaagggtgaaagccggaaaaaaaaacaagcggaaaaaaaaaaaaaaaaaccggggggggcaaaaaggggaaacaaaacacgaaaacggaggggccacaaaaaaccaacatacgaaaaaaaaaacgggagcggcccgtgcaaaaaaaaaaaccaccaaccgcgggaaaaaagacgcaaaaacgggggcggggggggggtaatcttttccgccaaagaaaggaggaaagatagatgcccccaaagaaaaggcccaaaaaaaaaaaacccgggggccaaaagaatatggacaaaaaaaaaaacctttttgggggggggaaaccaaaaaaaaagggggg

SEQ ID NO: 14930 - DNA, 515 bp, Zea mays
  Clone ID: cC-zmpo14820002g03d1
tcgccctcgcgtccgaaaaataaattaaaaaaaaataattaaaaaaaaaaaaaaaaaattaaaatttaaaaaaaaagaaaaataaaatgtaaggttgatgatttaatatcggggggccctctcttaggtttcctggctgccgtcccttagttggctcttatgacctgtccttcttgggtccccttctggcatttccttgggcgcccttatgcccgcgtgcggtcggggattcccctgccgtcccccggtttatccccgggttggcccctcccctttgccccctgggatctttccccttgctgcccttgcgcttgggcctcttcttgcttttggccctcctgttcggccttgggccgcccccctcctgggggttctatccccctgtggtttggtcttttccgcccggggtcccctttttttttttattttccctcccgcccggtcttttggccctctccgtcttttctttggcgatttcccgggttttcctcctccggggctttcgggggcccccc

SEQ ID NO: 14931 - DNA, 435 bp, Zea mays
  unsure at all n locations
  Clone ID: cC-zmpo14820002g04a1
gcaaggagcctcatcaggcattttattaaaattgaatagggcgaacatgtgtccaaaatgacaagggagaagcattaggtagcaacaatagacattacagtcttgatgaataggagaaagcgggtgccgacagaccggcagaaaactttgttcatgctaatgaagaaacagcaacaaaaggagaaagaaacggggcgggaggctggcgataatggctcctctcggcttgcatttcttgggcccaaagaattaaaagcatttcctgtgcacgatggacgggccagactcgttgtactcagccttggcaatccacatttgctggaaggtgctgagcgatgccaggatggatcctccaatccagacactgtacttcctttttggaggagcaaccaccttgatcttcatgctgctaggagcccgggcggngatttcctt

SEQ ID NO: 14932 - DNA, 550 bp, Zea mays
  Clone ID: cC-zmpo14820002g04d1
gcttggtgcacccatgcgtacggctgctggcattcacgagaccacctacaactccatcatgaattgcgacgtggatattaggaaggatctgtatgggaacatcgtcctctccggtggtaccactatgttccctggcattgctgacaggatgagcaaggaaatcaccgccctggcttctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaagccgagaggagccattatcgccagcctcccgccccgtttctttctccttttgatgctgtttctctcattagcatgaacaaagttttctgccggtctgtcggcagccgcttttctcctattcatcaagacttgaatgtctattgctgctacccaatgcttttcacttgtcattttggacacatgttcg

SEQ ID NO: 14933 - DNA, 319 bp, Zea mays
  Clone ID: cC-zmpo14820002g05a1
gcatcaattcgttaaattaaggagaaagagggaacaaagaaaaagaggacaaaaggtgtgtcgaatcaaaaacatgcccacgcatcggaatgcgcgcagccatgtcactctctctcccgcttcgtctcttcctcggcctccgggcgaccggccgcggccggctcactgaatgtagtaggcgaagaaggaggcgacggcggccccgagggcggcgccgacggcgggcgcgacggcggaggagccgctggtggggcccggagccggagcctccgcggcgagcgccacggtggccgccgaggcggcgacgaggacggcgcag

SEQ ID NO: 14934 - DNA, 325 bp, Zea mays
  Clone ID: cC-zmpo14820002g05d1
ctgcgccgtcctcgtcgccgcctcggcggccaccgtggcgctcgccgtggaggctccggctccgggccccaccaggggctcctccgtcgtcgcgcccgccgtcggcgccgtcctcggggccgtcgtcgactcctttcttcgcctactacattcaatgaagcctgtcgcagtcggtcgccctgtggccgacgaagagacgaagcgggagatagagtgacatggctgcgcgcattccgatgcgtgggcatgtttttgaatcgacacaccttttgtcctctatttctttgttcccctctttctgcttaatttaccgaattggatgcat

SEQ ID NO: 14935 - DNA, 422 bp, Zea mays
  Clone ID: cC-zmpo14820002g06a1
gcaaaacttgaaaatgggctgttgtttccctcgtacaaaaaaaagaactggagccccggtggtggtgttacaaaacccggaaaaccaagttggggggcagctaaagctaggggtggggggccccactggccccgggacgggtggggattaccgaaagcctgacggtttggggaacccccaacacatgttggggagcaggacgtcccccattacggggggggtgaatatcactggaggtgggagcttgacgttcctccaccacatggggttcctgaagcggcgagcttggcgcttgaagcccccccggttcccctgcatgggtgccggtttgtccaccaacaccttcagacggtgaccccttttcagcaccctgtggatgttgtccattataacgctccggacctggtgcattttttccctat

SEQ ID NO: 14936 - DNA, 462 bp, Zea mays
  Clone ID: cC-zmpo14820002g06d1
ctactccaacgacgccagcgcggacaggataaatcgcatgatgggagagatggaccaggtccggagcgtgatgatggacaacatcgacagggtgctggagaggggtgaccgtctggaggtgctggtggacaagacggcaaccatgcaggggaacacggtgcgcttcaagcgccaagctcgccgcttcaggaacaccatgtggtggaggaacgtcaagctcacagctgcagtgatattcatcctcaccgtaatcgtgtacgtcctgctcgcctacatgtgtcgcggcttcaccataccgtcatgctttccgtaatctccatccgtcccggtgccagtgcggaccaccagccctagctctagctgcctcacaacttggttttccgggttctgtaacagcagcagcggtgctgcagttctctctcttgtacgaaggaaacaacagctcattctcaagttctgcaa

SEQ ID NO: 14937 - DNA, 460 bp, Zea mays
  Clone ID: cC-zmpo14820002g07a1
tttttttttttttttttttttttttttttttttttttttttttttttttgtttttttttttttttttttttttttttttttttttttttttttaaaaaggggcccggggggaaaaataaacaaaaaggggttgctcattaaacaggggccctttaaaggggaaaaaatattggcccccccccccaaaaggggaaaaaagggtaaaaatatggtttttagggaaccaaaagggccaaaattccccgggaaatttttttttgcagggaaaaatagggggggggggggggtgcctgcccccggcccggggggtaaagggggggaggggggaaaaaattggcctggcacgaccaaaaaaagtgacccaaagggggcgttaggtccgggcgggaaaaaccttggaaatggggggaaaaaccgcaaattttccttattttcaccccgggccccggggggtccaacc

SEQ ID NO: 14938 - DNA, 436 bp, Zea mays
  Clone ID: cC-zmpo14820002g07d1
gcagggtcgagatggagggcggtcagtactgtcggagaggcacgcttgtcatcgaggcagagatcttcgaggtggagccatcggtgcgcgtggtggagatgaggaagattggcggtgactcgcccgagttccgagagttctacaggcaggaactgaagccatcgttaggtgacattgtatggtcgtggcagggcagtgattcgcctcctactcccttgctgccgccggcgccgaggcaggcaaccaaccaacgtccataatttcctctgcataaaaaaatttgcagtggaattttggcacttatggttcactaaaaacatgatgttaaacatattgtcactattgagggtggctggcaaatgatttgtcactgtcatagggacgctgtactagtagcataacatttgtgataatatatcatcacgggctcataatt

SEQ ID NO: 14939 - DNA, 493 bp, Zea mays
  Clone ID: cC-zmpo14820002g08a1
agtcaagcaatcgtcgcatatagtacaagatgtagtaataatatattacacacacgtacatatatgccgcccatccaaatccgatgtatataggaagaggagtatgtgcccgaccgggccgctgtctactagcacggctggccgacgatgcacttgagtggtccggcgaagcgcgtgagctgaccgacgtagcggccgtgcttggccgggatgaagtcgaacctgtcgtacttgcgctcgttctggccgccggactcgttgaagaaggcgccgttcatcatgacgtcgccctgcgacttccacacccactccttgtagtccttgtacggcgtgtactcccgcttggtcacctccttggcgttggggtcgtcgggggcgatgaagcggttgccctggctgatgatggtggggttcatgttgccgccgatggcgtacatgatccagtgcgtgtagtcgttgttcaccacgtggaagaagccgtagcggcagcgcg

SEQ ID NO: 14940 - DNA, 572 bp, Zea mays
  unsure at all n locations
  Clone ID: cC-zmpo14820002g08d1
gcactcgggcggtatgatccgcgactcgaagcggcactacgggctgcgcacgcggagcgacggcgacggcgtctccgtgctagtcgggcatgcaacagtagtgtgatcagatccacagtcgtaccatagtgccagcatgcatgccgacatgagcttgaatcgaacagtgtgtgacactgggttcagagcggacagtcatcctgcgtaacaggcatgcgcagctatcacnctgagccacagatccatcgtagatagcgtgtttctggacgccaagcaaagcgactaggcgccgtcaggaatcgcgcgctgatcgccaggaccatcggttggcagtaccagaccactctttggccagtggccgtggacgccaccggagtgcccgcgctggacgatacgagcttcttccacgtggggaacaacgactacacgcactggatcatgtacaccatcggcggcaacatgaaccccaccatcatcatccagggcaaccgcttgatcgcccccgacggaccccaacgccaaggaggtgaccaagcgggagtacacggccggcactgactaccaggtgtggg

SEQ ID NO: 14941 - DNA, 289 bp, Zea mays
  unsure at all n locations
  Clone ID: cC-zmpo14820002g09a1
aaaaaggcaaaccccgtacaaggttccaatacaatgcctgacccctcacaaaggaaaaaggacctcatggtaaggttttgggatgtaaaaatacaacataacgccctgttatttttaataatattacagggctttaaaccaggtgggaaggcaaacaaacccccaaatttttgtgtcgcctccaccattaatataattgcctgcctatttttttatttatatatatatatatataaaaaaaaaaataaannngnntnggnggttggctggacccccccccccgctttcg

SEQ ID NO: 14942 - DNA, 428 bp, Zea mays
  Clone ID: cC-zmpo14820002g09d1
ggatgaacccatcacgcacgcgtacgcatggtcggatgcctaggacgcgcgccacccaatcattttgtttcttttacatatttatttatataaatatacataaatggacagatatttatgaaccaattcattttggaccgaatcttgtagctggggatgatacctggatgtatccgacctgatgttgtgcatttggatactagctgctatgctcgggggtgcattgttatatatacacagaccgactgagaactcaactggctgatacagctaaagctcgacaggcataacgcctcgtatgctttaccatagtgtgcaacttgacacatgcactcatgatcaaaccaatagaacttttagagtaaaaacagccaggctctgctataatgtcatgcagaacagcccccgaggaccttctcaccgagaaa

SEQ ID NO: 14943 - DNA, 491 bp, Zea mays
  unsure at all n locations
  Clone ID: cC-zmpo14820002g10a1
agcaaactgatacagcattggaattcattggaaggggatatacaagtacagagtgtatgcaagggaaatagagcagatactgcaacctctcaagtacggcaatacttattaatacagcttatcatatattttatcgctcagggcattgttgatacatgtttttctacaggtttgcacccagatattgtttaagagctcccaagcagcttcttgatatccttctcaatgctcaaaggtgaagtggttggagcatagcgatccacaacacgtccctccttgtcaaccaagaatttggaaaagttccacttgatgctgtcgccgaaaaggccacctttgctagatttcaggaacttgtagatgggcgcagcattgttaccgttgacgtcaaccttgtcgaagatggggtactcagccttgaagcgtgtgcaggcaaactggacaatctnctcattggtaccaggctcctgcccaccaaactggttgcatgggaa

SEQ ID NO: 14944 - DNA, 414 bp, Zea mays
  Clone ID: cC-zmpo14820002g10d1
acccacgcgtacgcttactgataacgtgacaccccagatgaggctgcactaactttattttcactgagccggcccagctcttcgagaagtacatggaccgagggtttgatatgctggctttcctgtgcaaccaaatcgttgagcaggagccttgcaccaatgtggacattgtccagtttgccagtacacactctaatggtgagctccgggtttgctagaggttgacgacagggcgactgtggtatgaaccagcttcatatgtctgaaataaatcagaggcgggcttgtcggcgacggtcttattgggcactatgacacatgctcggatgaccaagacgaacgtgctgtggaaggctatacttcaaccaattggtctttgggcattgagaaggatatcaagaggctgcttgggag

SEQ ID NO: 14945 - DNA, 380 bp, Zea mays
  Clone ID: cC-zmpo14820002g11a1
atcgaactgattcagttttttaatttattggaaggggatatatttatacaaaaactttgcaaggcaaataggataaatgctgcaaccaaacgggacctgcacaaaatattaatacatcctaatcatacgttggataccccacagaatttttgatccatgcttttctccagggggggcacccagatattatttacgaagctcccacctggccctagacggccacctaaataataaaagataaaccggccggggcctagggaagaggaatacatccttctttaccgaccaacaaccctggaaagttccaattcttgcttagggcgcaaaggccagcttagctcgatacaaggaacttggttatgggcgcagcaaaattacct

SEQ ID NO: 14946 - DNA, 392 bp, Zea mays
  Clone ID: cC-zmpo14820002g11d1
gggtggacctcacgcgtccgcggactcgtggggtaaatttcttctgagtctgctgccactattggtccatgttgctgcacagcttgttaacttggggacccttctaaggatggaatgcgttgattattccctgcacacccacaagacagctggacatatataccattgtgaagatgctccctcttgaaagtacgcacttctaagaggagtacaacctgttcttggagggtgactcttacgaatgctatgctgaacccatctacctcttgctggtatctaccaaaagtgggatctgggggcccggtgtcaaacagaacatttttaaattcttggttgacacagaagaacggcgttgccgaggcgccatgaattaaacatcttttgcgctgagc

SEQ ID NO: 14947 - DNA, 106 bp, Zea mays
  Clone ID: cC-zmpo14820002h01d1
aattaaggccccatgcatcatgcatgcatgcctaagctacctcccatttctttgcttctacaatgcatgcatgcagatattaattaatcatcatcaatcagcatgt

SEQ ID NO: 14948 - DNA, 507 bp, Zea mays
  Clone ID: cC-zmpo14820002h02d1
cgcgtccgtttgagacctgcgttgtcacccacccatcgaggttggggccgccagctggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgcaagtgcttctgcaagaagccttgctagttcatcggtcttgctaattgttgatgggtgcttcattaatttgatttgatgggtctcatggctacgagaaaaatatctaccctaaccca

SEQ ID NO: 14949 - DNA, 451 bp, Zea mays
  Clone ID: cC-zmpo14820002h03a1
atgcttgggcgaattatatattgtagtgatgataattttgaaggtatactgagatcaattaattgtacaagatccatgcttggctcaaaactggaagaagctagctggaaatcatgagttcagttggtggggctcttcttcttcttcttgttcttcttcttgaggtccgtggcatagtagttgcatgtgatgaagacgcctcccttgaagcactctgctcgtgcgcatcccaccttggtgctcctcttgccgaccatgagcgcgaagtggccgcactccttgtacgccctgccgcctgtgcactgctccgtgttcctgtcgtagatggactcctccttgccccaccagaagacggcctccttggcggtggcgttccagtcgtcgtggctcctgaacaggctctcgccgtacttgtgggcgctgtggacgagctcgcagtccttgcgcatgc

SEQ ID NO: 14950 - DNA, 581 bp, Zea mays
  unsure at all n locations
  Clone ID: cC-zmpo14820002h03d1
gcgtccgcccacgcgtccgcccacgcgtccgctgagaccgacagtagcagcggttaatcttcttcgtcgtcgtcgtcggaagaggccggcgagaaggagaaggagaaggagcaggagatggagaaggcggtcgcggcggagaaggctgcccagcatgtgctgctcaagtacgccaaggagaagggcatcgtgtcaccgaccaacggcacggggtggtacaagggcatcgcccgggagttcgtggacgcccacatcgagctccgcgcgcgctacggcgtgccgcccatgaagtgggacaggaagctggcgcggcaggcgctgcgctggtccaaccgcatgcgcatggactgcgagctcgtccacagcggccacaagtacggcgagagcctgttcaggagccacgacgactggaacgccaccgccatggaggccgtcttctggtggggcaaggaggagtccatctacgacaggaacacggagcagtgcacaggcggcatggcgtacaaggagtgcggccacttcgcgctcatggtcngcatgaggagcaccatggtgggatgcgcacgagcagagtgcttcag

SEQ ID NO: 14951 - DNA, 324 bp, Zea mays
  Clone ID: cC-zmpo14820002h04a1
aaaaaaatcagttcatgacaaaccaagggcgccaggaccttttttttggtctttgaaaaccccgggaaatccacctttcgggggcctatttttttggtcgtcaggcaatgggggaaaaactggctggggccattttttttccttccatgcgggggggcaacttttttgcccggcctgttgatgagcaacttcaacactttacaaattttttttttttttcaatttttggccccaaaggggctttttgccttgggaaaaccattggccggccggaacaacccgtccatgtaaacaaatgtcggggcatatttcccttactttttg

SEQ ID NO: 14952 - DNA, 330 bp, Zea mays
  Clone ID: cC-zmpo14820002h04d1
cgcgtacgcacaaagtcagggaaccatgcctccacatttgtttacatggactggttgttccggacggacaatggttatcgcagggcaatgagaccattgaggagcaagaagcgaataagaagaagaatctgtacagtgttgaagctgctcatcaacaggactggcgatagagttgcgcctcatcatggaaggagagaaaatggacgcagtcagttattgcctcattgcctgacgaccgatactataggctcctgagatgttgatttctctgtgttctctatgatcaagaacgaggtcctggcgaccttggtctgtcatgaactgaatttg

SEQ ID NO: 14953 - DNA, 424 bp, Zea mays
  Clone ID: cC-zmpo14820002h05a1
ggagggacttggcttggatttaatgctgcccccaactggacattaataggcaacacatgaactaccctgactgacccaaaccccattaagtttacaatccgacattcacaaaaggggaaaatgcgattgctttgggtcgcctgtttttcctttctttacctgctggctgcaaaaggagggatgctgacccactggagctgcagctgaatctccccgctttccacgttcctgaggcggaggattatgttctgcgcgaacttgccgttcctccaacacacgtggtttttgttggcgaggcaattcgtggcgctcggccccacccacaggatgatggggccgttccttaagctcgcctccgggttcgcgttcgccgccttcaccaacggggccacgttgatcttcgcgtcccccaatgggtcgtccc

SEQ ID NO: 14954 - DNA, 495 bp, Zea mays
  Clone ID: cC-zmpo14820002h05d1
atttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgtagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcaggacatgatcctccgcctcatgaacgtggagagcggggagattcagctgcagctgcagtgggtcagcatccc

SEQ ID NO: 14955 - DNA, 440 bp, Zea mays
  unsure at all n locations
  Clone ID: cC-zmpo14820002h06d1
accgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgatgcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgcgttgtatataactcttgtgtttggaatgccgcccgtaattaatggtcaactctaacactgcttgcctttgcctgccggccagcntanatactatatgtttaacaaccttattcct

SEQ ID NO: 14956 - DNA, 471 bp, Zea mays
  Clone ID: cC-zmpo14820002h07a1
ccaaaagagaccaaatagttggtatcatccatgatccatcgtacaccattttctagaatagaataggatgatgacagggcacacaaaccaggaggcgcatcgcttacaaaacaatttacaatacacagctgcatggcaaagctcttctctgcgccaaggcgttggcagtcacgacacagcaacaccaacgctccacaagacggtcctttttcgtgaacccaaagttgtcgcagcgatgggaaatcacagtccggatcgctctgctgctgcggcagcgtgggaggccgacgaggcagtatgggcggttgccagaccggctgtgcagcaaggggttcagagccttgacgacgatgctcatgttgggacggaattaccctcgtattgcacgcagagggcggccacagcagccatcttggctacagcctttggaggggtattcgtctccgagctttggatcgacgcattgcctca

SEQ ID NO: 14957 - DNA, 554 bp, Zea mays
  unsure at all n locations
  Clone ID: cC-zmpo14820002h07d1
gtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgcagcagcagagcgatccggactgtgatntcccatcgctgcgacaactttgggttcac

SEQ ID NO: 14958 - DNA, 261 bp, Zea mays
  Clone ID: cC-zmpo14820002h08a1
aaactataataaaacattcagttacatatcttttatcagagtcacacaaaaaatcccttggtaactcaaaacaagagactgtttggactgttcgcttcggattaaaatcagctatttagactgttgtagctgtaatccatagagacaaaaacaatatagaagtagtagaagccggtacggattgaaaccaaacgaacaggctgaccgatgtagcatgtcactcaaaggtcgtccttgactccgatgtttagaagtctagcc

SEQ ID NO: 14959 - DNA, 340 bp, Zea mays
  Clone ID: cC-zmpo14820002h08d1
gggctaagatcttctataacattcggagtcaatggaccgaccctttgatgtgacattgctatcatctggtcatgcctgtatcgttgtggtttcaattccgtagccggcgttctactatcttctatatttgtgttttagccctctattggattatcatgctacaatcaagactataatagcctgacttttatatcccgaagacgatacatgtccataacaagtgctctttgttttgcagttaccaagaggatctttttgtagtgacctctgataataagatactgtaatctgacatgttttacttactagcttaacataaaaatcaaaaatagaaaactgt

SEQ ID NO: 14960 - DNA, 416 bp, Zea mays
  Clone ID: cC-zmpo14820002h09a1
gggggggcaaatatactcgagggcaaaacgacgggccagttttttgcttaaaaacctttccctttacaataccattttaacgccgatccttttttttatttagggcaagccaaaaggggaaaaaaaaaccagtttcaacacagcatgctttgttttataagttataaccggggcactttatttctggaaccaagtttaatgccatgtagggggggagcttaatagaagctttttgtttccgcactttccgccccctcaaaagactatgccccatatggctttccaaaaaaaaactgggcttcctcattaatcatcgaggtagtagtaggacccggccgacttttgttccctgtcctttggaaagcccaacttgtttatacggggcctatagttgggcgggtcttttttaaaagtaa

SEQ ID NO: 14961 - DNA, 229 bp, Zea mays
  Clone ID: cC-zmpo14820002h10a1
ggtgtaaggaaaaaaaccccggggccttttcgtgggaaacgccccccaagggggaaaaaaaaagggggagggcaaaaaaaaaggggggtttaagccaaaaaaggtgagaaaattggggaccccctgggaaacggaggggaaaaaatcgagaaaaccggacacaaggggggacccgggggttccgggggggaacccggaggggaaccaactggccaaagggggggggggg

SEQ ID NO: 14962 - DNA, 394 bp, Zea mays
  Clone ID: cC-zmpo14820002h10d1
ccccgggtagacctacgcgtacgctctggacgctaggatccactgcgactcccccgcgatacccaagagacacagtttctatgacgacttctgaagttttgactcgtgatgatagagtaggttacaaagatcataaacgtttgtagcgaaaaggcccaagtttttgaagcctaacacttgtctttgtaccaagtggggctatactaactgaaagtcaatggtggttactgaggagctgggtagattgaaactgatgaaaaacttgggacgccctgcaaaatttgggcgctttgatgcttcaccacccgcaccaacgctggtgcgcgtgccaatcaacgggggggggtctcttttaggggtggacaaatcctcttgagctcgggctaggtctttt

SEQ ID NO: 14963 - DNA, 461 bp, Zea mays
  Clone ID: cC-zmpo14820002h11a1
aacactaatttgcaccatttacagaatcagctttagcttacagggactaaccaagtctgaaaaatatcagttaatgatgcaaagccagcatcgatgcatcataaacgatgactgaatgagccatgcgtgtgtgtttttataagctgagacgtagtaaaatgtagaagatcccatacagcgctgcctgatcagggttgggagcttgcatctgaagtggcagcaggaggcggcgaaggcttgcttctttggcggctgaacaagttgtgcttgtgccaagcggcagcgacgatcgacaagccactgaacctaagccatttggttccccctttaggttgagagacctcgttggagtcctgtgccttgtttgccgtgatttcgctcctattgctcagctgtcgcgccgtcgctcttgatctgacgggtgtcatcggcgtcgatggcatcagccacgatcctatcga

SEQ ID NO: 14964 - DNA, 596 bp, Zea mays
  Clone ID: cC-zmpo14820002h11d1
cgggtctgctggcgccgccgcaccagcaggaagggcaggaggccgtgtcgtcgtccgggggcaggaggcgagggtgcaaggtggcgccggagcccaaggagctggaggaggggaccgccgcgctcccgtcgatgcccggctcgccgagcttcaggtactactgccagaagaagacggcggccgtcgataggatcgtggctgatgccatcgacgccgatgacaccgtcaggatcagagcgacggcgcgacagctgagcaataggagcgaaatcacggcaaacaaggcacaggactccaacgaggtctctcaacctaaagggggaaccaaatggcttaggttcagtggcttgtcgatcgtcgctgccgcttggcacaagcacaacttgttcagccgccaaagaagcaagccttcgccgcctcctgctgccacttcagatgcaagctcccaaccctgatcaggcagcgctgtatgggatcttctacattttactacgtctcagcttataaaaacacacacgcatggctcattcaatcatcgcttatgatgcatcgatgctggctttgcatcattaactgattttttcaaacttggtagt

SEQ ID NO: 14965 - DNA, 248 bp, Zea mays
  Clone ID: cC-zmpo14820002h12a1
ccgaccctgaccggcccccaaatttatttacttttttcctgggaccagccaggggaggaaatagtcccccattctttgcattacccatggagtggattacatcgttattttgccagccatgggcatatctagaggctaacatgttctttgatgtcgccaaaacgggggcccatgatctccgaaacagcctgaaaaaaaacagtttcgcatcctcctccccgttccgccgcctaagggacaatcttttc

SEQ ID NO: 14966 - DNA, 326 bp, Zea mays
  Clone ID: cC-zmpo14820002h12d1
acccacgcgtccggaagagatcgtccgagaggcggcggaacggggaggaggatgcgagactgtcttcttgcaggctgtctcggagatcatggaccgtcgtctcgacgacatcaaagaacatgttagcctctagatatgcacatggctgacaaaataacgatgtaatcaactcaatggctaatgcaaagaatggtgtactatttcctcccatgactgatccgaggaaaaaagtaaataaatctggagaccggtcaggctcgagactgaatagacaaaaatgcgggaccaccatgccagaagccacacaaaacaacaataaagtcagg

SEQ ID NO: 14967 - DNA, 328 bp, Zea mays
  Clone ID: cC-zmpo14820003a01a1
tgcgtcacaccggccgcccttttttaaaattgggatcattttaatattagcatcgagtcacgagtactgaggaaactccttgacaattcacacgagacactaaactgaacgaacaacctaccaattaaccatatagaataccacgtaaattaaaacaacaattaatttatcggatgaactatacacgatgcataaaaactttgccgccccatacgccgtcgctcaatggaggttttaggcgaggaaggaggccacgagcgcccccgcggggggcacttcggcatttggtggtggcgcttgcgctttggccatttcaaaccaccggacc

SEQ ID NO: 14968 - DNA, 484 bp, Zea mays
  Clone ID: cC-zmpo14820003a02a1
acgtatcagatggaagagttagatataaaatagcagtcacatttagattttgcttggatgcaccatgcgaactgaactgacgaaccactgatgaccctgttgttggttacaaggtactaacctattaatctctggtgttgaccttcctacagaaagctaggtgatctcttgaatcgattcaggaaatatggatttttttttctgctgatacaatgctgaaggtggggtcaatgtcactgcagtgatttgggtgacctataagcactgttcatattgtgaggttctcttggatattcaggaaggagccgcagatgttcccgccaagatctgggaatgtggcacacccagacagaggattcaccttgcccctggaatcgatgctgacggggtacttgagcaggtggcccttcatctcggtcacatggctggagatgaatttctcccagttctgctgtccgatgtgtcgcacctgcctcgtgcactc

SEQ ID NO: 14969 - DNA, 357 bp, Zea mays
  Clone ID: cC-zmpo14820003a03a1
acacgaacttactgccaggaaaattctctagcatgatctcataaatcaacagcacggacagctacatcacagggcttaatggggggggggggggcccccacctatttccactctctgttctctctctcaaatcaggtcactaccaatctttatcggtaaccgaatggctgcaaatgctttgccggaacttttaaggctgttgccccatccgaaaagcctactcccaaagtgcaattcttatgatcgctaacttctgggcttgtgggctcatagccccttgtttagaggttgatcctttccctgagggtgcaagctgacaggggcatttggctgctgagaagaccggttttttggacg

SEQ ID NO: 14970 - DNA, 608 bp, Zea mays
  Clone ID: cC-zmpo14820003a03d1
cggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacatccaaagttcatcactgataccaaggctgctatcgccgaaacttacaacctcacagattcagaatttctgaaagctgatagctgtcaaactcgagatgctggctcaactgcctcaacagctattattgtaggtgaccgtttgcttgttgcaaatgttggagattctagagccgttatttctaaaggaggacaggcgattgcggtttcaagggatcacaaacctgatcagacagatgagagacaaagaattgatgacgcatggggctttgttatgtgggctgtgacatggccagtgggtggtgttcttgctgtctctcgcgcatttgtgataaactcttgaagcatatgttgt

SEQ ID NO: 14971 - DNA, 267 bp, Zea mays
  Clone ID: cC-zmpo14820003a05a1
atataagaaccagttcattacttcattttataggaaaaatacagaaacgggaaaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaac

SEQ ID NO: 14972 - DNA, 268 bp, Zea mays
  Clone ID: cC-zmpo14820003a05d1
gtttcgacttccaataatagtaacaacaaagcaaaggccttcctcccggcgtatttgctttggctcttctcctccacgccataagatatctagcaattggtgactcgccttaattagttcgctttgcttttgaggttgactcgaccattttgctgtagcggggaattgcatggacatgcaacgctccaatggcctttggaatgtggaatttttttttcccgtttctgtatttttcctataaaatgaagtaatgaactggttcttatat

SEQ ID NO: 14973 - DNA, 564 bp, Zea mays
  unsure at all n locations
  Clone ID: cC-zmpo14820003a06d1
aacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaagagtgcgacaaggcgtacgtggtgaaggcggccgaggtcaccaaggcctgcagcgtcacctgcgccaaggagaagaacccgcgcctcagcgagaactgcaagaggtcctgcacccctnctccttcttgagcgaagccccttgaatgaatgaaccatgcatgcatgcatgcatgtatgcatg

SEQ ID NO: 14974 - DNA, 326 bp, Zea mays
  Clone ID: cC-zmpo14820003a07d1
gcgattcggccccgggaccctccaagggtgaacatcacgcggcgtgactctgctggccctggaccacggtcattcagcattcggcagctctatgggcggtacataggactgagaacgggacgtcatcggaccatctaacgtctaaggatttgcacttcttaatgaagtaacgatgtttcggctgtcccgcattcataggtcgtaccgatggaccgctcgctcttccgtgccttcactcgtctccaagaatccacttacgagaatatcatagaatgggaggacttcagtccataccccatttcttcatcgatctatgatagtactgc

SEQ ID NO: 14975 - DNA, 366 bp, Zea mays
  Clone ID: cC-zmpo14820003a08d1
ggcaagggacgtaagaaggccgccctttttgtatttattttttattattgtgttgtatcgtgctcttaaaaagcaggatcctataacttgacttcaattatgatgcatgtcctcccaaactttacaaagccttccggctttatctcccttaggaccgaatctaagcaacctgaactaccctgaccccgttctctatagacttcctgtacctgccagcatgatgctatgtcgacaggaacagccgataccattgctcaatgtcacctggctgttgtgcagcaggagctggaccagctagggaatttcacccaatgtagttgcagttgtatactcctcgcttttgacgttcctgagcctgacgatcat

SEQ ID NO: 14976 - DNA, 597 bp, Zea mays
  Clone ID: cC-zmpo14820003a09d1
gcgtggtgagccgcctcctcatcccggtccccttcgaccagccgccgccggagagcgaccacgcggtgctcatcggagactgaaataccatggaccacgaggtgctggcgcgccagctcgacgccggcaagagcgtgggccgccccgcgggcgggctcatcaacggcaagggaggcaaggacctggaggccgccgcgcccatgctcaccttcgaggcgggcaagacgtaccgcctccgcgtgtgcaacaccgggatcaaggcgtcgctcaacttccgcatccagggccacgacatgaagctcgtggagctggagggctcacataccctgcaggacgtgtacgactcgctggacgtgcacgtcggccactgcctctccgtgctggacgacgccgaccaggcgcccggcgactactacatggtggcctccacgcggctcatccacgacgccaagtccgtctccgacggcatcccgtacgccggctccagcgggcgccccgccgcgcccaacatgaccgagccaccggccggctgggcccggtccatcaaccggccaagtccgtccgctggaaccggacgcagcgccggcgcccaacccg

SEQ ID NO: 14977 - DNA, 468 bp, Zea mays
  Clone ID: cC-zmpo14820003a10d1
ctaaccatccctaccgcttgggcatggaggccgaaagaggagagaaatcgaagggagggagagagagccgccgacgtagatttactgagctaccatcgtcatggccgaggcttcaccaagtctcgtaggtcatgatcgcgactttgtctggacggattacgttccggttagcccagaattgctcgccggagtcaatcctctaccgcggtaccccgcaccgctatgagcagttgtactacttcgcgaacttccggagaagaacaggtggtccaggaggagccgtacaacgaggagtacgatttgatccaggtggcgtctcccagtcaactttatgacgccatggatggacattagttcgttttatatttatcatttatttttgtaagactttcgctatgtaataattatttttatgatattgtgacatttatctctatacactctgttattatatgtggttgttctcgc

SEQ ID NO: 14978 - DNA, 298 bp, Zea mays
  Clone ID: cC-zmpo14820003a11d1
tccttgctgaacgcatagcacgcccgccggacgttttgttctgtctgcttgcgtgacactgaatcactgatgcataatacatgcatgcatgggatgcgatgacgatacgatgcatgcatgcatgggtatacctactaattggatgacggacgatgtatagctgcggagactgctgtatacgcatatctagcagtcgaattactgtggcgaaacgcatataagcataagcggtgcttgcttgacacgccgatgacatgaacaaagggcatgcttgagatgaacaatctacgtctaaagg

SEQ ID NO: 14979 - DNA, 447 bp, Zea mays
  Clone ID: cC-zmpo14820003a12d1
gaccgacgccctcggaagatcgcctgcgccgagctcggcggcgcctcggcggccaccgtgtgtgctcgccgcggaggctccggctccgggccccaccagcggctcctccgccgtcgcgcccgccgtcggcgccgccctcggggccggcgtcgcctccttcttcgactactacattcagcgagccggccgcggacggtcgcccggatgccgaggaagatacgaagcgggagagagagtgacatggatgcgcgcattccgatgcgtgggcatgtttttgattcgacacaccttttgtcctctttgtctgtgttccctctttctccttaatttaacgaattgatgcatgccgctgatgttcttcccgctgagagagggattaacacttgtatcatcgcttgccataagtttgaatccattcaacaatgcgatttaatcaagaaagaaatc

SEQ ID NO: 14980 - DNA, 528 bp, Zea mays
  Clone ID: cC-zmpo14820003b02a1
ctatgcagcattcttgttgagcaaaaacgatcgaagaaactttacacggtcggtcactcgatgctgggcatggtaccaggtagtagctcaactgattttctgactcgggtgacgagtttttttttgtgtgtgtgtgtgtttatttatacatcaaacgttgaagaacagaaaaggctggtacagtcaaagccgccaggcatagtttcgtattggctatacggctgtgtggaactggagtaaaaaaatagcgtcgtcaaatcttgagctgctcgcagttacgcagctgtcctgtagaagaagcttaggcagcgcagcccccggtgacctacacacctcgcagtctcgatgattgtgttcttacgagagatggctggagtgcgtcgtagtgcccgtagccgtcgtagagaacgcggactgggtcgtcctttccgtattcctggccgtattccgctatgatccttgggccgtcggagctgccccttacatgtagacggtgatgggcattctgagaacgtgggaacacatgaa

SEQ ID NO: 14981 - DNA, 534 bp, Zea mays
  Clone ID: cC-zmpo14820003b03a1
aaaatacataataattaatagaaaattacataaatctaatgattattatgtccccatacatgttcaaccaaatcatttagtagttgtgtatacatcgatgtgtccgtcatctcgttgtccatttgaatcctagctgctaggctcggggttgcattgtagtagatcgacgggccgactgtagaatcaactgtctcatatgtctcgtctaaatcggcatcacgctcgtcatcgatgatcatattgtgcaaaatgacacatgcacgcatgatcaaaccaagagtacgttgagagtaagaacgtccaggaactgctataatgacgtgaagaagagtagaaaaggcgagtttggaagagagaaatgagatgaaatggtgtgtggaatgagctccacccgggtagggatatatatagagggattggggatgaaatttatgattttttgcatttttttcgaattttttgactccaaacggtcaaaaacggctagttgcaacggctagcacacgtggaccaatcagatcgcgacacgtggac

SEQ ID NO: 14982 - DNA, 638 bp, Zea mays
  Clone ID: cC-zmpo14820003b03d1
gaattgcgggatacgacccacgcgtacggggacgtaggacgacggcgctggcgcccggggagagcgggcggaatcgcctcgctcgcgcccggcgagagcgggcggaatcgcctcgctctcgcccgcgctggagcgcccgcccgggcgagaggcggtcgagagcgacgtggcgcgatctaactgggtccacgtgtcgcgatctgattggtccacgtgtgctagccgttgcaactagccgtttttgaccgtttggagtcaaaaaattcgaaaaaaatgcaaaaaatcataaatttcatccccaatccctctatatatatccctacccgggtggagctcattccacacaccatttcatctcatttctctcttccaaactcgccttttctactcttcttcacggcattatagcagttcctggacgttcttactctcaacgtactcttggtttgatcatgcgtgcatgtgtcattttgcacaatatgatcatcgatgacgagcgtgatgccgatttagacgagacatatgagacagttgattctacagtcgggccgtcgatctactacaatgcaaccccgagcctagcagctagggatcaaatgggacacgagatgacggacacatcgatgtatacacaacta

SEQ ID NO: 14983 - DNA, 489 bp, Zea mays
  Clone ID: cC-zmpo14820003b04a1
gacaatgattagaatagcccagtttgatacattttcttatcagctgtcatcatcatcatatacctaatttacagtatgacattacataccatggttatgtgacacacacacaggacagggcattctcatcaccactagaccagtgatgtgaaggacgatactaaagaattcttcaattagagacgcagacgcaggactgtctcgacgaaatgcgggaccaccatgccagttgccacacagtacgacgatgaggtcagtcaggcgccccagacggtgatcccctgcatcatgcacttgaactcgttgaagtcgacgcggccgtcgctgtcgcggtcgacgttgcagatcatctcccggacgttggccatgctgctggcctcggggaggccgagcttcttgagcacctcctgcagctcagcggcggagatgaagccgtcgccatcgacgtcgaagaccttgaacgcctcccgcatctcctgctcgtcctcc

SEQ ID NO: 14984 - DNA, 534 bp, Zea mays
  Clone ID: cC-zmpo14820003b04d1
tcgcaaggggacgccgtcggcgtcgttccggctccgcaacgggagcctgaacgcggtgcgcctccgccgcgtgttcgacctgttcgaccgcaacggggacggcgagatcaccgtggacgagctggcgcaggcgctggatgcgctgggcctggacgccgaccgcgccgggctgtccgccaccgtcggcgcctacgtgcccgacggcgccgcgggcctccgcttcgaggacttcgacaagctccaccgcgcgctcggggacgccttcttcggcgcactgggaggccaggacgacgccaccgccgcggcggacggcgccggcgccggcgccgaggaggacgagcaggagatgcgggaggcgttcaaggtcttcgacgtcgatggcgacggcttcatcttcgccgctgagctgcaggaggtgctcaagaagctcggcctccccgaggccagcagcatggtcaacgtccgggagatgaactgcaacgtcgaccgcgacagcgacggtcgcgtcgactcaacgaggttcagtgcatgatg

SEQ ID NO: 14985 - DNA, 515 bp, Zea mays
  Clone ID: cC-zmpo14820003b05a1
gggtccaacacatatacattaaaaaataattatacaataatattaataagaattctaatattaataaaaagaaggtttcgaatagtatctacataggttcacttctctgtgttatgagtatgatactacacaaagagcaaaaattgattctggatgcgaagtttttccaggggcatatccaacgcatgttgtagcttatgatcaactcttttgcagactgagcctcaatggaagtggtcgtcgtaatgagaatcatcctggtggtacaggtacaggccaaaaccgaaccgtgcgcaggctttgcagaatgcagcttcctctgcggctgcaacagcatcttccctgcgcccctcatgtaactgtgctgtgcccgtggcatctctgtatgcctctccatcagttcctttaagtatcactcgatataccacggttacagttccattctcggaatagataacatcacgaacttctccacaccaacctggtgcgtaaaaactaagcattctgttggcatg

SEQ ID NO: 14986 - DNA, 621 bp, Zea mays
  Clone ID: cC-zmpo14820003b05d1
aattccttggttgaccacgcgtccggtccgcggcggcgaccgcgctcccgttcgcggcggccgtccccactgcctggagggtgcgcgcgagcccgcggacgcggcggcgctccgtggcggtgaagctggagcgcgggctcggcaagggggttcccaccaccaactacgtggtgccgcttgacagggccaccgggatgacgcgcccgctcgtcgagatcctgcgggacctcaacaagcgcgtccccgacaagatcatcgaccccgacactaacaccgtcaactggtaccatgccaacagaatgcttagtttttacgcaccaggttggtgtggagaagttcgtgatgttatctattccgagaatggaactgtaaccgtggtatatcgagtgatacttaaaggaactgatggagaggcatacagagatgccacgggcacagcacagttacatgatgggcgcagggaagatgctgttgcagccgcagaggaagctgcattctgcatagcctgcgcacggttcggttatggcctgtacctgtaccaccaggatgattctcattacgacgaccactttcattgatgcttagtctgcatagagttgatcattagctcaacatgcgttg

SEQ ID NO: 14987 - DNA, 540 bp, Zea mays
  Clone ID: cC-zmpo14820003b06d1
gtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggtaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgttcgccatgcatcgacaacctattcttaataacgttcattatctcgttcttatttatgacgaatgtcatgtatgttctggtgactgtcatgtatattctgatgactgtcatgtatcttgttcatgtatgctcaaggttcattatcttgttcatattaagtatgttatgaataactcaatatttattattttggtcatgtaaaaataaaaaaaaagggcggc

SEQ ID NO: 14988 - DNA, 573 bp, Zea mays
  Clone ID: cC-zmpo14820003b07d1
cccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatactgtggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccaacaagatggctccggccctccgcaaggtttatgaccaaatgcctgagcctaggtgggttatttcaatgggcagctgtgccacggtggtggatactaccattactcctactctgttgtacgtggatgtgaccgtataagccctgtggacatctacggtcctggtggccaccaactgctg

SEQ ID NO: 14989 - DNA, 159 bp, Zea mays
  Clone ID: cC-zmpo14820003b09d1
tgcatattcattctttcgctcatgcactccgatacggtgccggagttaaaaaaatataaatcaatgtgcaaattcaaatgattaataattctagttgtgatcaatctgaaccgctaatgcatgcacacaccgaatgaatataccatccactattggaac

SEQ ID NO: 14990 - DNA, 544 bp, Zea mays
  unsure at all n locations
  Clone ID: cC-zmpo14820003b10d1
caaactcgtcgcttccgctccacaggatcctctgcgccacccacaaccgtgcgaccgtccgtgctgccggcgaccccgaactgactaattgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgtctncatccgcgcctaccgctccaagatcgagaccgagctcgcccgcatctgcgacggcatcctcgccctgctcgactcccacctcggcccatccgtcggcggcgccgagtccaaggtccttctacctcaagatgaagggtgactaccac

SEQ ID NO: 14991 - DNA, 635 bp, Zea mays
  unsure at all n locations
  Clone ID: cC-zmpo14820003b11d1
ctatgacgttgtaccacgcgttcgcgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaatgccatcggcaagtccatcggcttggcaaaggagctggcgtgcatttgaaccaattgactaacatgcatatattatgtactaggtttgtgcccgtgcgttgacacgaagttaanattagtataaaacatagatcataacgataaat

SEQ ID NO: 14992 - DNA, 644 bp, Zea mays
  Clone ID: cC-zmpo14820003b12d1
cgcgttcgcccacgcgggcgctcgaccatccgtgcaaattaccgcgatggctcccaaggtcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatcctccccacgctgctctccgtcaccgacaagaaactcggcgtcctcaactacaccagggccgacgacgggcagatgtacttcggcgctcccgggagcctctgcgtggccaagctcgtcaaggtcgtcgcagcgcggccgtactctgtgtccatcatggagatcagcgagcccattttgccggtcgcgttgcccttccccgtcgcggcgcccgccgtcgcggcatgggtggtaagcgcaagatcaagccatcagcggcaacccatgatgatttcaacatgatccc

SEQ ID NO: 14993 - DNA, 424 bp, Zea mays
  Clone ID: cC-zmpo14820003c02a1
aagaaggaattggaatttgcatattgatttacattttttaactctggcaccatatcggagtgcctgagcgaaagaatgaatatgcatgcatgatgcatgttataatctgcatggctgcttgcgggcatgccggttgaagaagaggagggaaagtggctacttaaaagttcttggacgcctggtacgtgacgccgaacttccagtcagcggggagaacgtgccatgaggtggccttgcggggggcgctagtcatcacccggaacgtcagcgactcgcaggtgaggtcctccccggtctgccacacttgcccccagttgcgctttatttccggccacttgacgcgcttgcttccctttaccgacaccgccgggatgtcgccggcgccgcccacgttggtgatcggcaccatggtgaagtacttgtt

SEQ ID NO: 14994 - DNA, 403 bp, Zea mays
  Clone ID: cC-zmpo14820003c02d1
gtggatggcggcgccacgacctctcctattgccgctgctggtcgccatgctagcggtggtcgccgatgtcgccaacgccggccacgccaagcccctgacgcctggcgggcgcgtggtacacgacaaccacggcaagttcacggtcgggcccgggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgtccaaggac

SEQ ID NO: 14995 - DNA, 484 bp, Zea mays
  unsure at all n locations
  Clone ID: cC-zmpo14820003c03a1
agacaccagtaattctcttcttgttcactcactatggtctcatattccaatgatttttggggcgtcaaatccaaccctgagcatgcgaagagccaacccatgcatttgcagtgaatcatgtatgcatcagcggcggaagcagcagcagcacgatttggggctgggtagcttgaagctgctgcagcacttgggcgccctgcagcatttgggcgctttgatcctccaccacccgcaccgccgttggtgcgcgtgccggtcgccggcgccgttcctcttctcggcgtggacgagcctcttgagctcggccttggtcttcttcagccgggcctcgtactcctttttccacgtggcgaactggctcttgagcgtcttgagctcctccaccgacctggcgctgccaggagtggacgacgacgtcggcagcctgctggcctccgncaccgngcgcgcgttgtgctcgaacgcctccctccccgtctggaac

SEQ ID NO: 14996 - DNA, 538 bp, Zea mays
  unsure at all n locations
  Clone ID: cC-zmpo14820003c03d1
gcgtgaggagaaatgtctggtcggtcgggagctggaaagacgggcggtcaaggcagaggaggaggtgaagcagaaagacgaggagatgaggcagaaagagcagctcatcgccacgctgcaacggcaggtgcagcactacgaatcccggctctcggaatgcgatgtcaggatgaaatctgtggagaggcagatcacttcgttacagatggctcacagtcacagccagaccgctggcgtaagcgtaaggagagatggatcgacgaggcacatccagggatcatctcgtggaggccttccgccgtcgtctcagccatcgtcagtgaggcgccagcagcgcggttccgagcccgccgctgccgacgagagcgagaggacgacactggcggagccggtagtgaaccagctgggcagggagttccagacggtgagggagggcgncgagcacaacgcgcgcgcggtggcggaaggccgctagctggcgacgtcgtcggccacttctggcagcgccaggtccgtggaagagctcaagacgcttaag

SEQ ID NO: 14997 - DNA, 328 bp, Zea mays
  Clone ID: cC-zmpo14820003c04a1
aaggggaacccggatgcccccgcccctacctccaaaaatacaaaaaatggggttgaagggtccccccaaaacatgggccctaaaaatggtgccaaaaaaaaaagccctgcaacaaatatatgccagggggcgaaatatattttaaaatgggttaacccccgcgtaattccccggggggcaaaaactgcacaagaagaagggggcccccctgttgcactttatgcccccccaacccaccctgggggggggcttccaaacaacggccttgaaggggccccccattttgccggggccccaggggtttgaattgtaaggggagttttttttt

SEQ ID NO: 14998 - DNA, 545 bp, Zea mays
  unsure at all n locations
  Clone ID: cC-zmpo14820003c04d1
gacgatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaggcggcggcgggctggaccccgacggcgacccagaggttgggctgaacgggaaggcgatcgaggagatcgtgaacgagcacaacgtgttccgcgccaaggagcacgttgcctcgctggtgtggaacgcgacgctggccaggttctcgcagcagtacgcggagacgctcaagggcaactgccagcagatccactcgtcggcgccgtacggngagaacctgatgg

SEQ ID NO: 14999 - DNA, 479 bp, Zea mays
  Clone ID: cC-zmpo14820003c05a1
aaatcacaagatactttgactattattctcgaaaacaagaaatacataaatatcgtatattacttcatgcaaggaaaacatgtggtgaaagacaaatcagaacaacgattcacagtcatttcatagtatgataacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggccgtccggcatgccgcgccccgcgcaagtgtcgtcccggcagttgtgcgtcttggtgcagatgacgcgggtgtcggcccaacagtcctcggaatggacgggcaggacaaagcctgtgttgatgagaagcagcagaacgagg

SEQ ID NO: 15000 - DNA, 512 bp, Zea mays
  Clone ID: cC-zmpo14820003c05d1
tcgggcgacgagcaaggcgatggcttcaggcctcctcgatctgctgcttctcatcaacacaggctttgtcctgcccgtccattccgaggactgctgggccgacacccgcgtcatctgcaccaagacgcacaactgccgggacgacacttgcgcggggcgccgcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattttgggatatttgttatcatactatgaaatgactgtgaatcgttgttctgatttgtctttcaccacatgttttccttgcatgaagtaatatacgatatttatgtatctcttggtttcgagaataatagtcaaagtatcttgtgattt

SEQ ID NO: 15001 - DNA, 62 bp, Zea mays
  Clone ID: cC-zmpo14820003c06d1
aaaaaaaaaaaaaaaaaaaaaagaaaaaaaaaaaaaaaaaaaaaattaaataaaaaggaaaa

SEQ ID NO: 15002 - DNA, 477 bp, Zea mays
  Clone ID: cC-zmpo14820003c07d1
tagaagcactactgatggcccaaaacaagatgattgtggtggttctcctccttgccacctttcttgtggtggcaagatcgttgtgggttccagaagaaccctcaaatgcggatgacataagaggtgcttgcatcgaggagtgcaccaaagaaaattaaggcttcctggcgacaagaagacatgcgaagtgttgtgcaccaagctcacaaaaaagcctagcgaagaaggcaaacatgattgatgaagtagcactccgataatatataccctagtggatcagtggtcatctttgtagccatgtctgccacacgatggccttgactatattgtcttattgttttgtttttggtttccactagtatcctaattccttgttcatataacctaatttcactcaaagcattttatatgcttcacttaattaaataaatacaaaggcaatggcatgttctgttttgatctaaaaaaacacaaaaa

SEQ ID NO: 15003 - DNA, 358 bp, Zea mays
  Clone ID: cC-zmpo14820003c08d1
atccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctacccacatgcatgctattgcatgcctccgaatatatattatccgactcgatcctgccaaattgtttcgtcgacttcattatatatatcccatccctttaatttaatggagaagtgtgactgctgttcgtgaaaaaaataaaattaaatataaattatataaataatttataaataaataaa

SEQ ID NO: 15004 - DNA, 261 bp, Zea mays
  Clone ID: cC-zmpo14820003c10d1
atcgccggccgtagagcgagcggtctcccaattccacccaagaactaacaacatcgccgcgagacgccgagggccgtgggaccactatatttaggagcgacgaagagatccacccgccagccatggagatgaagaaggtcctgtgcgccgcccatggccgccgaccgcctcggacaccgccgcgctggcctcggacgcctgcgaggcgccctccgaggcgcccgccggcgcggccgccggcgcgcctggacctagcgcaag

SEQ ID NO: 15005 - DNA, 573 bp, Zea mays
  Clone ID: cC-zmpo14820003c11d1
tgacgtctatgcacccctcgacaacctcctcgcctcctgcattgaccaacaattaagcctgcccgacttccacatctattaggtgcagccatgggtgcctgtgcaacgaaacctaagacgcttgatgggaaagccccagctgaggccaccatctgtacacccaatgatgcacctgataccactaccatccacattgaggatgcggaaaaacatgcagtagttgagatggtggaggaggacaaggatgacgcactaacagtggcggtgaaacaagagccagcagacaccattgagccttagcagattgctagtgaggtgaccacttcggaagtggcggacgtcgttgtcgagccttagagcaacgaggatgatgaagttgtggagaagaccgacgtctataaggagatgccatctgcagtccatgcacaggaaaatattgccaccaacatggtggtagtctagcccaccacagacttgaacaaagacaccgacgatgagatatagatggagaacgataagccatcgctaagctaattgactgcatgtcaattggttgatgcctgatgatcaatg

SEQ ID NO: 15006 - DNA, 523 bp, Zea mays
  Clone ID: cC-zmpo14820003c12d1
tatgacgtctaccgacgccttcggtctgcttgtagatatgcatagtggagcgcacatcacactggcaaaaacatacattcgctggcgacaaccgttgcacggatccgcggtgcagacccccgatgagtatgtaatgccccacagtataaggggcagtagcactgaccgtgtaggacatgcttgtagccgtagccataggaactggcgactatcagctacgacagttaccacgactgataccatcattgcgcgaacggtaggattgacgattgctggaccgagatgggcatccaggagtgaggatgcactgtccagcacgatggggacagccgcgccaagacaggatgatcgtacatggcattgaactgatgcacttgacatcatcgctgtgctcggagcgatgcacatatgaccaagacgatgacctgctctaaatgttgaagcccggggagctacagtactttatagcctattgctataatgctaccataggtgcggaacagatacgtgatgacaaacatcg

SEQ ID NO: 15007 - DNA, 453 bp, Zea mays
  Clone ID: cC-zmpo14820003d01a1
agatgaatagaactaagtatattgcatggaagttacacctcagcattcccgtacccttgtatagtgtatagctgtacaatgcagaattaagaacacaacatgtaggtacatattcacttgatccgatacaccagagttcacaaaaaaaaaactctcttgccaccccaaaacccacataagtacacctaaggaaacgaagaacacaggactcctccggccaccgctggacgccgtcggtctccggagaccagcgagatcagccgcatcagcggcgctagagatggtgggctagtcgccggagaagactgtagctacgtatatcttgcgacctttgcgggcctcctcggtgagctcggactgcatgctagtccttgctgcctataaagtcagaagaggaggtggtggcaagctggttgaggcccgtggagtgtctctgctctaccgcccactgtg

SEQ ID NO: 15008 - DNA, 517 bp, Zea mays
  unsure at all n locations
  Clone ID: cC-zmpo14820003d02a1
gcaatagcttcattcaacataatatgacatagttcatacaaactacatcagacatcataattcatacaagatagtaggaaacagttcatacaaacagcttcaaacaacatcactacgatctgtatcatacaaactatgtcattacattaacatagtacacagtttgtaatcgagtactacgccaaactctggcacaagagtgaatcttggtccaaaccttcagcaatcgcttcaagggcttcgcgcagttccttcacctctattgcactcaatgccttccctgggtgcagcttctccttgcggatatacatgagatgctttgaggtaacctgcatgatgctaatggccttgtcgacaatttcatccatctagatcaccttagttatgcttgtctcttggcgggaacaactcttcagcatcgattctaatgttggggtntgatgggcgccgcattgatccggcatctagccttttaacctcaacagtaaatgtccgacaaacacgacgatggtcagag

SEQ ID NO: 15009 - DNA, 547 bp, Zea mays
  Clone ID: cC-zmpo14820003d02d1
acccacgcgtccgcccacgcgtccggcagttatccaccccgtcaacatcagtagagtgctaattcagttcaaaatgctgggctggaaactattggactaagaccggcaaattctccaagtctgtcaactaattcaggggtttatgagcaattcatgcagaagttccattagccacagactcaaaattcacttaggttgcaggcatcttcagatcctcaacagtacaaggaccagagccaaaaatccgttcaaggaacacaggctgtgctggatccatatagcttacttggattgttgagtttaataggaatgaaagagcctggaccaacaactcttgctttagggattgatttgacctcattggggttgaatttgaactcccaagataatctttacaagacatttggctcttcgtggtcaagtgagccagctgtaggagaacctgattatcagatcccagcttgtttctctacaaagccaccaccagtactgcaaaagtttcaccctttgacactattctacaatttttacagcatgcctaaagatg

SEQ ID NO: 15010 - DNA, 362 bp, Zea mays
  Clone ID: cC-zmpo14820003d03a1
caccggtataaaatgaccccagggactttattaatttccatcccctcttttttgggggggggggtttcacccctaacaacaaatttggcatggaaaggggctggggcaatgtttgctttggagggggccccaaaatataaatcccaaaatataaattcaacaacattgcctggtcaaagggatgccatcccaaacatagtagcttatttgaaaaacactcaaggaataaataaaatggggcccaagggggaccccaagcttaaaagcacttccgatgaacaatcccagggcctgactcgttatactcagcctttgagaaccacatttgttggaaggggcccaggggggcaaggatggatccc

SEQ ID NO: 15011 - DNA, 565 bp, Zea mays
  unsure at all n locations
  Clone ID: cC-zmpo14820003d03d1
gtccgcagaaggatgcgtatgttggcgatgaggctcagtccaagaggggtatcctgactttgaagtacccgatcgaacatggcattgtcagccacacagtgccaatctatgaaggttatgcccttcctcatgccatcctgcgccttgaccttgctgggcgtgacctgactgacagcctgatgaagatcctcactgagagaggttactccttcaccacctctgctgaacgcgaaattgtaagagacatcaaggaaaagcttgcatatgtggctcttgaatacgaccaggagctcgagaatgccaagagcagctcatctgtggagaagagctacgagctgcctgatggtcaggtgatcaccattggggcagagaggttcagatgccctgaggtcctcttccagccttccttcattggtatggaagctcctggcatccatgagaccacctacaactccatcatgaagtgcgatgtcgacatcaggaaggacttgtatggtaacattgtgcttagtggtggcacgaccatgtnccctggtattgcggaccgtatgagcaaggagatcac

SEQ ID NO: 15012 - DNA, 515 bp, Zea mays
  Clone ID: cC-zmpo14820003d04a1
gattacaaatcgggcgtattcctttttatttatagaggagggggctggacccgttacaaacaaactcaccgaactaattccgtgaatctagccaacaaacacagcaagaaactcggaatcctaatcggttctgcgcgcgcggaccgtccgaaccagcggcgcggaccgtccggcctcaatttggtgctcaacaccagtattaattaacagactatttcatcttttggtgtataaaagaaaacttgaccttctaaaatttgagaaggcacgggctactttgcaataaaagttataagtgtcaaaatatgagtcaaaaatatattgtaaagctaagacaaggtatctgatttgggctttgtttgttttagcttctggtcaccaaaagttgttgcagtgctaaacactcaatttttcagcctgtttttaatgaaaatcacttttgtcaaaattgtctaaaatcaacgtaacacagaatcggtcgagccgttgtgatagtaggaaaccatcactttcta

SEQ ID NO: 15013 - DNA, 586 bp, Zea mays
  unsure at all n locations
  Clone ID: cC-zmpo14820003d04d1
cgtccggcacggtaacgttgatcacccgcgtgctgttttcgtggcttctcatactctatttttatgcacgggcataaataaaggaaacctgtttgatttttacaaattagtgagcgatattctattctaagggcctattcggttcaacttttttctaagaagctttttctgacaatctggctttgaagagaatttggttgtggaaaagaatatgagaatcgagacgtgaggagataaaaaagtccataatatttaggaggtagaaagtgatggtttcctactatcacaacggctcgaccgattctgtgttacgttgattttagacaattttgacaaaagtgattttcattaaaaacaggctgaaaaattgagtgtttagcactgcaacaacttttggtgaccagaagctaaaacaaacatagcccaaatcagataccttgtcttagctttacaatatatgtttgactcatattttgacacttataacttttattgcaaagtagcccgtgccttctcaaatttaaaaggtcaagttttcttttatacaccanaagatgaaatagtctgttaattaatactggtgttg

SEQ ID NO: 15014 - DNA, 354 bp, Zea mays
  Clone ID: cC-zmpo14820003d05a1
gggttggacacccgggggaaacccggaaaatcccggccggggcccgggagggcccccacgtgacccaaaagaaaggtctggaaaagcggggaaaaaacggggaaaggggggaaacgggggaaaaagggaaatccgaaaaaaaacccccaccgaaaaaaaggggagaacaaaaagggaagccccgggggggccaaaagggggacaaaacccacaagaaggggggggcgcaaaggggccgataaaaaaagaaaaaacgcggggcccccgaaccaaaaaaaaaccggcaaacgcggggggagaggcggtacaaaaaaggggccacaggggggtgtacttcaacccaaaaaaaaggga

SEQ ID NO: 15015 - DNA, 595 bp, Zea mays
  Clone ID: cC-zmpo14820003d06d1
cccacgcgtccgggctagtacaaaagatatttctcttccctcttccacagatgcaagtactttgagtgaacaaactccaaatcaggaaaaggatgctgtcacccttatgctcagtgttcgtcaggcaaatcttcttctttcctcgttatggactcaagcacttgtcacctgaaaatgttccacggaattatgaagcaatttctcatacttacagcttgatgctattgttttctagagccaagggctcaggtgccgacgttttggttggtagctttcagcttgctttttcattaagaagtgtttcgttacaagcaggttttcttccaccttcacgcaggcgctctctttttactttggcaacttcaatgcttgtgtttttctcgaaagctttcaacgttccagcgctcattccagttgtgaagcatgtgttgacagaaagtacagttgatccatttctttgcttaatagaagactgtagattgcaggctcttgatagtgctgctcagtcttgcaaactctatgtgtcaaaagaagatgacgatcaagctctgaaatactctcgaacttgacatgaatgacatcagtcaaagaaaca

SEQ ID NO: 15016 - DNA, 564 bp, Zea mays
  Clone ID: cC-zmpo14820003d07d1
gaactgcgactgcctccaagggttccaagtatgccactccctgggtggcggcactggttctggcatgggcacgctgctcatttccaagatccgggaggagtacccggaccgcatgatgctcaccttctccgtgttcccgtcgcccaaggtgtccgacaccgtcgtggagccctacaacgccacgctgtccgtgcaccagctcgtggagaacgccgacgagtgcatggtccttgacaacgaggcgctctatgatatttgcttccgcaccctcaagctcaccaacccttcatttggtgacctgaaccatctgatctcggcgacgatgagcggcgtgacatgctgcctgcggttcccgggccagctgaactcggacctccgcaagctggcggtgaacctgatcccgttcccgcggctgcacttcttcatggtggggttcgccccgctgacgtcccgcggctcgcagcagtaccgtgcgctgacggtgccggagctgacgcagcagatgtgggatgccaagaacatgatgtgcgccgcggacccgcgccacgggcggtacctgacagc

SEQ ID NO: 15017 - DNA, 437 bp, Zea mays
  Clone ID: cC-zmpo14820003d08d1
gagtgcggtgccctgacttcgagaagtagcgatctgctaggtacgcctccgagacgccatgatcgacctgcgtcctgtgcatgcctgcatccattgctgccctgcccgctcgcccaagaattgaagatggtagctgccttacgcgttatttgtattgtgtatgtctatgcactgcattcgagggcagcgataatgggcctggcctcgtaagcaaacgttcgatccgcttcttttgatgggcctaaatctgcatgcatgcagatgtactgctacttctgctcttttatattgctcttttttttaattctattaacttcttgttttctccctcatccctcgtcgaggaggaagggtatccgctttgtttttatgatgcaaaggtatccgttttgtttgtatagtacagtatctcatctatttgaaaaaaaaactatatt

SEQ ID NO: 15018 - DNA, 582 bp, Zea mays
  Clone ID: cC-zmpo14820003d11d1
ttccgtggtctacccacgccttcggaaagaagtcgtctaattgtttcgatcgaattaggcgccttcttcgttccacgctccgtctttatttgtaatctgaagctgacaggaacatttgagtgtatcatggacggattggtaggccttttgaaagttcgtgtggtgaggggcatcaaccttgtctaccgtgacgcaagaggcagcgatcacgtatgtcgtcctacgacttggcaagatgaaacttaagacgagcgtgaagaagagatctgtgaaccccatctggcacgaggagctaactctgaccgatacagatcccagactagctctgaagctggaggtggtcgacaaggacacgttcagcagggacgacccgatggtggacgcggagtatcgacgtggtgccgttggaggatgctgtgaacgcgagcccggacgcgagcctgaagaacggtgccatcatgctgtgcgtgcggccgagcgccacgaactggctcgacgacgagagccacatgtgctgcaggaacggaatgttcgtgcaggacatgatcctacggctcaggaacgtgtatagcgcagagattc

SEQ ID NO: 15019 - DNA, 527 bp, Zea mays
  Clone ID: cC-zmpo14820003d12d1
cccacgcgttcgcccgctgccgcggcgggccgcggaggagatggagagggaccaggacctctgctacaccgaccagtggggccgccgcaactacgagtacgtctcgctcggctgcgacgccatgcccgtcctcaagggacgcacgcccgtcgagtgctacaccgacttcatgcgcgcgttccgcgaccacttcgccgactacctcggcaacaccatcgtggaaatccaagtcggcatgggccccgccggcgagctgcgctacccgtcctacccggagagcaacggcacctggaagttcccaggcatcggcgccttccagtgcaacgacaggtacatgcgtagccgcctgaaggcggcagcggatgcggccggcaagcctgagtggggccacggtgggccgatcgacgctgacggctacaacaactggccggaggacaccgtcttcttccgcggcgacaacggtgggtggagcaccgagtacggcgacttcttcctgtcgtggtactcgcagatgctgctggagcacg

SEQ ID NO: 15020 - DNA, 388 bp, Zea mays
  Clone ID: cC-zmpo14820003e01a1
ggacccctcaacagccccaaaggataaactcggggattgaaccttacaacacgacagcaacaacaaggccttaattaagggcggggaccttaacgccggcccccgttcttgattcttttgggcatcttacatgaacacatggacaggggcccgggggccccaacagaactctttatacctatactgatactgggggacactgggactgccgccctccacccagtgttattgcaggatacacgttgtacgtactgatcgctgaaacaaaaaaaaaaacaatcctttgattaggccttgctttcggcgtaggatttgaaatccccgtgagtgtccttttagcgctgggacaagttcccggagcaagggatcggagggaactttggaggat

SEQ ID NO: 15021 - DNA, 193 bp, Zea mays
  Clone ID: cC-zmpo14820003e02a1
aatggaaatagcacctataccccatggcaggattagagaactactagtcccgaactcctgaactttaaatagaatgtctacacaatcaaaaactttaagtaacacaacctttgtccctgcatgcatagatatttatttcagtccattgctactatctgggaacagcggtgcaagtaacgagatccatgcatgc

SEQ ID NO: 15022 - DNA, 367 bp, Zea mays
  Clone ID: cC-zmpo14820003e03a1
aaaacaaaaaaataattccgggtgtttattttggtgttcaaattaccattacctgcccggatgatggaaggggccaaggccttttccattggtatttttctccccggggcaaacaagatacattagccgggatgaattctttcccgggggcgggcgatccaaagagaactcaaagcgcgttgccgggaaagggtgtcactgatcacaagccgcgcccgcgcggactggggggtggtcaacaccccccggatttgctcaaaagtctgccttcgcagaccggtagccttatgccccaaggttttaagagcgccaaggtttggaaccgccggcgccattgtccccgaacagtttggagcggggttttccc

SEQ ID NO: 15023 - DNA, 517 bp, Zea mays
  Clone ID: cC-zmpo14820003e03d1
cgccacgcgtccgcgggagacgaccagcgccaactctactagtgaaaaagcaggtgctttggcgtttgacaaggactacgctggatgggaagacgagcacaggaagcagataagcgagctgagggccgcgctcaacgcacacgccggtgacgacgagcttcggtgcatcgtggacggcgtcatggcgcatcaccacgaagcgttcaggctcaagtgcgtggcagccagggcggacgccttccacgtgctgtcggggatgtggaagacccccgtggagaggtgctttatgtggctgggcggatttcgaccgtcagagattctaaagttcctcgcaagccatctggaccccctcaccgaacggcagctcgcgagcgtacacggtctgcagcagtcctcgcagcaagccgaagagggcatcttgcagcgggtgcaagcgctgcagcagtcggtcgcggagaccctcgcgtcgtcagggtccccgtgcctgcctgtgcctgcaggtcgtgctcctccgtct

SEQ ID NO: 15024 - DNA, 527 bp, Zea mays
  unsure at all n locations
  Clone ID: cC-zmpo14820003e04a1
gaaaaagaaagaaagatatcggacgaccaaactagtaaaagataacagatcagcacataataatgctggctgctgccaagccaaattatacccaatcactaagccggcatggcatgggttgcagttgcagcggcgattgccaaagcccttcatcatccttctctccgttcatcttctatggagcagcagccagtcactgatcaaacacacacatccagcagcagcaatgcttgcaggtaacagcagagccagaggaaggtagtcctcatgtccacagtgacactcccaaccttaagccgatgccttgtcgaacttgaggggcttcaccacctcccaggtgaagtcggcgtcgtcacggccgaagtggccgtaggcggcggtcttgatgaacctgttgccgcccttcttcaggtcgaggttgatgctgatcatcccgggcctgaagtcgaagttcttcttcacgatcttgaggatctcctttgcngggatcgtgcccgtgcccgtcgagttgacgaacacggacaggg

SEQ ID NO: 15025 - DNA, 550 bp, Zea mays
  Clone ID: cC-zmpo14820003e04d1
tcttgccggtcccgaataaagagcagcagcgcaagaggtcggtagagcgagaagaaggcaatggcggccgagagctgccttttcaccttttttttcgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccggcctcaccggtcgcaagatcatcatcgacacgtacggcggctggggagcccacggtggtggcgccttcttcgcaaggaccccaccaaggtgga

SEQ ID NO: 15026 - DNA, 545 bp, Zea mays
  Clone ID: cC-zmpo14820003e05d1
ccatgcgtacgattgggccatagcctacaacggacaggtgtggtgtcatcacttctggaccagacgaaagatgcattcctggaaacaccatcgccgtccaagctgacatgccatacagtggcctgtcatcggtcggaacagcatttttggccaagttcgaatggttctaagatgccacatccactgttagagcacgtgaccttcgtggacactccaggagttttatcaggggagaagcagcggacgcagcgcagctacgatttcaccggagtcacgtcgtggtttgcggccaagtgcgaccttatccttctcctgtttgatccgcataagcttgacatcagcgatgagttcaagcgtgtgatcgggtctctccgcgggcatgatgacaagatacgcataggtctcaacaaggccgaccaagttgatgcacagcatctgatgagagtgtacggagcactgctgtggtcgctcgggaaagtcctgaacacaccagatgtcatgcgtgtctacataggttcattcaacgacaagccgatcatggagac

SEQ ID NO: 15027 - DNA, 551 bp, Zea mays
  Clone ID: cC-zmpo14820003e06d1
aagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccacttcaaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgtcgccgagaccacgacgacggtggaggcgaagaagaacgccgaggaggccgggaaggagaagctggcgcatcagagctgatcgactgtccgtgcatgcgtgccaattaatataattggctgatgatgcctgatgttcagtgtgtgatactgtgatcaagcaaggagacgacc

SEQ ID NO: 15028 - DNA, 537 bp, Zea mays
  Clone ID: cC-zmpo14820003e07d1
ggcatgcagatcttcgtgaagaccctgaccggcaagactatcaccctcgaggtagagtcttcagacaccatcgacaacgtcaaggccaagatccaggacaaggagggcattcccccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaagactatcacccttgaggtggagtcttcagacaccatcgacaacgtcaaggccaagatccaggacaaggagggcatcccaccggaccagcagcgtttgatcttcgctggcaagcagctggaggatggccgcacccttgcggattacaacatccagaaagagagcaccctccacctggtgctccgtctcaggggtggcatgcagatctttgtgaagacacttacttgcaagacaatcacccttgaagtggagtcttcggataccattgacaatgtc

SEQ ID NO: 15029 - DNA, 509 bp, Zea mays
  Clone ID: cC-zmpo14820003e08d1
catagagacaccaagcgtcaaacttgtcaagcagctagcaaccaacccaagaaagacaccatacccatggctcgcgctagcgtcgtcttcgtcgttgctgctctcctcttcgtcgccatggttgtggcaccgatggccgaggcaaagtccgctgatgccctctccgccgatgcccccgcccccgctgctgacgcacctgccgatggacctagcggaccggcaggtgcacctggtccccagggcgtcgagggactatcgggcaatgaggacgacgacgatgactccaccaactaaggccaagcacgtcggtccgattgcatttggaacaagatatgaaagaaaagtgagagcaatgttgtttaaaaccaaaaatccataataatgtgtggtcatccgtgatatgttcttgctctccctctttttctttctgtttgatttcgatgtgctatcatgttcttagcctctaattgtataaattcttgatatcaaagacttccaaaatatcgttt

SEQ ID NO: 15030 - DNA, 505 bp, Zea mays
  Clone ID: cC-zmpo14820003e11d1
ttccctggtcgtaccacgccttcggctcgaaatgcatggggagtccgaccctaccatggtatcatacacggaattcttagagatgttcaatgatccggattggggatttgggatcctgagcactctggtgaagctcgaagagagtgaccacatacgccatggtagccacacatgctacatctggccggaacactatcattgcgtcacggtttaaggaaacaaaacactcattcagcctgtgcaaccggtgctacagtgaagggaaggttccttcggtcttcaagttggacgagtacaggttcaaagaatacgctatggtgtaattgttggcttggcactggagagttcaccgcgattagaaggattcgaacttgcccaatgctgggtactgtgactgagcacctgtgaagaggcatactgagctgatccatgtaagataaagcgctggtctggtataacgaactgagctgttgagccaactaatagagagagctgaactgatggg

SEQ ID NO: 15031 - DNA, 497 bp, Zea mays
  Clone ID: cC-zmpo14820003e12d1
gacgtctatgcacgcctacgtcagttggtcgcctctcaatcagcgcccgtacagccaccactctcaaccgagccatatccaaagtactcaacatcgcttcgtgcagcctgcatccgacgacgagggctgcacagaacgatggggtccgactccgactcagtgccgacaaccagcttgctgaaggctcacgctgtcagcgctggctgttgatttcagggccgagggacaaggctacggctgttccaccgtgatgatgaccatgtgcccgggcatggactgcatgagcaccaaggggtgcgaggcgactatctggctgcagcataggctggccggattcagagctaccgacacaggctgactctgcatggtgctgcacggtactgatcgcgatcgtcagcattgtgatgaaccagaccagagcgctggagctgctgtgcgtgtgaaaagacaaggccctcgtcgatcatgcagcgcacaggcatactggtggtgcctgc

SEQ ID NO: 15032 - DNA, 415 bp, Zea mays
  Clone ID: cC-zmpo14820003f01a1
ggaacagagggagtatattatattatagggccattcaaacaccaaaaaactcaaggacaagttcgccaaggggcatagcaaaccgattgtactgagatactgtttatcgatcacactgaaacacgaaagtgcaataaccaccagccttatgtaagactttgcaacttatatacaaatttactgagagctaaagcgactttgttgatggcataatgtagccaaatgacactaatcatagaaccctgccgagcatgaccacataggctcagaccttcgagccatcatcgacttgagcagcataaatctggccatattctcccttgccgtcatcctcgtcaaggtagtcagcccttgcattgagggccagcatctggcaaacaagccagaagagagcaacgtcaagggcgaagaaagc

SEQ ID NO: 15033 - DNA, 412 bp, Zea mays
  Clone ID: cC-zmpo14820003f02a1
acaaagagaaccaatagtgttactcgacaagtacagttataatatgatcctaggtactttattaatttccatcctctcttttttgtggttgatgttttcaccactagcaacaaatttggcatggaaaggagctggagcaatgtatgcattgtagtgagccacaaaatataaatcccaaaatataaattcaacaacattgcctgctcaaaggcatgcaatcccaaacatagtagcttatatgaaaaacactcaaggaataaataaaatggagccgaagggggacccagagcttagaagcacttccgatgaacaatcccaggtcctgactcgtcatactcagcctttgagatccacatctgttggaaggtgctcagggaggcaaggatggatcctcctatccagacactgtatt

SEQ ID NO: 15034 - DNA, 643 bp, Zea mays
  Clone ID: cC-zmpo14820003f02d1
attccttggtcggtcgaccatgcgctcttccagccttccttcattggtatggaagctcctggcatccatgagaccacctacaactccatcatgaagtgcgatgtcgacatcaggaaggacttgtatggtaacattgtgctcagtggtggcacgaccatgttccctggtattgcggaccggatgagcaaggagatcactgcccttgcgccgagcagcatgaaaatcaaggtggtggcaccgcctgagaggaaatacagtgtctggataggaggatccatccttgcctccctgagcaccttccaacagatgtggatctcaaaggctgagtatgacgagtcaggacctgggattgttcatcggaagtgcttctaagctctgggtcccccttcggctccattttatttattccttgagtgtttttcatataagctactatgtttgggattgcatgcctttgagcatgcaatgttgttgaatttatatcttgggatttatattttgtggctcactacaatgcatacattgctccagcttctttcattgtaaatttgttctagtggtgaaaacataaccacaaaatagagaggatggaaatttatatagtccctaggatcatatattactgtacttgtcgagtacacta

SEQ ID NO: 15035 - DNA, 417 bp, Zea mays
  Clone ID: cC-zmpo14820003f03a1
gggcaacccaattaattggacattggtaggtgctttacaggtccagatttaacatgggcccccccataacttgggaaggtgggaagctaaacatagcacttcctcattttggattggggcatctgagctgggatgctctgaaaggtcatttttttgggcccaccgaaagtctcgggttcttttggttgggatgcccattggttggtccatcaaagggggaagtatcacatggatccccggcgggcgaggggtttgaacttccatccatgggaggtggggatatgccctcatgggtgaccttgggatgggggggaacgtttcccctgcccccatgctcaaccttttggagctcaaaaaagtccactagcacattggttttaagaagaacctttttaaccaccttttttttgagcccca

SEQ ID NO: 15036 - DNA, 543 bp, Zea mays
  unsure at all n locations
  Clone ID: cC-zmpo14820003f03d1
tcgggcttcggtgaatgcggtgatgacattcgggaggcagccttcgggatcatgtttgcagctaggaggtgcggcgacctgccggagctgacgtttgcacgaaccatactgacaaacaagtttggaggcgagttcgcagagatggctaaggaagggcgctggcgtcgtcgaccccatgttggtatggaagctaactggcaacaaaggagacatggagctcaagaaaaaggtggtgaaagaggttgctgctgagaacaatgtgctagtggacttctttgagctccaagaggttgagcatggcggcagcggcaacgttccgcaccatcacaaggtcagccatgaaggcatataccaaactgacatggatggaagttcagagccatcgcacgacgaggatccatgtgatacttccaactctgatggagcaagcaatgggcatccgaaacaagagaacacgagaactttggtgcgcacaagaagatgaactttcagagcatnccaactcagatgcaacaattcagaatgaggaagtgctatgtttag

SEQ ID NO: 15037 - DNA, 522 bp, Zea mays
  Clone ID: cC-zmpo14820003f04a1
gaattcgagcaatgatggcaagcagcttgaaattgcaagctgctatatgaaggttccagtttcaaattacaaagatgtactaggaacaagatttgcattgttagattgaaaatacctcctacgataagccaattatgttccactcaagaatgaagataaacagtacatgctttgaagcatgtaatcaaacaaagaggcatttaaatgaccccaaaaactgtattatgcaccttgtaaaaacagctgcttccaaatggacaagtgccctttccgaagtcaaagtgcttacaatcaatagacctgagcttggccttgtaaccttcaacaatttcttgcttttcttcctttgaggagtaccaagtaatgctaggaactacatagtatgacaatttgcggcaaattggacaagccctgagtgtagagttgacatccatgccagacgtaggagaggtgctacgccaattcctaatgcatgagatacagaaagaatggtcgcagtcagatagcagcccaaacctcctt

SEQ ID NO: 15038 - DNA, 540 bp, Zea mays
  unsure at all n locations
  Clone ID: cC-zmpo14820003f04d1
attgcagcgaatgccaaacggatttatgtgaccaaacacagcagatttgcaagtcaacagcagcactttctgcacatcaacctgcatgatagttgattatcatgaccatgacactccagatgatactacaagctggccgttgcaccaagcntgtgcaaaaatcaaacatcacaatatcctgttcatctgccaatttgctcttctgctgctgatggcacttgtccttatgggaaaggctgttctcagatgcatggagatctgtgtgcattctgtgaaagacagtgcatgaatccttatcaatctgatgaaaggggggtacatgtcaagctatgcaagaaaaacaatagagttcttgaggccatgagaagaagtgaagacatagaatgtggtgtgtgcttggaccgagtgctttcaaaacctacggcagcagaaaggaggtttgggctgctatctgactgcgaccattccttctgtatctcatgcattaggaattggccgaagcacctctctacgtctggcatggatgtcaactctacactc

SEQ ID NO: 15039 - DNA, 168 bp, Zea mays
  Clone ID: cC-zmpo14820003f05d1
gctatgaatatctatgcatgcatggtaacgggttgtgttatttaattattattattacgtagacattactatttaaaattcatgtgttctctttatagtcgctctgtaatcttgtgatggaatatatatgatatttccttttaaaaaaaaaaaaagaacccataacat

SEQ ID NO: 15040 - DNA, 543 bp, Zea mays
  Clone ID: cC-zmpo14820003f06d1
gtggatggtgatgtcacgaccttcgtggacaataatggcgcctctcctagcgtcgatgctgctcgtcgggctcgccgcgggctccgaggaggaggaggacggcggcggcaaaaagaagccccacgtcaaccacggcaagtttaaggcggagccgtggacggacgggcacgcgacgtactacggcgggcgcgacgggttaactgacaccacggacagcggcgcgtgcggctacaagggcgagctggggaaagactacggcaccctgacggcggccgtgggcccgtcgctgtacaccaacggcaccgggtgcggcgcgtgctacgagctcaagggccccaagggcaccgtggtggtgacggtcaccaacgaggccccgtcgtcggtgagcgggcagaagggcgagcactctgacctcaccataccggcgttcctcaagatcgccgaggagaaggccggcattgtgcccatcacctaccgcaaggtggcgtgcgagaggaaagggcgcatcctgtacacgatcacagggaaccagcactacagcga

SEQ ID NO: 15041 - DNA, 450 bp, Zea mays
  Clone ID: cC-zmpo14820003f07d1
gttcacggccgggccgtggaaacccgcccacgcgaccttctacggtgggcgggacgggtccggcaccacggcgggcgcgtgcgggtacaaggacacgcgcacgcaggggtacggcgtgcagacggtggccgtgagcacggtgctgttcggtgaccgtacggtctgcggcgggtgctacgaggtgcggtgcgtggacagccctagcgggtgcaagcccgacgcggtggcactggtggtgacggtgaccgacctgtgcccgcccaaggaccagtggtgcaagccaccgcgggagcactttgacctcagcatgcccgcgttcctccagatcgcgcaagagaaggccggcatcgtgccgatctcctaccgtagggtggcgtgcgtgaagcagggcggcattcggtacaccattaccgggaacaagtactttaacatggtgacgatcaccaatgt

SEQ ID NO: 15042 - DNA, 616 bp, Zea mays
  Clone ID: cC-zmpo14820003f08d1
gtacattctctctctcctctctcggccttcttcgcgtgtttccctctttttcttaggccgccctctacacttgtcgacataaccatcgagagggcggtcgagagaaacgagagcggcagacaccatggggagctcgaggaccatcgttgcgtccccccctgctccctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggagaaggccagggaggccaagagccgggtggacgagttcgcggcgaggaaccacgagggccggtcgatggagttcattctcggagcctgcagcaacgggtacgacaccgttgtgcagacgcttgaggaggcgcggaagatcgtcggcacgccgtccgtcgctggcacccaagcccaggccgacgacatggacacgaagctgtcggccgacggcacgagcgccagcgactgcgacaacggctttcgccgactttccggcg

SEQ ID NO: 15043 - DNA, 532 bp, Zea mays
  Clone ID: cC-zmpo14820003f09d1
tacatggatcagccaaaaatttaccagcttcatgtacctcaaagccaaagcaatcacctgagctgtgtatgttcccacagtatgttgtcccgacaatgcgcacaccattgttcatacttaatgcagcctacgattcgtggcaggtcaagaacgttcttagaacctagtccagctgatccgaagaagacttgggcccaatgcaagcttgacatcaagagctgctccgccagccaactcacaaccttgcaaaatttcaggacagattttctggcagcactccctaaaacgcagtctgtaggcatgttcatcgactcatgcaatgctcactgccaatcaggatctcaagacacgtggctagccgatggttctcccacggttaacaagacgcagattggcaaggcggtgggggactggtactacgatagggaggtccctcggcagattgattgcccgtatccctgcaacccaacttgcaagaaccgtgatgatgattgagcaatggtataagtagttcatggtatcgaaatgaaaa

SEQ ID NO: 15044 - DNA, 532 bp, Zea mays
  Clone ID: cC-zmpo14820003f10d1
tccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatttcgggatttgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagctaccaggtgcgcaggccgcactctggccgcgcccacggcgttctctacttctgctataagttcaccgaggtccccgccgtctcttgtgtctcggaaccggaaagcaaacaagtcccgtacgccaaga

SEQ ID NO: 15045 - DNA, 552 bp, Zea mays
  Clone ID: cC-zmpo14820003f11d1
accacgccttcggtctgaccgtgagatgatgacccagatcatgttcgagaccttcaacattcccgctatgtacgtcgccatccaggccgtcctgtctctgtatgccagtggtcgtaccacaggtatcgtgctcgactcgggagatggtgtcagccacactgtccccatttacgaaggatacgccctacccgacgccatccttcgtctcgacctgtctggccgcgacctcaccgactaccttatgaagatcctgactgaacgcggctactccttaaccaccactgctgatcggcaaattgtcagggacatgaaggagaagctcgcctacattgacctgcactacgaccaggagatggagactgccaagaccagctctactgctgagaagagctacgagctgcctgacggacaggtcatcaccattggtgctgaacgcttacggtgccctgaggtcctattgcagccatccttcattgtgatggaagctgcttggatgcacgagaccacctacaactgcatcatgaagtgcgacgtggatattacgaaggatct

SEQ ID NO: 15046 - DNA, 669 bp, Zea mays
  unsure at all n locations
  Clone ID: cC-zmpo14820003f12d1
ttccctggtttgaccacgcgttcgcccacgcgtccgcccacgcgtccgcacggtgtggagcctgctgcagctgatgcggcggtaccccgggcgcgtgcccgacgtggacctcatgttcgactgcatggaccgccccgccatcaaccggaccgagcacggggacggcgctctgccgccgncgccgctcttccgctactgcaccaccagggaccacttcgacatccccttccctgactggtccttctggggctggccggagacgaacatcgagccatggaaccacgagttcaagaacatcagggcgggcgccagggcaacgagatgggcggacagggtgccgacggcgtactggaagggcaacccggacgtggcgtcgccgctgcgggaggcgctgctgggctgcaacgacacggtcctgtggcgcgccgagatcatgcgccagaactgggacgacgaggccaggtccggctaccagcactcgaggctctcggcgcagtgcacgcaccggtacaagatctacgccgagggcttcgcgtggtcggtcagcctcaagtacatcctctcctgcggcttcatggcgctgctcatcgagccgcgctaccaggacttcttcagccgcgggctgtagccccgggtgaactactggccgggtcgccgccttgcatgtgc

SEQ ID NO: 15047 - DNA, 164 bp, Zea mays
  Clone ID: cC-zmpo14820003g01a1
aaaaggggaaaacccccccaaggggggggggaaaaaaccccgggggccgggggggaaatttttatttttttggggggggtcccggccgcggggaatttcccatggggaaaaattttccccgggggttacaaaattttttttgggggggaaacccttaaacgacc

SEQ ID NO: 15048 - DNA, 283 bp, Zea mays
  Clone ID: cC-zmpo14820003g02a1
gtcggccccctcccgcttgaaatgaaaacaatttcggtttttttcggtttttcgaaaaccgtttttgattttttcgactgaaaccagcagttccggtttttttcggagccggcatcggttatcggaattttgtttcaaaatcgggatcgaaaacaatataagatttttccgaccgttttaatcggttcccgttttcaaacgaaatttaccgaatttaggtatcggaatttttccaaaaacaaaaaattaagttggctttttaaaagcccacactcaattatgg

SEQ ID NO: 15049 - DNA, 347 bp, Zea mays
  Clone ID: cC-zmpo14820003g02d1
gacccactgcgtgcgccattattgagtgtgggctttgaaatagcctacttaatttatagtttttggaaaaattccgatacctaaattcggtaaatttcgtttgaaaacgggaaccgattaaaacggtcggaaaaatcttatattgttttcgataccgattttgaaacaaaatttccgataaccgatgccggctccgaaaaataccggtactgctggtttcagtcgaaaaaatcaaaaacggttttcgaaaaaccgaaaaaaaccgaaattgttttcatttctagcgggagggggccgaaaaaattcaaaaaacatggaactatacctaaataaataaatattaaaaa

SEQ ID NO: 15050 - DNA, 340 bp, Zea mays
  Clone ID: cC-zmpo14820003g03a1
aaaaaagggggggttttttttttttttggggcttttttgttccaaagaaaacaaaagggggtccccaaaaaggggggggggccaattttaaaatctttttaaaaaaaaaaaaaggggggggggccccccacgccaagggggagagagcccttttttgggggggaaaaaaaattttgggggggccccccctggagggaaagcccctttttgggggaaaaatttggggttggggaaaaaaaaaaaaccgtcgttgcccccaaaaaaaatcccccacccccgggtttatcaaacaaaaaaacccttcagggaaaacccgggggggcacaagggggggctattt

SEQ ID NO: 15051 - DNA, 559 bp, Zea mays
  Clone ID: cC-zmpo14820003g03d1
gcgccatccgccgtgaaagttgcccctcatccgtcttccatcctctcccccacgtcgcgcccccttccatcctcgctcggccgtgctcggccttaaatccccgtgaatgtcgtcggccttccatcagttctcgaggacggattcccagggcgcggccggaggcggacgtcggcgggttggcctttccacgagatcagtgaggtacaaaatggatgagggctgcgctgacgatgatgacgacatggccaccatcgtcgccctcaggatttacctgaagggagttatggatcggatggaacaggtggttgtggaatttcttgaggtagcagtcagctacatcgtcttcctcaaagccttatattctcctcataatagtgctctctcattcgagttggttcagtcaagaattttttgtgccatcaaagaagtagctcatcatggcttgcatcggggaacctgcttccatattgcttttttatgaaggatttgagaattgcgcaacaacagtttcagggaagccatttgtgtcatcaatgtaacatgaaagctcagataaatg

SEQ ID NO: 15052 - DNA, 207 bp, Zea mays
  Clone ID: cC-zmpo14820003g04a1
aaaaggagatatcatatatatgtgatcacaggataacctaacgacttgactcgaacacttgaagtttaaatagtgatgtctacgtgataataattattaaataacacaagccgttaccaggcaggcatagatattgataggggaccacgagtactctgtgggaacatcgttgaaggtgaggtagaccatgcagtgcatagatgttca

SEQ ID NO: 15053 - DNA, 346 bp, Zea mays
  Clone ID: cC-zmpo14820003g05d1
cgtttattaatttcagacccacccactgctaaccacatcgtgcacgagagattatattcatccgtggactacgctctcgatcttataaatagattctctttctattttcctaattactatgtattccaggttcattttgattgtgaccattcttcagttctttctgtaaggatcggagcatattatatactctatgtggctatgccaattatattgttgggtataagaatgcattttgtttctgtaatacggaaaaatatattttctttaagcaaaaaaaaaaaaacaaaaaaaaaacaaaaaaaaaaaaaaacaaaaaagaaaacaaaaaaaacaaaaaagaaaa

SEQ ID NO: 15054 - DNA, 582 bp, Zea mays
  Clone ID: cC-zmpo14820003g06d1
acggagatggagtgcctgctggggctgctcaaggtgcgggtggtgcgaggagtgcacctggcaatctgcgacccgctcacccacagcagcgacccctacgtcgtcctccgccacggaaagcagaaagtgaaatcaagtataaaataccgcacgataaacccagaatggaacgaggagctcaccctgtccatcacgaacatgatgaacccggtcaagattggactcttcgaccacgacacgttcaccaaggacgacagcatgggcaacgccgagttctgcatcctcaacttcgtggagatcgcgaagcaggacctgagcgacgtccccgacggcacggtgataaagacgatccgtccggagaagggcagctgcctcgccaccgagagccacattacgtggaaggacggcaaggtcttccaggacatggtgctcaagctcacggacaccgagaccggaaagctcgtcctgcaccttacctgggtcaacatcctaggcgttgcgatgtgaatccccctgctgcttgatgcggcgacgcctgcccaactggtttactacactaaatatatccgattatacgatttg

SEQ ID NO: 15055 - DNA, 562 bp, Zea mays
  Clone ID: cC-zmpo14820003g07d1
gttgcagcagcatccatcgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggtgcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttggttaaggcataatatataaactgccaaattcacatgtattttgggatatttgttatcatactatgaaatgactgtgaatccgtgttctgatttgtctttcaccacatgttttccttgcatgaagtaatatacgatatttatgtaaaaaaaactatacta

SEQ ID NO: 15056 - DNA, 441 bp, Zea mays
  Clone ID: cC-zmpo14820003g08d1
cggacgcgtgggcggcgacatcgagctgatggaaatccagtacatgttgtcggctgagtggaagcccatgaagctctcttggtgctctcatctggaggatggacactgccaaggcgctcaagggccccttctccatccgcctcaccagcgagtccggcaagaaggtcatcgccaaagacgtcatcccggcgaactggagacccgatgccgtctacacttccaacgtccaattctactagactttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaagcaaaaggttaaatataaaaaaaaaataa

SEQ ID NO: 15057 - DNA, 534 bp, Zea mays
  Clone ID: cC-zmpo14820003g09d1
ggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggtttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaagcggacagggaccgtgcccgcgtcctgctaaccgggaacgtcggcattagcgacaacctgcgccccgccaacccgttcggctaccttaaggacctgccgctgcccatctgcgccttgctgctaatacagttggactctgacgacgacgacgatcaggaatagcacattgacgac

SEQ ID NO: 15058 - DNA, 544 bp, Zea mays
  Clone ID: cC-zmpo14820003g10d1
caatgggcagcgccgcggtcatgtacagcgggaagaagtcgtccagcgacggtggccacaagtctgcttccaaaggcaagtcgagcggcgggtcagactcggactcgggagcggaagcggaagcggaatcggaatcggaatcggggtcggaatcggaagacgaatctgaaggccgtgtccaagagcatcaaggcgatgtgctcgcagacggactacacggacgcgtgtgagaagagccttggcaaggccgcgaacgccagctcgtcgtcgcccaaggacatcatccgcagtgctgtggaggtgatcggcgacgcgatcggccaggcgttcgaccgcgccgatctgatcctgagcaacgacccactcgtgaagggcgctgtcgccgactgcaaggaggtgttcgcggacgccaaggatgacctcaacagcacgctcaggggcgtcgacgacaaggacggcatcgccaagcagagctaccagctgcgcatctggctcagcgccgtgatcgcgaactggagacgtgcgtcgaccggttccccgatga

SEQ ID NO: 15059 - DNA, 332 bp, Zea mays
  Clone ID: cC-zmpo14820003g11d1
ttccgtggtcgtaccacgccttcgctccgatggtatccatcacgacgacgcggctagctgcccggtctgcctggaagactacgcgcccggccagcgtgcccgtgagatgccctgcatgcacaggctccagcgcaatagcatcggcccgcggctcaagaggcacatctgctgccctgtgtgccgtctgcatctgacggctaccggctacaggagatcatgcagcgtccgagacggagtgtacctcaatgtcgatcctgatcgagacggccatgaccacggacggtgcgatggtcgggcaagctgtccgggcaacgcctatctagcatgcacct

SEQ ID NO: 15060 - DNA, 568 bp, Zea mays
  Clone ID: cC-zmpo14820003g12d1
acgcccacgctgagatcgtatccaacacaacgacggcgctcattagcaatgtcgcattgaatgctgcgggcgcggacgcgctgctgctggtatgagatgtgtctactggatcgcgcgctgcggtgtaggcgacagtgtgaagagcgccagcagaagcgttgggtgccgcaaaccatcagacagcagggcgatacggacgacctaatcgcgtactagaacaactggacctgtatccctaacctcgatcatatgttcatcaccaggaacacgaaggaagcccacgcatcagcggaggagctgatgaataaccatgctccaggacctgtacaagatgacctatcgtcccgtgaagccagctgctgaaggttgctacaaacgtcgagatccgtggaacctcgccacacctcacttagcagctccaccttaacatccaggagcacggcagccttcacggccagcgccacagtgtcgacggcgccggcgaccacctcaacgacgacggcgtcgacctcgacgagttcagctacctgagcagcatgagcagcatcagcagaagtgggtgacgact

SEQ ID NO: 15061 - DNA, 549 bp, Zea mays
  Clone ID: cC-zmpo14820003h01a1
ataagtattatatttatttttagaccaatcgcaaacagaggtggttcatgttatacaaactgtatacgtagatacacgcgtgtgggattaaatcaatccctacttcctctgtgggaaaaaaaatgaccaaactgtactgtgatgtgtaacaatgccacaacacagtacttgaaggcaaacgtagattaattagcagaacgacaacctgtgatccatccttgctttcttccatgaaatgaaacgcagccatcgcgacctggcatggccaggccatgagctagaagaagcagcctctgacgcccaccggccggccttcagcacggcttgcccgtgcagcaagacagtgtgccggagaagcgggtgagccttgtaacgtaggttcctggcttgggcttgacccactcgttggtgtcgacctgcttgggggcgccgccggacggattgaagatggcgccgttcatgaacaggtcgtcctccgtgtgccacacccagttttttcacacgccttcttccgcgtagtgcttggtgatcacttttggcgcgatgttt

SEQ ID NO: 15062 - DNA, 502 bp, Zea mays
  Clone ID: cC-zmpo14820003h02a1
agtcaaaatagcataaaccaaccaacaaactaaaccatggtacgtacatgttagtgccacgtcatatcgacaacgcagcctgccgatcatatatcatcttccttagatgtcagtgtatcctgcccgattgctgctgcggcagcagccccgggatgaatggcacgccgagctgtgggagccagtgctggccctggatgaagctctcgacggtgtacttctgcagcgcgtgctggtaggtgatgttcttgatacccctccacttgacgcgtctggtcatgttggcgccgggcccgtggttttccacctcggcgtagtagcaggtgctgaggccgaagtcgccgctgccgtccttggccaccgtcacgtcgggcctgaaagcccttctcgccgggggagaccagcagcagccggcgcttggcgtcgggcatccaagaaggcgcgccgcgggcgtgctccgcgaggagccggcagtggaagctcggcaggcccaggttggcgagcg

SEQ ID NO: 15063 - DNA, 459 bp, Zea mays
  Clone ID: cC-zmpo14820003h03a1
gtgcttagaacaaatcactctctgtttttaagatgaggaactgttcgagaaaaagagtgaagatctcaacagaaaggtacattgtctaccatagttgcatcaactttccttttgatcttcttcttcgacatgccgccgattatatccttcagcgatgcgcacttggttccgtgtggccatcgcgcccgcagtagcggggggccgtgcccgccactcacctgagatagtgcacgttggggccgatgctgcccgcatggccggacccgtgcgcgccgctagatggccgcgactcatgctgctgaggccgagccggatcgccgtcgaggccagggttgaggtcgtctgcctggccgggcccacgcgtgcccggggagccgtgcccgcgctccatgtgaaatcaggacaaactcccgccgaagctgggggccgtgttgcccacctcgcccgcgctgcaaggga

SEQ ID NO: 15064 - DNA, 450 bp, Zea mays
  Clone ID: cC-zmpo14820003h04a1
gcccttgaatcagggcgctttcaagtttgaacagggaacagattaccattatatacatgcccattcaattcctttcgcgtcgaatgaacgacagagatttcgacgcatgtccagtacaccgactgagatgaccaaccagccagctggacctgtactcacactcacactcactgggcatggccgaggatcgtgaagggggggtcgaactgggggagcttgtcctcgtcgccgtcgccgtcgaggtaaatgccgccgttagggaaaaccaccccgacgcccttgggcctgcacgtcctgtccgtggccgggttgcacccgtacgcggagcccccgggcgtgggggggtccgcggacctgacgagcagcacgcaggggagcgccaaccccatggcaaacaagcgtgcccccggcggggacctcctcatggagatcgatcgattggccgacaga

SEQ ID NO: 15065 - DNA, 515 bp, Zea mays
  Clone ID: cC-zmpo14820003h04d1
ggacttccggttccgtgctagcgtctagcgatcgcgtcggcctccactccaccttcccgaaaaagcttaccctttgtgtttgtgtgtttgtttggcaatcgatcgatctccatgacgacgtccccgccgcgcgcacgcctgctcgccatggcgcttgcgcttcgcctgcgtgctgctcgtcaggtccgcggacgccgccacgcccggcggctccgcgtacgggtgcaacccggccacggacaggacgtgcaggcccgagggcgtcggggtggtgctgcctgacggcggcattgacctcgacggcgacggcgacgaggacgagctgccgcagttcgacccacacttcacgatcctcggccatgcccagtgagtgtgagtgtgagtacaggtgcagctggctggttggtcatctcagtcggtgtactggacatgcgtcgtaatctctgtcgatcattcgacgcgagaggaattgaagggcctgtatttgatggtaatctggtcactggtcaaacttg

SEQ ID NO: 15066 - DNA, 296 bp, Zea mays
  Clone ID: cC-zmpo14820003h05d1
cacacacgtccgcccacgcgtccgcgtgagtccggcgcaatctggaacaagacatggaagaaaaatgagagcaaggaccttaaaactatttttattgtgtggccaggcactcatcgcatggatacatccatagctctccctggtgaggtgtatgaccgatgtccaaccgtgacaccaggtggatagataactgtatcgactcacggcatgaagatctaaaacattatacgacctgggatcttgagccactgagatccagagacaacgaaggactcactaggcccgacacagaaccc

SEQ ID NO: 15067 - DNA, 459 bp, Zea mays
  Clone ID: cC-zmpo14820003h06d1
ggcttctgatggccctcgacgccggcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgtcggagcatgttgcgcgcccgcgttaggacggtc

SEQ ID NO: 15068 - DNA, 446 bp, Zea mays
  Clone ID: cC-zmpo14820003h07d1
agcgacatgttcaggtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgccttcgagggccctgcgagcgccagcggcccgtctggtgacgacgcgccggcgttccgtgcttgtgccagcgcgtcggc

SEQ ID NO: 15069 - DNA, 569 bp, Zea mays
  Clone ID: cC-zmpo14820003h08d1
cgagccacgcgtagcgcccactcgtaacgcccgacctactgaccttgtacaacgcacgcacggtcccagtcccaagggcccagactctgtccgacgactatgtatctgttccaccctgaagcgcccgatcggcaacgacgggatcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcacttcaacccgacggtgctggcgctggggcggcagatggcggcgctggagggcacggaggcgggctactgcacggcgtccgggatgtccgccatctcgtccgtgctgatgcaactggtgggcgcgggcggtcacgtggtggcgtcgcggtgcctgtacagcgggacccacgcgctgctgccccggttct

SEQ ID NO: 15070 - DNA, 469 bp, Zea mays
  Clone ID: cC-zmpo14820003h09d1
gcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagaacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacggtcagggcccagccgtgtggagcaagaacttctgcaccagaagtacgactgcaagat

SEQ ID NO: 15071 - DNA, 369 bp, Zea mays
  Clone ID: cC-zmpo14820003h10d1
atcgcatccaccggtcgttcgtcgtcgccggacacctcgccgccggccgtcgcgcgcgcgtctatgggcggcttcgctatccaccccgcccatggacgccccagcgacagcctgccgtccgccggcaccgggaggtcgacgacgtcctcgtctggcttcctcccttgacgacaacggcgtccgcggccagcaggcccgcacaccgggccacacgctggaggagccgccatcgcggcggcggcaccaggcgggctcgtcgtcccggccggcccggctgttccagaggctgcggcacgcgctgcccctcctgacgctggcgccgcgctgcgggcggatgccgcaggtcggcacgcccgccgagatcgcggc

SEQ ID NO: 15072 - DNA, 643 bp, Zea mays
  Clone ID: cC-zmpo14820003h12d1
acgcctacgcaagaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaggagatatagatggagaaggagaagccatcgctaagctaattgactgcatgtcaattggctgatgcctgatgatcaatgtgcatgaaagagatcgaccactaattggcatacatgtttaagtcgggagagagactcggtcacctttgaaacaaaacaa

SEQ ID NO: 15073 - DNA, 181 bp, Zea mays
  Clone ID: cC-zmpo14820004a01a1
gctggtgtaaataaatgttaagataaaagtatatataactcccattacaatgattgttttttaaaaccccattacagtgatttgagagggcatctcaagattacatcaatagatatatccgtgcgttctcatttggctcacccccacccaacgtcccttctcccttccctaggcttccttc

SEQ ID NO: 15074 - DNA, 181 bp, Zea mays
  Clone ID: cC-zmpo14820004a01d1
gaaggaagcctagggaagggagaagggacgttgggtgggggtgttccaaatgagaacgcacggatatatctattgatgtaatcttgagatgccctctcaaatcactgtaatggggttttaaaaaacaatcattgtaatgggagttatatatacttttatcttaacatttatttacaccagc

SEQ ID NO: 15075 - DNA, 498 bp, Zea mays
  unsure at all n locations
  Clone ID: cC-zmpo14820004a02a1
agtagtaactgccagcatgcctttttattattacccattcaatcgatgaaaaacacacatttgcgtgacattacatttggagttccatcgacggtatatttggaaaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatggttcattcatttcaaggggcttcgcttcaagaaggaggagagggtgcaggacctcttgcagttctcgctgaggcgcgggttcttctccttggcgcaggtgacgctgcaggccttggtgacctcggccgncttaccacgtacgccttgtcgcacttcctctggcagaccttcatggccggcgccgtgatgcccttctgctcggtgcacttgcccttgcac

SEQ ID NO: 15076 - DNA, 607 bp, Zea mays
  unsure at all n locations
  Clone ID: cC-zmpo14820004a02d1
gacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcatnttctaagctaattgtttttttccaaatataccgtcgatggaacttcaaatgtaatgtcacgcacatgtgtgtttttcatcgattgaatgggtaataaaaaaaagcatgctggcagttactact

SEQ ID NO: 15077 - DNA, 266 bp, Zea mays
  Clone ID: cC-zmpo14820004a03a1
atgacccggtcaatttcccggaaatatcggaaccgaacctctaagcgaaacaaattaaccgaaaccaaccgaaaacaaacaatggcagacagcaggcgaaaactgcgacccggcggaaaaagacagccggtaaaaagccaacaaagaaaacacggaggaacccaaaacggaaacgacggccgggaacacggccgaggaggcgctgatgggggcgggcgcccgaacctccccagctaggaccacgaaacctgaagcggcagcggcaa

SEQ ID NO: 15078 - DNA, 379 bp, Zea mays
  Clone ID: cC-zmpo14820004a03d1
caccgttttctcgggtgcgacccacccgtccgaaaaaaatataaaaaaaaaaaaaaataaataaaaaacatttttttttaaaaaaaaaaaaaaaaaaaaaaagagaatgggaaaatttcataaatagggctcccccttttcatgccccatcttttcttccccttactttcaatttctttcctcttttatagtggtcccttatttcatttccctgtccgtctttttccttttctttgtctggtaaccccctgcttttccccccttttattcctctgtttcctttccccctttcccctgttgggtcacttcccaataggcccccaccgttctccctccccaccttttggccctttccgtatgccctttgggaccccccctt

SEQ ID NO: 15079 - DNA, 283 bp, Zea mays
  Clone ID: cC-zmpo14820004a04a1
gggaccaaaaaagtttgggcaaattcgatgaacaaataaaactacaaactggattcaactggaatcaggggccaaaacacccaaagccgtacagattcacacagcaggggaagcaaggggtttcgatgacccaaatgggaaaaaggggggcaacagggggactcaaacgttcagcagctacagctagtacgggtttttcatggggaaaaccaaggaaacaagacctgcattgcctttttaaaatgccaagcacgggttggggttcctcctttaaatcccgggg

SEQ ID NO: 15080 - DNA, 596 bp, Zea mays
  Clone ID: cC-zmpo14820004a04d1
acccacccgtccgcctctgccctctggtcacctcgcttccgctcccggctcccctcctgccacccagacatcgtccgttcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggcgatggtcagatcaactacgaggagttcgtcaaggtcatgatggccaagtgagtaaagcctgcggtaacggtatactaccccgcgggaatt

SEQ ID NO: 15081 - DNA, 452 bp, Zea mays
  unsure at all n locations
  Clone ID: cC-zmpo14820004a05a1
acaccggaacttctagttcattaaaaactattcagcatagtactggtactaatgttatatttcaagatttggatattgcaaaagaaagacaatatacaacacctccacttagcgaaggaacaagtgctgtacaggtttgctgctctaccaattgaatgatcagactcagaagtagcaaccagttcagagaaaaactgagttgctctgttttgcaggagcacccattggggcaaggtcactgaaaggatcaccaaatgggttcgaagctccagatgtaggcacagagtactgatactggtggtgatacatgtttggcattggcattgccaacgtctgttgatgctgctgaaaatactgctgctgctgtggctggaaatacagctgcgcctggtaatactgctgcgcctggtaatactgctgnntggttctgagccatcagtgccaactgcaca

SEQ ID NO: 15082 - DNA, 547 bp, Zea mays
  Clone ID: cC-zmpo14820004a05d1
ggacgaagagggcgcatcgtgggttgggtgatcacggcctgatggggtcgtggcgcaaggcctacggcgccctcaaggactccaccaaggtcggcctcgccaaggtcaacagcgaattcaaggaattggatattgcaattgtgaaggcaaccaaccatgttgaatgccctcccaaggaacggcacgtcagaaaaatactcttggcgacctcagcaaaccgccctcgcgcagacctctcgtactgcatatacgcattgtcaaggagattgtccaagacaaagaactggatagttgcgctcaagacattgatagtggtgcataggcttctgagggagggcgatcccatgttcaaggaagagttcctggcctactcatccagagggaacatcttgcacatagccaatttcaaggacgactcgagccagtcagcttgggattgctccgcatggattcgcgcctatggatgcttcctggaggaacggctcgagtgcctcagggttctcagatacgacatcgaaaccgagccgtctgtcagatatccccagac

SEQ ID NO: 15083 - DNA, 499 bp, Zea mays
  Clone ID: cC-zmpo14820004a06a1
atcgcatccgttgttcctttgcaagttttgactgaatttgtaaatgcagttctaatatcccaactaattcgaaacgattttctgtccgcagcaggcgtacaagcaagcgtttctcccttttgccgacactagtcagtgccaagcgcggggcccgatcacatgtccttgcagagcctgcggctgaggctgctgaagttggccctggagtactggcgggagccgttcctccagtcggtgccggacttcatcatgagctcgaactcctggtagctgatccggccgtcccggtcggtgtcgacgtcgcggatgatgtcgaggatggcctggtcgttggggcccagctcatcccgcagctcctcgggctcgatgaagccgctgccgtccttgtcgaagtacctgaacgccgacgccaggtactcgtcgttgctcatcttcttgaggtgcagggacaccgtcacgaactcgtcgcagtccagggtgcccgtgccgtccgtgtcgg

SEQ ID NO: 15084 - DNA, 514 bp, Zea mays
  Clone ID: cC-zmpo14820004a06d1
catcgacttcaatcgggagccatggccgagagtgtccgccaactccaaggacctcatccggcggatgctcgacccaaacccctccacgcgcctcacggcgaggcaggtgcttgagcacccgtggctgaagaacgcggacacggcgccgaacgtgtcgctgggcgaggccgtgcgcgcccggctgcagcagttctccgccatgaacaagttcaagaagaaggcgctgggcgtggtggcgcggaacctgccggtggaggagctggacaagtacgtgcagatgttccacctcatggacaaggaccacaacggcaacctcacgctggaggagctcatggacggcctccacatcaacggccagcccgtgccggagtcggagatcaagatgctgctcgaggccgccgacacggacggcaactgcaccctggactgcgacgagttcgtgacggtgtccctgcacctcatgaagatggagcacgacgagtaccctgcgtcggcgttcaagtccttcgacaag

SEQ ID NO: 15085 - DNA, 527 bp, Zea mays
  Clone ID: cC-zmpo14820004a07d1
accgtgacggcgcccggggacagccccaacacggatggcatcctcatgggcgactcatccgggatcaccatcaccaacaccgtcattggcgtcggcgacgactgcatctccatcggccccgggacctccaaggtgaacatcaccgacgtgaccatccaggtggatggcaatctgctggcgaccacggacctaagccagtacaaggaccatggtaattggatcgagattctacgcgtggataacctggtcatcaccggcaagggataccttgacgggcagggcccagctgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaatgacgtgaccgtgacggcatcagcatcggaagccttaggcggctcatggacgagatggacgtctcggacatcaacgtc

SEQ ID NO: 15086 - DNA, 469 bp, Zea mays
  Clone ID: cC-zmpo14820004a08a1
ggcagcacatccagcagacagataagctagccttttgacaccgtgaaaacaaattatgatacattatgcacccccagacaaacataatgcagacatgttccttgtgatctatagcatatacctaatacgttccaaatgctgcaatgccaactaccagaatgcttgaatcaattaggactgttccccatcaaaattggcaaaactgagctgcgtttctcggacagtagcctcagccttatggtaacaacagggaacctccgcaccagatgtgtctcccctcgagctcggaacaagtttcattggcaccatgacgagggcggtctcatggacacatgcacctcatgttcttcagggccaacacggtactttgggacaataatctccaggcctgtccccgtttcatcgcggtatgctttcagagtggcatcttcagggatccgggtaggcagtgggatttcccggacaaact

SEQ ID NO: 15087 - DNA, 539 bp, Zea mays
  Clone ID: cC-zmpo14820004a08d1
cgcacgcctggcctgggctggccgcttcgcttccctgcgtctcctctccaccgcgtcgcgtgggccctctgcgctacgagggcttcaaatggccctctgcgccgtcccttccgtctagcgccctgccataatgcacacccagccatcttctgatcctcctgacacctccaacatgaaggtcaagctggagatccctaggcagcaggccatgccgtcgtcgcggtccctgccgcggagcagccgcggcgccgggaggtggctcggagcaacgacgtgatcgaggcggcacgcaccaagctgatgcagaagcgccagtgcagcagggtcaaggcgctcgtcggcgccttcgagactgtcatagacacccagaaggacgccgccgtcggcaggccacatcacatctaccgcaagtcagcttaaaacatactgcggcggcggtgacgcatcgatcctccacgcttcgtgtcttcgccttaattaattaattaattggtatgatcatgtcggccagcccaacgccgtatgcatgcatgcacacg

SEQ ID NO: 15088 - DNA, 419 bp, Zea mays
  Clone ID: cC-zmpo14820004a09a1
gatcacaactggttaagatgtcatttgagtttgcacattgatttacatttttttaactccggcaccatatcggaatgcatgagcgaaagaatgaatatgcatgcatgatgcatgttatcatctgcatggttgcttgtgggcatatgcaggttgaagaagaggaggaaaagtggctacttagaagttcttggatgcctggtacgtgacaccgaacttccagtcagcggggagaacgtgccatgaggtggccttgcggtggtcgctggtcatcacccggaacgtcagcgactcgcaggtgaggtcctccccggtctgccacacttgcccccagttgcgctatatgtccgtgcacttgacacgcttgctgcccttcaccgacaccgtcgagatgtcgtcggcgccgcccacattggtgatcg

SEQ ID NO: 15089 - DNA, 438 bp, Zea mays
  Clone ID: cC-zmpo14820004a09d1
agttgacccacccgtacgcaatcactcaatgtgggcggggccttcgacatggctgcgttgtctgtgaaggggagcacgcgtgtgacgtggacggagatgaagctctactgggggcatgtgcggcagaccggggaggacctcacctgcaagtcgctgtcgttccggctgatgaccagcgaccaccggaaggccacctcatggcacgttctccccgctgactggaagttcggtgtcacgtaccaggcatccaagaacttctaagtagccacttttactcctcttcttcaacctgcatatgcccacaagcaaccatgcagatgataacatgcatcatgcatgcatattcattctttggctcatgcattccgatatggtgccggagttcaaaaaatgtaaatcaatgtgcaaactctaatgacatcttaaccagttgtgatc

SEQ ID NO: 15090 - DNA, 97 bp, Zea mays
  Clone ID: cC-zmpo14820004a10a1
cccaaaagcatgcctgatttctattttcatttaaaaaacaatgtatccattcgttcttgtttttttttcctgggtaaaaatgaatcttacccggccc

SEQ ID NO: 15091 - DNA, 100 bp, Zea mays
  Clone ID: cC-zmpo14820004a10d1
gaccacccgtcagctaagattatttaacgcaagaaaaaaaaacaagaacgtatggttacattgtctcttaaatgaaaatagaaatcagacatgctattgg

SEQ ID NO: 15092 - DNA, 547 bp, Zea mays
  Clone ID: cC-zmpo14820004a11a1
agtagtaactgccagcatgcctttttattattatccattcaatcgatgaaaaacacacatttgcgtgacattacatttggagttccatcgacggtatatttggaaaaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatgcatggttcattcatttcaaggggcttcgcttcaagaaggaggaggggtgcaggacctcttgcagttctcgctgaggcgcgggttcttctccttggcgcaggtgacgctgcaggccttggtgacctcggccgccttcaccacgtacgccttgtcgcactcctcctggcagaccttcatggccggcgccgtgatgcccttctgctctgtgcatatgcccttgcactggatcctgccgtacagcaccaggttggactgctgggagagcgc

SEQ ID NO: 15093 - DNA, 535 bp, Zea mays
  Clone ID: cC-zmpo14820004a11d1
tgggtttacccacgcgtccggctggatcgaattgtctcacgttaacaacatcgggatcaccggctcggtcacgctggtggtggcacgctggaggcagcggggggacgttcgacatctccaagctcggggcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaagggaagcatcgaggcactggcttgcctggtctgatgatgaccttccttttgcatgcatgcatggtatctcatccttgatgatgatctagctcactagttctttttaatttccgcttcattcgcttttccaaattcgattgtgtttcagccaaattgtttagcgggacatctcttgtctgatcttcctgctaaatagaagtggactcctatatatagaggcctttcggcacatataatatacgtcggaccaatattattgtgaac

SEQ ID NO: 15094 - DNA, 554 bp, Zea mays
  unsure at all n locations
  Clone ID: cC-zmpo14820004a12a1
ggcggaggccatcggcgggggcggggaccccgaggccgcggcgaggcggcgctgggatctgcccggcaaggtggccgggaacattgcaatggggaaagttgatatttctactgacgaagaaccagattgtgtagttatatgtccacctaacagaaatgctggtcacgaggaagttgtgagtggcagccatgatgaagattcttcaggaaagcaagagaacccttatgctatgaactcacatatggacagcaacggccaggaagatgtgtctgtaaacctagacctgctcaagctaattcatcagcaggaatcttctgtcagcaattcaccaaaaaagcctgcagtagctagacagcaagggtctggccatactgtccttgagccatgcgctgttgcacctgaaagaagatcatctggagcagggaatattgctcgaattcctcatcccaccagcagcggtgaaaaactttcagataaagtagctcctcaccaagagcatgcatagaagagtncatcattacacccagaagcctctcatctgacacacttttaca

SEQ ID NO: 15095 - DNA, 516 bp, Zea mays
  Clone ID: cC-zmpo14820004a12d1
tttttgggtttatccacgcgtccgaaagaaacaagagcacacaaaaaatacctctctagctcgccacctacaatggcctccaggttctccatcatgctcgccacgacgacactggctacatttttcgtgattggttcgcgcaccaccccgctcaccttcgaggtcggcaaaggctccaagcctggccacctggtcctcacccccaacattgccaccatctccgaagtggagatcaaggagcacggtggcgatgacttctcctttgagctcaaggagggcccggccggcacctgtacgcttgacaccaaggccccgctcaagtaccccctctgcatccgctttgccgtcaagtctggcggataccgcatcgccgatgacgtcatccctgaaaattttaagtgccgcaccacctacaagaccaccctcagcatttgatcagcctcttatgaggaataatatttcgaaagaagctatccgatccatgtttcagcgagctaaatattaattttttctatg

SEQ ID NO: 15096 - DNA, 588 bp, Zea mays
  Clone ID: cC-zmpo14820004b01a1
gatgttggtagataacaacattgttttttttatgagaaaaataaagggtgtaattgggagtgtcttgacatatgcacaatgcacctgaacctgagtcaattgaccgcccctgatacatttccttgccaaaatgtggcgacctatacacaaaacatggaaaactgggtacagttctcgtgttctctgttttagtcgagtttgcaggcagtagacacatcactcaatcaacatcttgttgttctttgacggctgcagcagcaagtggaccattgttactaccaagcttcagtgacgcgtccttgaacatcttgcggctgagggtgttgtacaccgctctcgagtactgccgcgacgtattcctccagtccactccagctttcatcatcagctcaaactcctcgtagcttatcttcccgtccctgtctatatcgacgtctaggattatgtcctcgatcgccttctggtcacctcttggagagagggcctccttcaactcttcgatctcgatgtacccgctcccgttcttgtcgaagtagctgaacaccttgggcaggtgatcctcgctacggattttctcaggtgaatgga

SEQ ID NO: 15097 - DNA, 562 bp, Zea mays
  Clone ID: cC-zmpo14820004b01d1
acccacgcgtccgattcactgttatgaacaagttcaagaagaaggccctgcttgtggtggcagagtacctaccagccgaagagctggaagcaatcagggagttgtttcagttgctggacacaaacaaggatgggcatcttacaatcgaagaactcaggaagggaatgcgattgataggccacaatgtccatgacactgacgtcgatatgctcatggaagctgccgacatcgacgggaacgggaccctggactgcaaggagttcgtgacagtctccattcacctgaagaaaatccgtagcgaggatcacctgcccaaggtgttcagctacttcgacaagaacgggagcgggtacatcgagatcgaagagttgaaggaggccctctctccaagaggtgaccagaaggcgatcgaggacataatcctagacgtcgatatagacagggacgggaagataagctacgaggagtttgagctgatgatgaaagctggagtggactggaggaatacgtcgcggcagtactcgagagcggtgtacaacaccctagccgaagatgttcaaga

SEQ ID NO: 15098 - DNA, 530 bp, Zea mays
  Clone ID: cC-zmpo14820004b02a1
gcatgcgccatttggctttttgttccagagtattcagggtattgtgtaattggagataatagtacaaaccaggttggtcgtcggtgtcgctacaaaacttgacatatgaatcatcatggcgaagacacgattacctctgcaatttacaaatcaagttactctataggtaggtagcctatccattgtccaatcgaacttttcttcactgcctgcgatcctacatgagcatcgatcgtggcagctggacttgtcacaccccgatggcagaatgcttttgtgggcttgtgtagcctaacaataaaacgattctacttgtcggtcggagtctcagttttcggaggagccgtgtgcctctgggcctgggagcgacccagatctaagttttgcatctcactggcgagcaaggcccttctttctttcaaaagttgagtcgagtagtcagcttggctaatgcagaggacggtgcggctccagaatccctcgttttagtacttgaataggcattggaaaccttgaccctgctcataact

SEQ ID NO: 15099 - DNA, 564 bp, Zea mays
  Clone ID: cC-zmpo14820004b02d1
ggcttgtcaacagaggaggctggctgttgcagtgataatgacgaggctcatattgcgaagcttgaaaacaagaagacccatcttcaatctaaacttacggaggaggtaaaagaaaacacagtcctccaggcaaatttagaaaggcgaaaagcagcactacatgagcgtcgtgtagcacttgaaaaagaagtggaaaatttacgagaccagttgcagaaggagagaaatttgagggcttcattggagtctgggttaatgaatatgcgaagaggacaagtgttctttccatcaacgatagacaccaagactaaagctgatcttgaggaagttgctgctgctgaagctgatattatgaacttgaagcaaaaggtttctgatcttcgggggcaactcaactaccaagttcagttgagttccacctcgttatgtgaatcatgcaacaagcgggcaataaatgcagacaagcttgtcgaaggtgaacaaaatgctggcctttctccacagattggcttctcagtcgaagcacccccaattcaagggtctaatctgtagttcctgacatgt

SEQ ID NO: 15100 - DNA, 498 bp, Zea mays
  Clone ID: cC-zmpo14820004b03a1
agccaccaaaactttcaactgtttatctatcgtcaaaaaaaatatagaagggctttcattccttaatgagcccggatttctctgtttcttttagacaactacaagaacggtgtttgctgtgtggaaccacaggatacactgacaaacgtaaaacttgctccagtttatgctactatgccgcaaccggctgaacgagccctgtcccggagggagtgctgtcgcctgtagcagcagcattctgatcataccttgacaagtacttgtctaccgctgcagcagcctgccgccccttcgtgatggcccaaaccaccagtgattgtccacgtctgcagtccccggcggcaaacacaccatcgacactggtagcgaagtctccaaactgcgctttgaagtttgatctgttgtccttctccaaacccaatttctcagctattgtcgcttcaggacccaagaatcccatagctaggaggacgagatcagcctcaataatctcttctg

SEQ ID NO: 15101 - DNA, 626 bp, Zea mays
  Clone ID: cC-zmpo14820004b03d1
caagaacttacggagtcttgacaaagcgttttattggcgatggatatggcaaggtgaaggcccttgaggtagtgcgtgtgaagtgggagaaagtagatggaagatttcaactcaaggagatggaaggatcagaagagattattgaggctgatctcgtcctcctagctatgggattcttgggtcctgaagcgacaatagctgagaaattgggtttggagaaggacaacagatcaaacttcaaagcgcagtttggagacttcgctaccagtgtcgatggtgtgtttgccgccggggactgcagacgtggacaatcactggtggtttgggccatcacggaggggcggcaggctgctgcagcggtagacaagtacttgtcaaggtatgatcagaatgctgctgctacaggcgacagcactccctccgggacagggctcgttcagccggttgcggcatagtagcataaactggagcaagttttacgtttgtcagtgtttcctgtggttccacacagcatacaccgttcttgtagttgtctaaaagaaacagagaaatccgggctcattaaggaatgaaaagccttctatattttttttgacaattgataacaggtgaaaagtttggtggct

SEQ ID NO: 15102 - DNA, 486 bp, Zea mays
  Clone ID: cC-zmpo14820004b04a1
atcaatcatcaatcacattgttaaatatatcacatacattttttattattacattgcatgtacgtgacattgttgtagaatagaagagaagtatttccccttccaaacaaacaaaaaagaagggaaaacgaagttcgtaatcgtagtatcgaacacacaatcatgtttccctttcctcgatcctctcttcttcccgcggaaaacgaaggaagcccacgcatcgccggaggagcttgtggatagctcgctcgcgggcctgtcccgatcacctgtcgtcgttgtcgtccagctgcgacgggctcctccaaaagccggtgccgtagaacctcgcccacacctccttctccagctcccccttttcctccagctgcaaggcgggcttcacgggcagcgccaccgcattggcggcgccggcatccacctcgacgacgccggtgtcgtccacgaggagctcgtatatctccgtggccttgcccgcggaggcag

SEQ ID NO: 15103 - DNA, 624 bp, Zea mays
  Clone ID: cC-zmpo14820004b04d1
cggacgcgtgggcatcagggagcaccgctcctgcagcgaggtggtcggcggcaccgcggcgggctgcgccgctgtgtgctgctgcttcccctgcgtcatggtggaggtcgcggtgctcgccacggtgcgcgcgcccgcggcgctgtgccgcaaggccgcccgcgtgcgcaagggccgcaggcgctctgcctccgcgggccaggccacggagatatacgagctcctcgtggacgacaccggcgtcgtcgaggtggatgccggcgccgccaatgcggtggcgctgcccgtgaagcccgccttgcagctggaggaaaagggggagctggagaaggaggtgtgggcgaggttctacggcaccggcttttggaggagcccgtcgcagctggacgacaacgacgacaggtgatcgggacaggcccgcgagcgagctatccacaagctcctccggcgatgcgtgggcttccttcgttttccgcgggaagaagagaggatcgaggaaagggaaacatgattgtgtgttcgatactacgattacgaacttcgttttcccttcttttttgttgtttggaaggggaatactcttttctttctacacaatgtacgtacatgcatgtaataataaaa

SEQ ID NO: 15104 - DNA, 268 bp, Zea mays
  Clone ID: cC-zmpo14820004b05a1
aaaaaagggggaaaaaaaaggctttaatggggaaaaggaaaccgggtttccaggccaaaaaattttggcaaaaaaaaaaaacggggaaaaaaaggaacaaaaaaggcccaaaaggcgggggctaaagaaaaaagggcccaagcttttgaaaaaggggaaaaaaaaaaaggggggggccgggaatggcatttccaaaaaaacggccctaaaaaaccaatccaaaaaagggggggaaaaaacgggcggaaacggccaaaagggggggccc

SEQ ID NO: 15105 - DNA, 443 bp, Zea mays
  Clone ID: cC-zmpo14820004b05d1
tgggttgacccacccgtccggacgtgaaaggccggtgtcacctcgaagatctcggcgtcgacacttctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcgattgttatttaagtgcagtctcttcggagatgcaattacagtccatcctctctttcttttcccctttctcaaagagctaggaccttgctcgactgagcatcaggctgtagggctctttgtgatcatcttttgccagttttcttcttgtagcagaagttgctgggcatggaactcctgttccttttcaccaatagaagcataatgatcagcact

SEQ ID NO: 15106 - DNA, 392 bp, Zea mays
  Clone ID: cC-zmpo14820004b07a1
gcgctgtatatatgtactcatattccctgtattggaatacaatcaatcattcacatatttacaataatgttggaggaggattgcgaaacacgcctaagaggatctgctcctacccatcgtaccataccatcgcaaacacaccaatataattaagccacgtatcccaaattaatcctgctttggaattgaatgaaggagcctgactgcttgatgagcacgtaattaagtttttgagctacatatgggaccgtacgtgcagtgctcatcacgacctggtctggaagggcacgtaggttttgagcgagtcgcgcacgccctgtaccgaggcagccccggccgcgacggtgatgacgaagcagaagatgctgaaggcctgcaagcgcagccacgtg

SEQ ID NO: 15107 - DNA, 511 bp, Zea mays
  Clone ID: cC-zmpo14820004b07d1
gtcttcatggcatactcttccccaatcattcagtggaaaaacagtttttagggaatctgaacactgtgtcaactggaagcaatacatcaaacactaaacttgatgtcattgatggcgattttttgggactcctgttggagcataaattgatagagttgacatctggtgtgagatcgccctacactaagacaaccaaaggtgttcaagcgcaccacacttcatctgcttgggaagatatggcatctgcctgtgaaacatgtatcattgcttctactgattatgatagggagtcggtacacactttgaatgatggataagctactctcccccagaccgatcttgcttgtagaagtctccattcatctcagcctgtgaagaagtacgatcacgatgtcacggatcaagcagagccgactgagcgtctcaggcgtagttcactcttcacatgggaggcttctatttcaaccgatacctgcagctgatcatagagctggaggagtgcatatggaac

SEQ ID NO: 15108 - DNA, 568 bp, Zea mays
  Clone ID: cC-zmpo14820004b08a1
gttctctcaatctcaataaaagagatgaatatttcgtggtaaagaatacccatagctggggttaactgaacttagttccacgcgccatagcaggcgagcagcactaaagatcgagattaacatttctccactcttcaattacagagcaatagagcatttctcggggctggaaaaacgaaatgctagagatgctgcagcaaacgaggatcaccagtgttgagtatagttaagttcggtcacaaccaccaatcagctaccaacccggatagaaaatgctagcttccaagtggaagtggcacgattgggactgcttccttctgatgacttgaacattcagcgaaaagataaaattcagaaatgactgccctcttttttttggatgtttttttataatatccattacaaagcgaaatccaaggttgcctgctcggtcaacgaactccaatcgaactcagcatgtttgctcaaagatacgtttgagtttccttacacatgcagccgagtcagtaagtacgacaacctcattagtttggcaatcgctgcgcttgcatcgtcggcatcatgatga

SEQ ID NO: 15109 - DNA, 390 bp, Zea mays
  Clone ID: cC-zmpo14820004b08d1
tcgtgccctgcggtctgatcgcctgtagcctgttctacgtctcctactcgttctggctcaacaagacggcgggccaggtgaacaagaagaacatcgcctgggacagcgtcaagatcaagacgtttggctaaggtgtgcacccccgccacttccagataggggggcttataactggcgctgaactggacgaaaaaataccactgagtgcgcaggaggtcctgatcgtgtggatgcggaccgccgcgctcccgacatgcaggttgctgcaccgccggatcgaggggggctccatggagagcgacgagatcacggtggtgatccagaacaacttctacacgttcagcttcgggggctcccatgcgctggtgctgtgcaccacgctgtggatcg

SEQ ID NO: 15110 - DNA, 268 bp, Zea mays
  Clone ID: cC-zmpo14820004b10d1
gcgttagaccagcttttccggctgcacgctacttttatggcacctaataacacgccgcgttaccgcggactgaaaccctgcgtcccactaatcgctgctaatccctttcccgtgggtatacaaaggccgaccgtgccttcaacagtgcacctgaatggcgaggacccccgtgcgccattacgcgggtgggggtaccccggacgtcactgcaggctagcccgtcttcgttctactttttccccgttgcggttccgtagttaatcgggct

SEQ ID NO: 15111 - DNA, 492 bp, Zea mays
  Clone ID: cC-zmpo14820004b11a1
aagagatacaaaatgcaaattctatttcatcgttgcgtattaattagagatttacaaggacaataatctccatgactgcacgacaacatagatctaaaatgccaatgcatcgttgaacccggcatcataagcggcgtcggtctcatagtcaccgatcgcctctccgagcatcatccccccgaccgcaccgtctaggagccctaggccgagccccatccccatacctccgccatgcctcgccggtgcagctaccggctgtgctgcgtagttgtacatcgccggttgtggggaagcagcattgtacccgtacggtggcggagcagggtacccgtaaggctgccgcgggtacgccgcgtacggcgaacaatattgttgcggcgggtatgcggacgccatggcctgcggcggtgggtacacggtgggcggcaccatagtcttgtccgtcgtgttcttggagtcctgcacgtacttcttggcgtactggacttgttt

SEQ ID NO: 15112 - DNA, 564 bp, Zea mays
  unsure at all n locations
  Clone ID: cC-zmpo14820004b11d1
attnttgggttgacccatgcgttcgaccggtgcaaacatttcgaatccctccattgcattcctctccgtgcaatctgccattcacatgttccttggctgcattgaggcatcggtacgcgaattttgatgtgagctgaccagacatggctgcgaaagacggctcgggatcacaggatctgggggggcacacgttctggcccatgctgtcctacgcttgcggcgagctgtgtgtgatcgtactgctctacgtgtctgccctggcgtcctatgcggccacgaggctggcgcgcgtctgcgggctccggccgccctgcatcctgtgcgcgaggctggaccacgccctccacgggaagccatggttctcttcggacttggtctgtgccgcgcatcggtctgagatctcgtctctggctcactgcaagacccatgaccagcttgttgcatgctccggcgatctctctcggcctacatcggccaggtcaagaaggttgtgtttctgttcggatccactcaagaatgctcgcggcgcgcagaatcattctgaagcagccaatgctgtggagt

SEQ ID NO: 15113 - DNA, 472 bp, Zea mays
  Clone ID: cC-zmpo14820004b12a1
tggctcgccacctcgtgcagctccacccgcggctgcatctcctccagctccaactcccgctgccgctgttcccggaacagcctcagcagccgctgcgccttgtcccgggccctggccgtgccgttggccgtcacggacaccagcgccgggatcacgccctcctggagcaccgtctggctgctgccatcgtcgccgctgcagatcacgtacagacacgacacggccttctccttctcccccggctcaccgttgtccaggatgagcacgatggcgcccaccatggccgcgctggccgcgatctcttccttgcccctccgggtcatcgccaggttcagcagcaccgcgagggccttgtccgtccacggggacgacggcgtcagcactccccggaggccctcgatgatgcccgacgccatgagggacgggatgttgggccgcgtgcagggagagattgtacagggtgagcagcgcg

SEQ ID NO: 15114 - DNA, 574 bp, Zea mays
  unsure at all n locations
  Clone ID: cC-zmpo14820004b12d1
aatactattctttcttatattgggatttgttttttcttctttagctatatttttttttttgattgttttttttttttttttttttttttttttttttttttttttttttttttgggaaaaaaaattttttttttgggggggaaaaaaaaatttttttttatagaaaaaaggcccggggggggcccccggaaattttggaccggcccctgggaagaaacaaatttttctttttaggggggcattaaaaaaggggggaaaaaaagggaaaaaatttttccggggaaaaaaaattatncccaaaaaattccacaaaaaaataaagccggaaaaaaaaaaataaaaacccggggggccctatagggggggcccccccaaatatattgggggggggcacatgcccctttttaaaagaaaaaaacattgtgggccccttttttaaaaaaacccccaccccccgggggagaggggtttcttttttttgccccagagggtttttttttttctcaaggaagagggaaaaagttttttttttcacaggcgggcaaaaaaaaaaaaaaaaggtgcctcttttttt

SEQ ID NO: 15115 - DNA, 514 bp, Zea mays
  Clone ID: cC-zmpo14820004c01a1
aaacgataattttggagtccttgatatcaagaattgatacagttataggctaagaacatgataacacatcgaaatcaaacagaaagaaaaagagggagagcaagaacatatcacggatgaccacacattattatggacttttggttttaaacgacattgctctcacttttcttccatgtcttgttccaaatgcaaccggaccgacgtgcttggccttagttggtggagtcatcatcgtcgacctcattgcccgatagaccctcgacgccctggggaccaggtgcacccgccggtccgataggtccatcggcaggtgcgtcagcagcgggggcgggggcgtcagcggagggggcatcagcggactttgcctcggccatcggagccacaaccatggcgacgaagaggagagtagcaatgacgaagacgacgctagcgcgagccatgggtatggtgtctagctctcttgggttggttgctagctgcttggcaagtttgacgctaggtgtctctatgc

SEQ ID NO: 15116 - DNA, 517 bp, Zea mays
  Clone ID: cC-zmpo14820004c01d1
ggcatatagacaccaagcgtcaaacttgccaagcagctatcatccttctccaagaaagctagacaccataccgatgggtggcgctagcgtcgtcttcgtcattgctactctcctcttcgtcgccatggttgtggcaccgatggccgaggcaaagtccgctgatgccccctccgccgacgcccccgcccccgctgctgacgcacctgccgatggacctagcggaccggcgggtgcacctggtccccagggcgtcgagggtctatcgggcaatgaggacgacgatgatgactccaccaactaaggccaagcacgtcggtccggttgcatttggaacaagacatggaagaaaagtgagagcaatgtcgtttaaaaccaaaagtccataataatgggtggtcatccgtgatatgttcttgctctccctctttttctttctgtttgatttcgatgtgttatcatgttcttagcctataattgtatcaattcttgatatcaaggactccaaaatcatcgtttt

SEQ ID NO: 15117 - DNA, 350 bp, Zea mays
  Clone ID: cC-zmpo14820004c02a1
ggacaaaaatcgccttggataaattctaatcagccagaccctgcatgaaaaagggctattaagactttttttggacaaagaatcatgtgtttttatgataataaatacaatcgggactaaactgaccgccatggggacttttaagttttaacccacccaaaaaaactcgatcagttccgggtacttgtatgaagggaccattcactggcttgacagtggtattattaaaatcttcatttttttcctctttcacaagaattacttacacagccattttggcaattccgatgaagtggcacttgtattacaaagacgatcaaaaccgggctccctagaccctgacgggcttg

SEQ ID NO: 15118 - DNA, 615 bp, Zea mays
  Clone ID: cC-zmpo14820004c02d1
cggacgcgtgggacacaatgcatgatggaaaatttttacatttgcctgttctggacagggatggaaatgttgtgactgttgttgatgttcttcacataacgcatgctgcaattgctacggttggaaacagcggggcagctggatctgagtcaacgtctgccatgatgcagaggttctgggattcagcaatgtccattggacctcttgatgatgatgatgactccaccagaagcgaaggatcgacaaaggtggcatctgaggcagcagatataggaagatcagccttgtttccagcttctgctttatcaaacacttttgggttcaagattcaggacaagcaagggagaatgcacagatttaactgtgaaacgagcagcttgacagacctgataactagcattcttcagagggtcggcgatgacattgacagaaaacacctgccacaaattttgtatgaagatgaggaccatgataaggtcatattgtcgtctgacagtgaccttatagctgccgtagaccacgcaagacatatcggttggaagagcctaaagctgcacttggactacgcccgccggtagagaggggacggtttcttagacttcaattcccctgcaa

SEQ ID NO: 15119 - DNA, 182 bp, Zea mays
  Clone ID: cC-zmpo14820004c03a1
aaaaggaaatatcatatatattccatcacaagattacagaacgacttgacgcgaacacatgaattttaaatagtaatgtctacgtaataataataattaaataacacaacccgttaccatgcatgcatagatattcatatcagaccagtagtactatatgggaacagcgttgcaagtgacgt

SEQ ID NO: 15120 - DNA, 184 bp, Zea mays
  Clone ID: cC-zmpo14820004c03d1
acgtcacttgctacgctgttcccatatagtactactggtctgatatgaatatctatgcatgcatggtaacgggttgtgttatttaattattattattacgtagacattactatttaaaattcatgtgttcgcgtcaagtcgttctgtaatcttgtgatggaatatatatgatatttccttttac

SEQ ID NO: 15121 - DNA, 391 bp, Zea mays
  Clone ID: cC-zmpo14820004c04a1
ggacaaaacgcccgcccaccatgcattaagcaatggcccaacaaatcattggccaaaggacttttcgggtttcacccggagaaacagccaaaggaatgcaaagggggaagggccaaatggcagccctcctggtctccgacccctttggttgcaaggctcagtcattggacatacccccaaacatgggggcccccccccccaagcgtgggggccccctcactatatatgaggggatgtatgccatgccatgcggcctttaaaacttgaaaccaagtttgggcggggccccggggtacttgagccacatggcgccgtcaaagaacggcccggcggtgaacgggttggccttcttccggccgaagaccgggaaaccgggccagttgaccctttt

SEQ ID NO: 15122 - DNA, 549 bp, Zea mays
  Clone ID: cC-zmpo14820004c04d1
acccacccgtccggtcatccagaactgccgcctggtgcccgaccagaagctgttccctgaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgccgggccgttcatcgacggcgccatgtggctcaagtacaccggcgcgccgcacatacttggtttcaagttctaaaggccgcatggcatggcatacatcacatcatatatagtgaggtggcacacacgctcgcgcgcgcgcgcacacatgtttgtgtgtatgtacaatgactgagacttgcaaacagaggtgtcggagaacaggagggctgacatttgtaccttcaccatttgcattcctttggc

SEQ ID NO: 15123 - DNA, 550 bp, Zea mays
  Clone ID: cC-zmpo14820004c05a1
gaatcaagcactctgttacatttttttatttccttttcttccttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcagacggggagcggcacgtccttgaagtagccgagcgggttggcggggcgcaggctgtcggagatgccgacgttcctggtgagcaggacgccggcgcggtccctgagcgcctggacctcgtcgcagtccttgcgcgggctggccaccagcaccacctggcaaatgtcctcctcgtggctgtccttgagctcaatcgtgtaagtgccggtcgcgtcggtgaccccgtcgatggcgcgctcgagcttgccggtgccgaagtgcctgcactccagcctcaccttggcgcccgcgatgtactcggtgacgttggtcacgaacccggcgcggcaggtgtcgcagtacacgcggcccttgatga

SEQ ID NO: 15124 - DNA, 419 bp, Zea mays
  Clone ID: cC-zmpo14820004c05d1
gccaccctcgtctcaccctccctccctcacacaaataataaggattggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaaccttcccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatct

SEQ ID NO: 15125 - DNA, 398 bp, Zea mays
  Clone ID: cC-zmpo14820004c06a1
gggcaggaaccagtcggataaaatatattcgggggcctgccataacctgcctgggggtaggcttggccccactttgggtttttatatataattatggcaaaaacagtattagccggacacacaaacgagcccctaattagttctcgggtttgacccccctgcttgggtggaccccccctttttaatttaaccggaccacggccccggggccggggccggggccggggcattggattccctatcaaccaactttatttccccgtaaaccacccggcccttggacccggggcttcttccctccctggaaccccccacccttcccaggacctggatttttttcttgtgggccgaagccgtggtggccaagtggcaaaaaaacaagccccctatggcccccc

SEQ ID NO: 15126 - DNA, 455 bp, Zea mays
  Clone ID: cC-zmpo14820004c06d1
gcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcatagtgtggcccagcctacccacatgcatgctattgcatgcctccgaaatatatattatccgactcgat

SEQ ID NO: 15127 - DNA, 366 bp, Zea mays
  Clone ID: cC-zmpo14820004c07a1
aaagaaacaaccgaaaaaaaaaaaggggcaatcccataatgagaggagcaccaaaataggaccagaccagggcaaattacccaaaatagggaaaacatgactggcaattgtcaaccaatttttaaagcaaaaccaagggccgaaaagggccaagaatacgctgcttggggagcgcacaacaccaaagcgggagggtaaaaacatgccaaaaaactggcccgggcccaagaatagctataaggcggatccaagcctccgggaactgggggccattgggatgaagatctaatggaagtaacccagggggttggggacaccaggacggggaaacgggcggtaaaaccaagtgaactcctggacagggag

SEQ ID NO: 15128 - DNA, 365 bp, Zea mays
  Clone ID: cC-zmpo14820004c07d1
gtcgcgcgggggatctgggtgccgctcactgtggacatttattctttaaggcgagtcttacgtattcggggccgcgacgggcgcatgcaagacctgggacgcgagtgttgatgtagattttatggaacctacacatgtacgctcatctggttgagcccagcactgtcagtgctgacgggataaactgcggttaacaccagcctcgaggcggcatacgcttacacaaccaggcaagagagggctgatgcatgatcataatgtatggatatgcttagcttatgatgatagggagacgtatcactcgttgggtgacggataaattaatcaccgccaaactgaactagtgctgtgaagtccaattacac

SEQ ID NO: 15129 - DNA, 507 bp, Zea mays
  Clone ID: cC-zmpo14820004c08a1
gatgaataataattcatggcaaagcgattaattaataatggagacaacatccacagtaagcccaattagaacatgttgtttcatcagaagaactccgtggaggaaaataatgggagacatcgaagaaggttagtttgttacatggtgtggccagtcgagagtgtctctcccgacctatgccgctatgccaactgttgagaattcaagtgtcgtctccttgctcgatcacacactgatcatcaggtatcatcagccaataattatattagttggcacgcgcatgcacggacagtcggtcagctttgctgcgcctgcttctccttcctggcctgctcgacgtccttcttcttcgcctccaccgtcgtcgtggtctcggcggcggtggcgaccttttcctctgcattggcggctgccgctggcttctcctcctcgacgacggtcttctccacggcttcctcctccttgtgatcgggctcggcgacggccgcctctggagcgaccacctca

SEQ ID NO: 15130 - DNA, 477 bp, Zea mays
  Clone ID: cC-zmpo14820004c08d1
ggcgtgtgggagaactgggtgtggcacaccgaggacgacctgtttatgaacggcgccatcttcaatccgtccggcggcgcccccaaacaggtcgacaccgacgagtggtgtaagcccaaacctggaacctacgtttcaaggctcacccgtttcttctggacactgtcctgctgcacgggcaagccgtgctgaaagccggcctgagggcgtaagaggctgcttcttcttgctcacggaccggccatgccaggtcgcgatggctgcgtttcatttcatggaagaaagccaggatggatcacaagttgacgtcctgcgtattaatctacgtctgccttcaagtactgtgttgtggcattgttacacatcacactgcagtcaggtcattttttttcccacagaagaagtatggattgatttaattccacacgcgtgattgtacgtatacattttgtataacatgaaccacctttgtttgcg

SEQ ID NO: 15131 - DNA, 395 bp, Zea mays
  Clone ID: cC-zmpo14820004c09a1
attaatgaatattggagacaacatttcacatgttagcccaattagaacatgttgttgcatcagaagaactccgcggaggaaaataatgggagacatcgaagaaggttagtttgttacatggtgtggccagtcaagagtgtctctcccgacctatgccgctatgccaactgctgagaattcaagtgtcttctccttggtcgatcacacactgatcatcacgtattatcagccactaattatattagttggcacgcccatgcacagacagtcggtcagctttgctgggcctgcttctccttgctggcctgctggacgtccttattattaacctccaccgtcgtcgtggtctaggcggtggtggcgaccttttcctctggattggttgctgccgccgg

SEQ ID NO: 15132 - DNA, 323 bp, Zea mays
  Clone ID: cC-zmpo14820004c09d1
ggaactcattgtagccccggcggtccacaactaatcccgctttaatttccatatcaagcatgggcgccagcgaaagggagccaaacacacttgaggggcaggccccatctgaagccgccgattcacacccaaagttgcgcccaaggacactccaatctcctgggaggctctaagctgatagaacagggaagcccagaatgtgacggtggagagagaccactgctgtggacgtcgtggagcataagcaggctaatgaggaggtcgctccataggcggccgttttcgagcccgagcacaaggaggaggacgccctggagaagacc

SEQ ID NO: 15133 - DNA, 371 bp, Zea mays
  Clone ID: cC-zmpo14820004c10a1
ggactaatgatttcgggtttgggccctctgtattggggatttcatccatttcacatacatgcgacacacctgtttcgtcgactttgatttgcacacgtgtgtgtgtgaacgtgtgcgcttggaacaaaaaaatcgctcgtgtaggcggcctactaacgaacgaacggattggtgaacccgggtgagagcctatttaattacccgaacctattgacggccaggagcgcgccgagagctaacttctccgggggcagcattaccaccagttagagatgcccgcgcctgtcagtctctctgacggggtgcacgaggccctcgtgccgaccctgggccgactccttctagacaccatgcacgccgtacgggcacca

SEQ ID NO: 15134 - DNA, 248 bp, Zea mays
  Clone ID: cC-zmpo14820004c10d1
gggtcgaccacccgtccgcggaggcctggcaacagggggccgcagatgctgcgggcgtatcctttgcggggggacgcgggggacccggaggcgagccggagttgaaaggaaccggacgaccggctgttacggcaccatcacctgctaacagcggacagcgggatataccacttgtgctgcagtggcaacatgaatggcacgggaggaacagctaggaatgcgggcaaacggtccctgccgcagctgcc

SEQ ID NO: 15135 - DNA, 484 bp, Zea mays
  Clone ID: cC-zmpo14820004c11a1
atataaatataaaggctagtttgacaacttcattttctcaagtgaatcctattttttcaagagaaaatgaattaaattcccttgaaaaaataaaacctcttaaaaaaaataagggtgtgaaactagccctattaataaatttatgccgaatgcaacatcggtttccaccattttcctctttacagaatactactggtccgtgtatacggagaaactacatttcacggggttgtaaataaacagggattaattatcgccgtgtgcatgcatgcatacggcgttgggctggccgacctgatcataacaatttattaattaattaaggcgaacaccccaagcgtggaggatcgatgcgtccccgccgccgcagtatgttttaagctgacttgcggtagatgtgttgtggcctgcccgcggcggcgtccttctgggtgtctatgacagtcttgaaggcgccgaccagcgccttgaccctgctgcactg

SEQ ID NO: 15136 - DNA, 400 bp, Zea mays
  Clone ID: cC-zmpo14820004c12a1
gtcaattcacagcttcagatacacatcatcttatttcagaacccagaggtttcatacagaagcatatatagtacatgccaaactcagttctcatccaagagcgaacaaatatggtttcatccaccgtgttgtgtggaatatcaacttcaatgttacagggccaattaccaaaaaaaaagagagagagaatgacaagcaggcaaaaaatgttaatgtgggtcaaaggatttacaaaagaggcggtgtcagcatccttgttttccaaggacgatgatgcctgtcaattttgatgcgggcgatcctgtctgctcttcgctttcttcatctttgctttaaacctcagtttcagtaccagcgtctccatagtgtggacaaagttgccgactgccataaccaccag

SEQ ID NO: 15137 - DNA, 394 bp, Zea mays
  Clone ID: cC-zmpo14820004c12d1
agtaatccgctgcggtgggttctttgctcgtcccttcttgcacaaacgaaagagacagtgagaaaaaaaatgacttgggtgacaagatgatgaggggagcacgcgcacagcgaaacggcgcggcctggcacagtggcagtggcacccctatggcccgaacacctactccgatgatccatctacagcttggcctgaccgggggcgcggagcttggccatgttcctcttcttcttttactccaggtccgtcacctcctgctgcttggcagcttcctcggcgccgccgggcgccgccgggaccgggttcactacatgtcccccgctgccgctgatcttctggccggagccggacctatcctggtctccggcgctgacgaccaccccgccaggaacct

SEQ ID NO: 15138 - DNA, 527 bp, Zea mays
  unsure at all n locations
  Clone ID: cC-zmpo14820004d01a1
gagcctcaaatgttttctccaaagaacgtggatacaaactctgcattatcagtctggaacagcaaatggtggcacctgctgattaacataaatgcagagagattaaaacacacacacactgtatttcaagagccatttgcaatgtttgttattcactaataacaaggcacgcagcaacagcgcccacgggcttggaaatttgatcacacagtgaaagtcaggcagagcccatattacatacaaaagaatcaaggggtaacaagctacagatatactctgagtatgcacacccgcacttcgttttttttttttggctcgttctagcacgatcgcagtggcgaaagcagcgctgccttgccactacgctctccagggangggggattcctccgtcgagcagccgatcgccaaacagcagtatgatacaaggtatgtattcttaaaccctttttagatagtttggacaaagctatacgggttgtgatatgccgtcactttttcccgccgctcgtaacccctactacaaca

SEQ ID NO: 15139 - DNA, 222 bp, Zea mays
  Clone ID: cC-zmpo14820004d01d1
acaaccccgtatatctttgggcaagctatctataatgggcccaagaacacatacctagtatcatactgctgttcggcaaaatgcaaagccgaccaaggaactctcctccctggagagcgtaccgaccaggcctcgctgctttatcccctgctaccgtactgcaagtatccataagatcaatccgacatcgcggatgcccatactcatagtatattctgtagc

SEQ ID NO: 15140 - DNA, 415 bp, Zea mays
  Clone ID: cC-zmpo14820004d02a1
cgaggtaagagtattattattagcattcacaaacgccataacatttttcacatattacatgaacaccacagttgatgacacaggaacactcagtaatcgtatatatagatcatcatgcaagggccgaggggacagtcgctttgtcctgacctctgaaactagccaaccaacaccaatgttgcattaattgcaggcacactgaagagtgaagactcatgactagctgaaaaccgaagggactaaacgagcaattagatagagggtctgaatttgttgcacttgctttgaactgaacgtggagcgtgcagtttggacagttagcaacagcagcgtcgtccaccatcaatgagctagcacagcgccaccgctcctccgtccgaggacgcctggagcatcatgtacatgccagattggt

SEQ ID NO: 15141 - DNA, 546 bp, Zea mays
  Clone ID: cC-zmpo14820004d02d1
gcctcttgtcctgtcgtcgtctcttcctttcgcgtgagctgttcatgcgttcttgccctttcctcgctcaggtcaggtggggataggatcgtgacgtcgtcatcgccaccaccacccccagcatcccgagctgctgctggcggtggggcaaccgcgtgcgttgctagcttgctcgatctgcctctcctctggatcccctgtcctgtccctgttaatcgcgcgcgcttgcctatttacaaggcgaaacaagcgcgcagcagtggccatgtcgtccgacgcggtggccgccagcagcaggaagggccggctgaagcagcgctacgacaacgagttccgcctcgtcgcagggtcgggcgtctgcctttttgattttcctcggtcttggatacattggtgcgtgccgtaccgggtgaacaagaaagacgacgagggcggcaacccgtgcagcatcctcggcgacgacacggcggcggaggtggaggtgctcatgatctccacgcctaaccgggccgacatggtcttccccaaggcgggtgggaggacgac

SEQ ID NO: 15142 - DNA, 494 bp, Zea mays
  Clone ID: cC-zmpo14820004d03a1
ataataacagagtgtatagagataaatgtcacaatataatcagagtacttattacatagcggaattcttacaaaataaaagataaatatagatagaactaaagtccatccttggcgcaaaaaagtcaactgggagacgccacctagatcgaatcgaactcctcgtcgtgtggctcctcttgaaccacctgtacttctcctggcacttgagattccagttaccaggatgattcttcagatccttgtgacctcaccgctaagaccatggcgcagttactccggctcacgatgggaagtagcttcacggtggtgtctgctcgccggacggtggttgttgaaccgcggcgggtggagaggacgcagatgcgaggagtcagagacaccggaatgaaggagagcgccacccacgggcggtgcgactacctacacggtgtcgatggtggactcctgcccatccatctggtggcttgccagagctcttcaccaccattggct

SEQ ID NO: 15143 - DNA, 503 bp, Zea mays
  Clone ID: cC-zmpo14820004d03d1
gtccgagccaatggtggtggagagctctggcaagccaccagatggatgtgttctggagtccaccatcgacaccgtgttaggtggtcgcccctcccgtgggtggcgctctccttcattccggtgcctgtgactcctcggatctgcgttctctccacccgccgcggttcaacaaccaccgttcggcgagcagacaccaccgtgaagctacttcccatcgtgagccggagtaactgcgccatggtcttagcggtgaggtcacaaggatctgaagaatcatcctggtaactggaatctcaagtgccaggagaagtacaggtggtttcaagaggagccacacgacaaggatgttcattcgatctatgtggcgtctcccagttgacttttatgcgccaaggatggactttaggtctatctatatttatcttttattttggaagaattccgctatgtaataagtactctgattatattgcgacatttatctctataccctctgtcattat

SEQ ID NO: 15144 - DNA, 546 bp, Zea mays
  unsure at all n locations
  Clone ID: cC-zmpo14820004d04a1
atcttcgttaaaaattatagcagtacaaatcatagcacattctgtaggtgtaggatacagtaacacagcagcagaacatcaaacccatctcctgccaggctctgagcaaacgccaaagcctccaacgtggcacctacgtaccgtaccccactcctggtacccagtcacccaccccacaccctacctcgctcgcagtcgcagcttccgctgtacgcacactactgcgcggtgcacgcaccgatgacacggcggcgcagcttatgtatgagtaagtatagggactcgccatacaggtagtcgtcgcagcgtgccaccccgtctagcgatcgaacacagtcgacggggaacgccggccggtccggtcagttggtgagcgcgacggcggcctcgtgcacgaggggctgggtggcgtgcgcgacgccctcggcctcccgctccacctgctcccggcacgcctcccgcgcgcncggctccgtcatgcgctttgacgaacgcgcgaagcgggccagttgtcgggctggaacaggtcgggccccatgcgcaggt

SEQ ID NO: 15145 - DNA, 494 bp, Zea mays
  Clone ID: cC-zmpo14820004d04d1
gagatggacaaggaccaggacctggcctacaccgaccggagtggccgccggaactacgagtacgtctccctgggctgcgacgcgatgcccgtgctcaagggccgcacccccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgagtagcttgaaggcggctgctgaggcagtgggcaagccggagtggggcaacgcgggtccgggcgactccggcagctacaaggactggccggaggacacgggcttcttccggcgcgagggcggctggagcacggagtacggagagttcttcatgagctggtactcgcagatgctcctggagcacggcgagcg

SEQ ID NO: 15146 - DNA, 388 bp, Zea mays
  Clone ID: cC-zmpo14820004d05a1
aaatgccggttattttaaaagtacggacaaaaaggtgacccaaaaaacccaacagaaaggggcaaaaagccaacctacgaaaagcaaggggctataaaaaacaatacgaaaaaaaggctaaacaaagctaaacagaaccagaaagccccaggaacctagggaggggaaaagagaaagaaaacaagaccggggaacagaaaagggggggggaaaaaggcctgagggccggggaaaccggcctgggaaccaaagaaaaacaaagggggacccaagaaaaagaagacccccgaaaccaagggagaaacttggagcgccaacgccagaagaatggcccaaaaaaaggccgaacccccgggaaaacccggggaaaaaacacaggggccccccg

SEQ ID NO: 15147 - DNA, 376 bp, Zea mays
  Clone ID: cC-zmpo14820004d05d1
gacccacgcgtccgggcatattgaggaagataccgcaaagaataagactgagagcgactactcataattcaggagcaagatttcagatgtgtaagcagctgtagagctgcagttatctggcctgtgtccacagagctgaaacctgagaagtgagagctttgcaatctcacggtccttatatgtttctctttggaacaaaataggtacttgcggcctgcaggtgctgtttagcctcgcttagtatggtaatcgtaatggtagatgaagtgatttgcctgtcagaggtgaggagtattatctgttatgttcggttttgcagggccattttgtacagtactttttgcagacccagcatttgaaatgtttgcattcttgc

SEQ ID NO: 15148 - DNA, 480 bp, Zea mays
  Clone ID: cC-zmpo14820004d06a1
agtgtctcccattctcccctctttacatatcgaaattaacagaaaagggagaaatggcaaagcaaataaaatgaatggatcaatcgacatgttcagacccaaattaaagtacttaaatatatatataaacggaatccaaccgaatacaggcaatggcagccagcagcctctccctccgatcctcctttaattttactgcaggtagtaggcgaagaaggagagcacggaggcgcccagcacggcgccgacggccgggaacgcggccgaggaggcgctggtgggggcgggcgccggggcctcggcggcgaggaccacggtggcggaagcggcggcggcgaagacggcgcaggcgaccttcttcatctccatcgcgacttgatgtggtttgccggagccgaacggagcgtcgtcgggatcgagacgaggaagaacgaagggcacgcaggcttattagcaagatggatcaacggatgatcacac

SEQ ID NO: 15149 - DNA, 492 bp, Zea mays
  Clone ID: cC-zmpo14820004d06d1
caattattgcaagtgtgaccatccgttgatccatcttgctaatatgcctgcgtgcccttcgctcttcctcgtctggatcccgacgactctccgttcggctccggcaaaccacatcaagtcgcgatggagatgaagaagggcgcctgcgccgtcctcggcgccgacgtcttcgtctccgtggtcctctccgtcgtggccccggggcccgcccccaccagcgccttctcggtcgcgttcccggccgtcggcgccgtgctgggcgcctccgtgctctccttcttcgcctactacctgcagggaaatcaaaggcggatcggacggagaggctggtggctgccattgcctgtatgcggctggattccgcctatatatatatttaagtactttaatttgggtctgaacatgtcgattgatccattcattttatttgctttgccatttctcccttttctgttcatttcgatatgtaaagaggggagaatgggagacact

SEQ ID NO: 15150 - DNA, 100 bp, Zea mays
  Clone ID: cC-zmpo14820004d07d1
gtcgcacgatggtgacaagtgccgcccgcagaagctatgttttttttatgacccgccattcggtaacggggacgggacgggcgcatgcatgtcctggaac

SEQ ID NO: 15151 - DNA, 450 bp, Zea mays
  Clone ID: cC-zmpo14820004d08a1
gaatgtcatagtgatatttatcgttatgtatctttgttttatactaatttttaacttccgtgtgaacgcacgggcacaaacctagtacataatatatgcatgttagtcaattggttcaaatgcacgccagcttctttgccaagccgatggacttgccgatggcattcttgcagacggccatggtcttgttgccggatccattgtacttgatgtcgacgttgacgagctgcacgccctggcatggcaggttgttggcgcagttgagcgtgatggccttcggcgtgttggaggtgccgtggatgttcttgaagacgacgtcgttgacggccaccttggaggcgccggacttgacgcacatgttgttggggcagtacttctggtcgatgatgatggggtaggagacattgtccatggtgatgccctcgtacaggaacttgctggccttgagcg

SEQ ID NO: 15152 - DNA, 88 bp, Zea mays
  Clone ID: cC-zmpo14820004d08d1
gtcgcacgggggatccaggagcctgacacaggagcaaagcttttgataagacgcgccgtttggattcggggacgagacgggcgcaagc

SEQ ID NO: 15153 - DNA, 411 bp, Zea mays
  Clone ID: cC-zmpo14820004d09a1
gattagaaagatatagaagagagaatcttttagatgagactataaagtccaggcttagaagatgaatattgattacattgctggagactttaaaaactagtgccagaacggcaaaacaagtgaacagtgaaagcttgccgtgaaacaggattgcattgtactttggagttgtcttccctctggttggttgggggaagcgttatacgttacggtttggagaaagcattttcatggcagttcttggaaaggaggccatcctcgaggtcattgggctgcaatcccgtccatccatttgccgatttgcttcagctgcagagagcaacgatcccgcaaaagatgtcggcctagtaaccgcctttcactcacagaaatcgtcggggtgggcctcggcaggtcacttcctcctgctgg

SEQ ID NO: 15154 - DNA, 496 bp, Zea mays
  Clone ID: cC-zmpo14820004d09d1
gggggagtacaatgttatggtgatcgatcttcttggccctagcttggaagatttgtttaattcctgccacaggaatttttctatgaaaacagtactcatgcttgctgatcaactgataaaccgagtggaatacatgcattccaagggatttattcatcgtgacatcaagccagacaacttccttatgggcttaggtcggaaagctaatcaggtctatatcattgattatggacttgctaagaaatacaaggaccttcatactcataaaacatcccgtacagggagaacaaaaatctgactggaacagcacgttatgctagtgtgaatactcatcttggaatagaacaaagtatgagagatgatctggagtctgctggctatcttctgctatattttttaagaggaagcctcccatggcagggtcttaaagctggcactaagaaacagaagcatgacaaaattagtgaaaagaaaatgcttacgtcagcagaagttc

SEQ ID NO: 15155 - DNA, 414 bp, Zea mays
  Clone ID: cC-zmpo14820004d11a1
cacgcatcatattccgtttaacttatggacaacaatgaacagcaaataaacaaccagccactaccgatcgacaaccggggtgccagctgtgtgtgttatttactctgcacacactgtacgagaccgagagcaggtctagctgctaggcttccctcagttgggatggtctgggttctctctgttccatgacaagtacagaggggtctccaagcgcccttggcttgatgacgtataggatgacgaaggccagggcgagatagaggcatacgccgtcgatggctacttacgcgacgccgatgaagttgttcctgccgcctatccacgaagttgtggacagcaccagcgccttggtgcccgcgaagatgcacgtgttgtagctgttctggatcaccaccgcgatctcgtcgatcgcca

SEQ ID NO: 15156 - DNA, 383 bp, Zea mays
  Clone ID: cC-zmpo14820004d12a1
aacacccgaatttggttggtttttagagaagaaattttataccctcaaattcagggtgttacaccggcgaacataatatagctgtcggatgtctgtcgttttactgttgggcgttaccaatggattgcatgttatgggcaattcaagggcgagagaaaaatttttacttgagagatgggtcaatcgacggggggtctaaaagcatgcaagctccttgaggcaacccttggtgctgcccttggcgttcgtgcatatagccatggtcttgttgttggggcccctttactcgacgttgacgtcatccatggtgaccccggtgcatgggaccctggcagtgcatagcaggctaacggcctccggggtggaggaggtgccggtgatgt

SEQ ID NO: 15157 - DNA, 587 bp, Zea mays
  Clone ID: cC-zmpo14820004d12d1
gaagaatactcttacgaatgggattgttaaggtatcttgcattatcgttggtaggatgccattattgaaaaggcatgatcggactttcaagttggcggatccttctcctgagcattgcccaccaggagagtttgtccgggaaatcccactgcctacccggatccctgaagatgccactctggaagcataccgcgatgaaacggggacaggcctggagattattgtcccaaagtaccgtgttggccctgaagaacatgaggtgcatgtgtccatgagaccgccctcgtcatggtgccaatgaaacttgttccgagctcgaggggagacacatctggtgcggaggttccctgttgttaccataaggctgaggctactgtccgagaaacgcagctcagttttgccaattttgatggggaacagtcctaattgattcaagcattctggtagttggcattgcagcatttggaacgtattatgtatatgctatagatcacacggaacatgtctgcattatgtttgtctgggggtgcataatgtatcataatttggttttcacggtgtcaaaaggctagcttatctgtctgctg

SEQ ID NO: 15158 - DNA, 548 bp, Zea mays
  unsure at all n locations
  Clone ID: cC-zmpo14820004e01a1
aaaaaacaggatcctatcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcaggtcacctggttgttgcagcagcaggagcaggaccaggagggaagttcacccactgcagctgcagctgtatctccccgctctcgacgttcctgagccggaggatcatgtcctgcgcgaacttgccgttcctccagcacacgtggctctcgtcggcgaggcagttcctggcgctcggccgctcggacctgatgatggcgccgttcctcagactctcctcccgcgggttcatgctcaccgnnctcatcagtggcgccacgtccacctncgcgtctcccatggngtcgtctctgctgaaagtgtccttgtcgaacacctnctgtagcaaacagtctagaataatgaatcacaaacaggatc

SEQ ID NO: 15159 - DNA, 551 bp, Zea mays
  Clone ID: cC-zmpo14820004e01d1
acccacccgtccggctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggtgagtgagcagcaagcagaacgatcctgtttgtgattcattattctagactgtttgctacaggaggtgttcgacaaggacaccttcagcagagacgaccccatgggagacgcggaggtggacgtggcgccactgatggaggcggtgagcatgaacccgcgggaggagagtctgaggaacggcgccattatcaggtccgagcggtcgagcgccatgaactgcctcgccgacgagagccacgtgtgctggaggaacggcatagtcgcgcatgacatgatccttccgc

SEQ ID NO: 15160 - DNA, 371 bp, Zea mays
  Clone ID: cC-zmpo14820004e02a1
gaaacaattccttctccatttgcatgtttctcttctcggtcatcatgttacatgtgcacacactcgttacattacctatgctgttatacccttacgcacaaacgtacatgcgcttatccgatagcattcaattcaggtcgctagagcattgcatggtgcgatcgacttgtcactgcttctcctggcctccctcgtcgcgattactctcatcgtcagtagagcgcgctgtgatcaccgtttagtatccttggaacagaggcggcggtggcgacgcatactgctgcgccatgattggtggcaagatgaactcctcaggtgccgacggtggaggtgatgatggtgcaggtggaggtggtgatgggacggctggt

SEQ ID NO: 15161 - DNA, 599 bp, Zea mays
  Clone ID: cC-zmpo14820004e02d1
gtcgacccacccgtccgccttccaccaccggcaccagttagctcacctcccccgcctgtttctgtgagctcagcacccccatttgcaaaatccccaccgccacagttcaaatcacctgcaccaccaactttgagaagatctccacctccactggtgaagcccccgccaccaccgccacttgtaagctctccaccattgccaccaatgacctccccacccccaccttcaccagccgtcccatcaccaccttcacctgcaccatcatcacctccaccgtcggcacctgaggagttcatcttgccaccaatcatggcgcatcagtatgcgtcgccaccgccgcctctgttccaaggatactaagcggtgatcacagcgcgctctactgacgatgagagtaatcgcgacgagggaggccaggagaagcagtgacaagtcgatcgcaccatgcaatgctctagcgacctgaattgaatgctatcggataagcgcatgtacgtttgtgcgttagggtataacagcctatgtaatgtaacgagtgtgtgcacatgtaacatgatgaccgagatgagaaacatgcacatggagaaggaattgtttca

SEQ ID NO: 15162 - DNA, 368 bp, Zea mays
  Clone ID: cC-zmpo14820004e03a1
caaaacatacgcacgattaatttcaagtttcacacgggtagcctggctggctggctggagctaacatggaacccaagcatcagagtgccatttccacactgacggcagaatgctaagctcactactgctgagtgctgcgtgacggattcacgatcggtcgacagccaaaggaaaaacgctcgcaagcaaaacacatgcaggctgcacattccagagacatgtacaaggcgcgtcgtgttcatgaacatactacgtcttaggggcgacggaaacgggcggcgagagtaccagcgcgtgaagcgtacacggaaacggggccgtacgacggtgcgtgcgtggccttaggggcgtgcgtcgggcgcgggttc

SEQ ID NO: 15163 - DNA, 567 bp, Zea mays
  Clone ID: cC-zmpo14820004e03d1
aatcgccacgcccaaggcacacgtatgtctcgcgcgctctcgcttgcgatcctcctcctggccgccgccgccgcggtggcgccgctggcctccgccggcaccgaggagttcaccagcgtcgggtccagcggcggcaagatgttcgacagggcggtcggagccgatcccgacccgtccccggccggcggactgccggccgacccggcgcccgacgcacgcccctaaggccacgcacgcaccgtcgtacggccccgtttccgtgtacgcttgacgcgctggtactctcgccgcccgtttccgtcgcccctaagacgtagtatgttcatgaacacgacgcgccttgtacatgtctctggaatgtgcagcctgcatgtgttttgctttgcgagcgtttttcctttggctgtcgaccgatcgtgaatccgtcacgcagcactcagcagtagtgagcctaacatcctgccctcagtgtggaaatggcactctgatgcttgggttccatggtagctccagccaggcagccaggctacccgtgtgaaacttgaaaataattcggcgtatgttttg

SEQ ID NO: 15164 - DNA, 507 bp, Zea mays
  unsure at all n locations
  Clone ID: cC-zmpo14820004e04a1
gggtataaagagtaatcttgtctcattagctcatctttgatgtccttgatgcatgactatatatggtcatacacagattaaagaagcactatgaaggatataaatgaattccaagatatgaaataaagataaaacagatgtaccaaatagtggaggaagtaaagctaactagagattataagctggtaggatagcttaaattaaatatgtagcaaactaaactggcagggaaatatttcatatttgttatctgcttcaggaaagctaaatagctcatcccttcgtttctagtccttgtcgtcgtcatcgtcgtcgtcatcatcccccttcttgagaccggttgtccccccttctttgcttattggtattttcatgtgcccaaacggagtgtcgacatcgatgtgtcccttgatggtgtaaccagtgcccttccccctgatcatatctcagatagcatagccgaaatccttaggcctgaagctgataggcangttcatggtggtcact

SEQ ID NO: 15165 - DNA, 521 bp, Zea mays; identical to SEQ ID NO: 12236
  Clone ID: cC-zmpo14820004e04d1

SEQ ID NO: 15166 - DNA, 150 bp, Zea mays
  Clone ID: cC-zmpo14820004e05a1
gcgttaagaagacctcggtattactagtgattagagagggcaatataagaatacataaatagagaaaaacgagcgaaacaagtaggctcaaggccacccaacgaccctgatgccgtccctacgcaaaggaacggacacaaggaaagaacg

SEQ ID NO: 15167 - DNA, 531 bp, Zea mays
  Clone ID: cC-zmpo14820004e05d1
ggcgtggccaacgcgcgcaagctcccgacatcattagttcgcttgaaagacgacgacgtccgggacctcgagcggatcctcatgagtgagagtgacatccagaacgaaagcggtgaggaggcggaggcggaggcagaggcagaggcagaggcggcggcggacgtgaaggacgcggggtcaacgtcgacgaacactgcggtggtgatggcaacaacggaatgggtgacattcgacgaggagagaccaagcgctggcgttgtcgcctaccacggcgggggtcacgtctctaatcactggaaccccttcgtcgctgcgccgttagacggtagggaaggcggaaacctgatcgagcttttctagttttctaaccgaacgcaatattgttgggttaaaccataaccttttgctcttttgcgcccgcccgattggacactatgctctttgtaaatagtaacgtgactcgtttggtccagctttgttagtttctcattctatggagtgcaaccctaccatgactacgtggagaatctc

SEQ ID NO: 15168 - DNA, 511 bp, Zea mays
  Clone ID: cC-zmpo14820004e06a1
aatacataataaatgaataaggcttttattgattgtgtttcttctcttcatgcatgtaacaaggccggaaccggaaaccctagaacatatatatatacgtacgtatccaacagcagcacatacatatacatgtaaggaaattaaaataatttgatatagtacgtacgccttggaaagacctgcatgcggcgtggcatcaatataatataaattataatatgcatgcagatcgatgcaagaaggtcgagaagcgatcgatcatagtagatagcatgcatatatatatataataattaatcgattcatgcggcggcggcggcgacggcggcgtggtgtgtgaatccgaaggcgatgtgcgccatccgaccgtactccctgtcgtgcgcggcgacggggacatcctcctcctcgcccttcgacgcgtcctcgcagctctcggaggcgcccattgcggcggtcagctgctccatggccttgccgtagatcttcgccttgaggttgtccagcgcgt

SEQ ID NO: 15169 - DNA, 505 bp, Zea mays
  unsure at all n locations
  Clone ID: cC-zmpo14820004e06d1
aattnttgggtggacccacccgtccgcggacgcgtgggcgccgccagctccgagtacaagatcgacgacctcgctgagctggaggcggcgtcctcggatccgaaggcgcgcgcccgattcaaccactgcctggagcagtacgggggggccgccgacctgctccgggacgcgctggacaacctcaaggcgaagatctacggcaaggccatggagcagctgaccgccgcaatgggcgcctaccagagctgcgaggactcgtggaagggcgaggaggaggatgtccccgtcgccgcgcacgacagggagtacggtcggatggcgcacatcgccttcggattcacacaccacaccgccgtggccgccgccgccggatgaatcgattaattattatatatatatatgcatgctatctactatgatcgatcgctttttgaccttcttgcatcgatctgcatgcatattataatttatattatagtgatgccacgccgcatgcaggtctttc

SEQ ID NO: 15170 - DNA, 469 bp, Zea mays
  Clone ID: cC-zmpo14820004e07a1
aatacataataaatgaataatgcttttattgattgtgtatgttctcttatgcatgtaacaaggccggaaccggaaaccctagaacatatatatatacgtacgtatccaacagcagtacatacatatacatgtaaggaaattaaaataatttgatatagtacgtacgccttggaaagacctgcatgcggcgtggcatcaatataatataaattataatatgcatgcatatcgatgcaagaaggtctagaagcgatcgatcatagtagatagcatgcatatatatatataataatgaatcgattcatgcagcggcgtcggcgacagtggcgtggtgtgtgaatccgaaggcgatgtgcgccatccgaccgtactccctgtcgtgcgcggagactgggacattctgctactcgcccttgcacgcgtactcgcaactctcggaggcgcccattgcggaggtcagatgctccat

SEQ ID NO: 15171 - DNA, 152 bp, Zea mays
  Clone ID: cC-zmpo14820004e07d1
gtcgctcggtggtgacagagagccggccgcgcaagctatgttttttttaggaccacacgttcggctacgcgggcagggcgggcgcctgcacttcctgggacacggccgttgagctagacctccctaccactcgacatgtacggatatctcgt

SEQ ID NO: 15172 - DNA, 455 bp, Zea mays
  Clone ID: cC-zmpo14820004e08a1
aggctcaacatgatgcaacgtttcatgactcacataagtttcgacaaaagaaattatcaaagcctcgcctaattcacttacttttaatcaaaaggcaaagagagagagagacaagaggtaccccctcaatttgggtggtatttggagaacaaattttataccctccaattcagggtgctgcaccggcgaacataatatatctgtcggatgtctgtcgttcaactgctgcgcgttaccaatggatagcatctaatgggcaatgcaaggaccagagataaatttttactagagagatgggtcattcgatggggggtctagaagcatgcaagctccttgaggcaacccttggagctgccctttgcgttcgtgcatactgccatgggcctgttgttggagcctcatactcgacgtttgcgtcattcatggtgacgcccgtgcgtgggaccttgggagtg

SEQ ID NO: 15173 - DNA, 304 bp, Zea mays
  Clone ID: cC-zmpo14820004e08d1
gtcattcaatggggccgactgccgcccgcccaggatatgttttttgtcggcaccaacatccggtgtcgggggcgggggcgggcgcaagcaattcttgggactggtcttgttgaagtgcaccctcaccttcctgacatgtacggtatcctagcggtgcctgtaacgtgcaatctggactggatagactatggtttacaggaacatcaactggggtagcgcatgcataaacatgctagagggtgaatgtggcccattccaacgcctgcacactcaaggatctagggaggcgggtatccttcatgcc

SEQ ID NO: 15174 - DNA, 434 bp, Zea mays
  Clone ID: cC-zmpo14820004e09a1
gctcatcatgatgcaacattttttgacggacagcagattggacaaagcaaatgacaaaaaccccaactccttcaatcgctctgaattaaacggtattgattgactaagacatcaggtccccccgcacctgggttgcaagaaggagaaaaacttgaagacccctacactcgaggtcttgcacttaactggtgtataataaagaaacaagtctgtcttaacacggtggtgggaaaccacaggataacagctaacggccaacgcatggacctgggcataatggaacccacacacttgggacctttgaagggggggccagaaccatgccaacccgatgaggtaacgcttggcactccccctagaggcctagcatatcggcaggctcctaccagaagagaccgtatcattttcagacgcaccattcatactgacgcctg

SEQ ID NO: 15175 - DNA, 403 bp, Zea mays
  Clone ID: cC-zmpo14820004e09d1
gttggagcctatggaaatggatccgtatcctttggggcttgtcttttccccaaacatgaccgtgtcgcgcgcgtgctgccttatcaataccgacagcaagagcgccgaccgtgaagcaaaggcatcgccgtgcgtgtgttcctagatggccccagctatagctttactgctctgcactgacttggtacaatgcaccagcttgtccatggatgacggcaactttatttatcaccggtccaacaccagaaccatgagtttttgcaccaacgccattgagaattcctagtgacagcctaacagaggttgtttgctttataccctatatagactgagcaaacagtccgctataagggttctgtcctcctggcattagccatatgcatctttctgtcgattacacact

SEQ ID NO: 15176 - DNA, 392 bp, Zea mays
  Clone ID: cC-zmpo14820004e10a1
cagcccaaaatgggcgcgaggtgggactgtcattacattaaaaaggccaacaccctccaaggttccaatacaatgcctgacccctgacatgggggaaaggacctcacggtacggtattgcgatgtaaaaaaacaccataacgccctgctttatggaataattttactgtgctctaaaccagctgggaaggagtactaacgcccaaatttttttgtatgctccaccattaatataaccgcccgcgttctgtccatgtatttttatataaaagaaacatggtgcttgggtggaacccaatataagtttgacaactgaaacggaaaaagaatccgtgcaactgcagagtcttgtatcatacgaggcattctagggcctgaaaccttcccttgggg

SEQ ID NO: 15177 - DNA, 488 bp, Zea mays
  Clone ID: cC-zmpo14820004e10d1
ggggaaatggctggttccacaaacaacactcttaaggtgctgttttccctaatggttgtatgcgccgcacgggggacagccaataagactggatcgaacgcaggagacttggcgccagaccctgctaccttaggagcatgaggcgccaccgcatccccagaacgtgcggcttgagccagcaagacgtgcgacatatcgaaggtcggcgcgaccagggaccgttagacagactctacacaggcaatccacgacacgtggacgttagcgcgctgtgcgaggggagagacatcgatgctcattcccaaaggccactacctgtagggcactctttactccagaggcccgggcatgggggacataatcatccaactcgacggcattctgctgggatccaacgacctgaccaagtacaccgtgagttggacccaggtgtcgcacggtaaccacattgtcatacacggctccggcacgcttgatggccagggcac

SEQ ID NO: 15178 - DNA, 492 bp, Zea mays
  Clone ID: cC-zmpo14820004e11a1
ataagtattatatttattttcagaccaatcccaaacagaggtggttcatgttatacaaactgtatacgtacatacactcgtgtgggattaaatgaatccctactttctgtgtgggaaaaaaaatgaccaaactgtactgtgatgtgtaacaatgccacaacacattacttgaaggcgaacgtttattaattatgcataacgactacctgtgatccatgcttgctttcttccatgaaatgaaacgcagtcatcgcgacctgggatggccaggccatgagctataagaagcaggctgtgacgcccaccggccggacttcagcacggcttgcccgctgcagcatgacagtgtgccggagaagcgggtgagccttgtaacgtaggttcctggcttgggcttgacccactcgctggtgtcgacctgcttgggggcgccgcccgacggattgaagatggcgccgttcatgaacaggtcgtgctccgtgtgccacaccc

SEQ ID NO: 15179 - DNA, 551 bp, Zea mays
  Clone ID: cC-zmpo14820004e11d1
gcaccgcgttcgtcgcgctcatcaccctgtgcgccgtcctgctgcccttcttcaacagcatcctgggaatcctgggcagcatcggcttctggccgctcaccgtcttcttccccgtcgagatgtacattcgccagcagcagatcccgcggttcagcgccacgtggctggcgctgcaggccctcagcatcttctgcttcgtcatcaccgtcgcggccggggctgcctcggtacagggcgtgcgcgactcgctcaaaacctacgtgcccttccagaccaggtcgtgatgagcactgcacgtacggtcccatatgtagctcaaaaacttaattacgtgctcatcaagcagccaggctccttcattcaattccaaagcaggattaatttgggatacgtggcttaattatattggtgtgtttgcgatggcatggtacgatgggttggagcagatcctcttaggcgtgtttcgcaatcctcctccaacattattgaaaatatgtgaatgattgattgtattccaataccgggaatatgagtacatatatacagcgcat

SEQ ID NO: 15180 - DNA, 414 bp, Zea mays
  Clone ID: cC-zmpo14820004e12a1
agtgaatgaatggtacgttagggacattccattcatgttagggaatgaatgctacacgatgcctacggagacgcgctaccgatgtacaaacaaggtaggtattgtttgtgaggggggaggatccatccaattgagcttcgcggtggaagaacggccggcggtcatggatatcaggcgaccacttattcgatcaaggagccgcgcagctgcgtcgacatgttaccgccgccttggtacgactccaccttgaagtcgacccagctgcccagaggaccactcatatacctgtacactatgtcgtccaccatccactcttcagcgacctgtgggctggccatatgtcggtggatccgttctgccgacaagctctgcaagaccggcgtttgcgtggaccacaggccgaatccaccggtg

SEQ ID NO: 15181 - DNA, 572 bp, Zea mays
  Clone ID: cC-zmpo14820004e12d1
ggacgaatctactcgctgcaccgaccgaccaaaccctaggcgttcggcgggcgtcaccacggcggcgaagaaagggtgcctcgcgtcgccttggtgtccccgaagtcgtcgacggtgcagctcgatccgcctcgtcgagcatgtcgaggagggtcccttgcaaattcttcttgcatggagcttgcttcaaaggagattactgtgaattctcccatgactgcaatgatcaaccagataatgtttgcactttctaccagaaagggacgtgcacctttggtagccgttgcagaaatgaacatgttgaagttcattgtaactgcccccaaccagcaaccactgtagcgcgtgcatcctccaattcttctcagctagttgcttcttccagagatccccattgcagcgaatgccaaacggatttatgtgaccaaacacagcagatttgcaagtcaacagcagcactttctgcacatcaacctgcatgggttgttgattatcatgaccatgacactccagatgatactacaagctggccgttgcaccaagctgtgcaaaatcaaacatcacaatatcct

SEQ ID NO: 15182 - DNA, 478 bp, Zea mays
  Clone ID: cC-zmpo14820004f01a1
actggtactaatgttatatttcaagatttggatattgcaaaagaaagacaatatacaacacctccacttagcgaaggaacaagtgctgtacaggtttgctgctctaccaattgaatgatcagactcagaagtagcaaccagttcagagaaaaactgagttgctctgttttgcaggagcacccattggggcaaggtcactgaaaggatcaccaaatgggttcgaagctccagatgtaggcacagagtactgatactggtggtgatacatgtttggcattggcattgccaacgtctgttgatgctgctgaaaatactgctgctgctgtggctggaaatacagctgcgcctggtaatactgctgcgcctggtaatactgctgttggttctgagccatcagtgccaactgcacattagccggtggtgcaaatctgctagacatggtgaacggatcgctggcattggtgcagaaagggttggc

SEQ ID NO: 15183 - DNA, 623 bp, Zea mays
  Clone ID: cC-zmpo14820004f01d1
actagccctggttctgaaggagagcttcaagatctactgctcaattaacgatggcatcatcaatctcgtcgatatgttcttcgaaatgccgaagtacgacgcaatcaacgctctggcgatttacaaacgagctggcctgcaggcagagaaccttgccgagttctatgacttctgcaaacagcttgagcttgccaggacgttccagtttcctactctcaggcagccacccgcatcgtttcttgcaacgatggaagagtacatcagagaagcaccccgaccctcgatcaagagtgaggagagcgaggagccgaagctactgacctacgagcaagaagctccagaggaacccgaaaatgctgtggaagaggagaaagaagaaccgagtcaaaaaccagaacctcagcctgtgcctgatccagaaccccacccacagcaaacgactggagatctactaaacctggaagcagaggtgaatccttcggctctggaactcgaacaaagcaatgcattggcactcgctattgtagcaccaggtgactacaagccgccagcatctcaaagtatgtttgatgtcaattcgtctgggtgggagctggcactggtcaatgctccaagcacccata

SEQ ID NO: 15184 - DNA, 423 bp, Zea mays
  Clone ID: cC-zmpo14820004f02a1
ggggacaatagcaagaatccagcacttaaaatttggtacagccacccagttacatttttggtttcctttcctttctcagttacatatttgtaatccaggtgaaaaggatttggggtttagtgccagccagtctgcgacaactggggtcggtcgtcgacgacgggctattacatatcgatcggcgtcgtcgatgggctattactgatcgtcgtcgtcgtccgagtccaactgtttgagcagcgaggcgcaaatgggcaacgggacgtccttgagggaaccgaacgggttggcggggcgcaggttgtcgctgatgccgacgttcctggtgagcaggacgccggcgcgggccctgtccgcctgcacctgggcacaatccttgcgcgggcttttcaccaagaccaccttgcaaatgtcctcctcggg

SEQ ID NO: 15185 - DNA, 624 bp, Zea mays
  Clone ID: cC-zmpo14820004f02d1
ctcgtcgtcgtctcactcaccccgccttcacgcctccctcaccatataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctatacagttggactcggacgacgacgacgatcagtaatagcacatcgacgacgacgatcg

SEQ ID NO: 15186 - DNA, 340 bp, Zea mays
  Clone ID: cC-zmpo14820004f03a1
agatagggggtttttcgtttgttccggccgggtacaaaagatgacgggggtagcatttatacaactactcagaaaacatgaatggtagctactaaaataatgcgagatggaaattatttaaatttttttaggaaagatgtctgctagcatgcatgcgcgcattaacaaaccgaaacaaatgggctatatggatatgggatttttttttaaaaaaaaagcgagcgagagaacttttgtttggacccttaggaattctcggacgtttcgttgtaaagtgtcgtaggcccggagcaacttgccgcaattggggagcggcttcttgcggacgaaggccatgggg

SEQ ID NO: 15187 - DNA, 612 bp, Zea mays
  Clone ID: cC-zmpo14820004f03d1
gtcgacccacccgtccgcgccatccaaggcgcgacggtggagatggagtgccgcctcttcgtgtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacgacggcatcaagcagagcggcgtccgctacgccaaccccatcgccttcctccgcaaggagccgctccccaactgcggcgagctgctccgcgcctacgacctctacaacgagacgtccgagaattcctaagcgtccaaacaaaagttctctcgctcgctttttttttaaaaaaaaatcccatatacatatagcacatttgtttcggtttgttgatgcgcgcatgcatgctagcagacatctttcctaaaaaaatttaaataatttccatctcgcattattttagtagctaccattcatgttttctgagtagttgtataaatgctaccaccgtcatcttttgtacccggccgaacaaacgataaacacact

SEQ ID NO: 15188 - DNA, 379 bp, Zea mays
  Clone ID: cC-zmpo14820004f04a1
accccggaacttttagttcattaaaaactattcagcatagtcctgggactaaaggtatatttcaagatttggatattgcaaaagaaagacaatttccaacaccttcacttagcgaaggaacaagggctgtcacaggaaacttgccacgcctctggccaaactgcccgccgagacggcgcggccgtcgggggagaaccatgtaacttgcacgtacttgagaccctttgtgcgggccgagatgaatacacgcaccgtcattctgccaacgctgttgtccgtgaccgatacgaaacttggcgggctcagctacttcagggccaacgaccggcagatgtacttcggggctcccggagccttctgcgcggccaagctcgttaag

SEQ ID NO: 15189 - DNA, 214 bp, Zea mays
  Clone ID: cC-zmpo14820004f04d1
gtcccgtttttctctgaactggttgctacttctgagtctgatcattcaagtgctgtacagagcacacacgccgaccagaggggggggattaaacgcaactgaccacattcgctgatacaccgaagaagacctcacctgcaagtaggtcacgcacccgctgaagaccaccgaccaccgcatggccacctcatggcaccttcccccccgtgactgg

SEQ ID NO: 15190 - DNA, 531 bp, Zea mays
  Clone ID: cC-zmpo14820004f05a1
catcagtcaagcaatcgtcgcatatagtacaagatgtagtaataatatattacacacacgtacatatatgccgcccatccaaatccgatgtatataggaagaggagtatgtgcccgaccgggccgctgtctactagcacggctggccgacgatgcacttgagtggtccggcgaagcgcgtgagctggacatggacacgtggtcgatccacacgttgctggacgacagcacggagacgccgtcgccgtcgctccgcgtgcgcagtcggtactgccgatttgagtcgcggatcatgccgcccgagtgcgccttggagtcgtggatgtgcaggttgtgcaggatcacgttctgcacgttctgcagcgtgatctgcgcgaacatgatgtgcacctgcgcgccccgaccgtcgatcgccttgttgaggttcacgatcagctcctgccgcagctcgatcaccatgtcgtgcgcgaacacgatccacagtggacggtcctgtatcacggcgtgccgtagcgtgcccttccgcgggatg

SEQ ID NO: 15191 - DNA, 570 bp, Zea mays
  Clone ID: cC-zmpo14820004f05d1
gttgacccacgcgtccgccgtaataaggagccgccgccgcgtgtccgttttcttctacgtcgtcctctccgcagctgcagctgcagccgcggcgcaggcatccaataacgtcacctccgacgaggagtactgggcggagcgcgccgaggtggctcggtcgcgcaacctcgccgcctacgtcagcgaccccgtggccgccacgaaccgcttcaacgcggacgtgctgagggccacgacgcggcgggcgctggcgaggtacgatggcccgtgcatggcgaccaaccccatcgaccggtgctggcgctgccgcgccgactgggcgacggaccggaagcggctggcgcagtgcgcgcgcgggttctgccacaggaccgtcggcggcgcggccggcaagctgtacgtggtgagggacccgagcgacgacgagatgatcatcccgcggaagggcacgctgcggcacgccgtgatccatgaccggccgctgtggatcgtgttcgcgcgcgacatggtgatcgagctgcggcaggagctgatcgtgaaccacaacaagacgatcgacgggcggggcgc

SEQ ID NO: 15192 - DNA, 517 bp, Zea mays
  Clone ID: cC-zmpo14820004f06a1
gatcacaataatattggtccgacgtatattatatgtgccggaaggcctctatatataggagtccaactctatttagcaggaagatcagacaagagatgtcccgctaaacaacttggctgaaacacaatcgaatttggaaaagcgaatgaagcggaaattaaaaagaactagtgagctagatcatcatcaaggatgagataccatgcatgcatgcaaaaggaaggtcatcatcagaccaggcaagccagtgcctcgatgcttcccttgcatggcccagtgaagttgagagggccgaccaggtagtcgcccttggggatcaccaccgtggcgcttccggacgcttcgcacgctgacgtctacgcgtcctggactgcctttgtgcaatccgacttgccgtcgctggtcgcgccgagcttggagatgtcgaacgtcccgccgctgcctccagcgtgccaccaccagcgtgcccgagccggtgatctcgatgttgttaacgtgagacaattcgatccagctc

SEQ ID NO: 15193 - DNA, 514 bp, Zea mays
  Clone ID: cC-zmpo14820004f06d1
gctggatcgaattgtctcacgttaacaacatcgggatcaccggctcggtcacgctggtggtggcacgctggaggcagcggggggacgttcgacatctccaagctcggcgcgaccagcgacggcaagacggactgctcaaaggcagcccaggacgcgtggacgtcagcgtgcgaagcgaccggaagcgccacggtggtgatccccaagggcgactacctggtcggccctctcaacttcactgggccatgcaagggaagcatcgaggcactggcttgcctggtctgatgatgaccttccttttgcatgcatgcatggtatctcatccttgatgatgatctagctcactagttctttttaatttccgcttcattcgcttttccaaattcgattgtgtttcaaccaagttgtttagcgggacatctcttgtctgatcttcctgctaaatagagttggactcctatatatagaggcccttcggcacatataatatacgtcggaccaatattatgtgatc

SEQ ID NO: 15194 - DNA, 550 bp, Zea mays
  unsure at all n locations
  Clone ID: cC-zmpo14820004f07a1
attaaatacatattgtatttcaatttatgtaatcatatcaacccaacacaacaaggtgcacgaagggacatgtagcataacttatttcttgggtggtgtggtgccataaaataaccatagaaaaaattaaatattagctcgctggaacatggatcggatgagctctttcgaaatattattcctcataagaggctgatcaaatgctgagggtggtcttgtaggtggtgccggccttaaaattttcagggatgacgtcatcggcgatgcggtagccgccagacttgacggcaaagcggatgcagagggggtacttgagcggagccttggtgtcaagcgtccaggtgccggccgggccctccttgagctcaaaggagaagtcatcgccaccgtgctccttgatctccacttcggagatggtggcaatgctggcggtgaggaccaggtggccaggcttggagcctttgccgacctcgaaggtgaacggngtggtgcacgaaccaatcacgagtaatgtagccagtgtcgtcgtggcgagcatgatggagaacct

SEQ ID NO: 15195 - DNA, 393 bp, Zea mays
  Clone ID: cC-zmpo14820004f07d1
atctcgggcagaaagttgatttatgcagagcatcattttcgttttctatttttttatgttcagaaaaaacatttcccttcgaatgctctgaacaaaaccatcgaggtcagctttacgatcaccgggtgcaggtcgactgcatgaacctgacctccatgttcttgaggtcgaattcccagaggtgctcttgctgcatgatgttgccgatgaccgacacgccgggccactcgccctcctgcaagccgatgcacttcacgcccggtttcacgtcgatcacgtagctcttcgccggtggctccagccgcgcgcacccggtgaactgcaccgccagctttgggatctccggcgctccccgtcgcggtgccgtccagttgtagcagtgctcgaacgggg

SEQ ID NO: 15196 - DNA, 468 bp, Zea mays
  Clone ID: cC-zmpo14820004f08a1
attaaatacatattggataacaatttatgttattatatcaacccaacacaacacggtgcaccacgggacatgtaacataacttatttcttgggtggtgcggagccctaaaataaccatagaaaaaattaaatattaactcgctggaacatggatcggatgagctctttcgaaatattattcctcataagaggctgatcaaatgctgacggtggtcttgcaagtggtgccggccttaaaattttcagggatgactttatctgcgatgcggtagccgtcagacttgacggccaaacggatgcatagggggtacttgagcggggccttggtgtcaagcgtccaggtgccggccgggccctccttgagctcaaaggagaagtcatcgccaccgtgctccttgatctccaccttggagatggtggcaatgttgggggtgaggaccaggtggccaggcttggagcctttgccga

SEQ ID NO: 15197 - DNA, 168 bp, Zea mays
  Clone ID: cC-zmpo14820004f08d1
gtcgacccacccgtccggtcatacattattgacaagcacccagccttagaagacgatttttttttaccgcaaacaaagtcccgtgcccgggcagggggcgtgtttgtccttctctgagcatgatgacttggactacaccctctacctatggttctgaccggatatcta

SEQ ID NO: 15198 - DNA, 441 bp, Zea mays
  Clone ID: cC-zmpo14820004f09a1
gtatgatcacaatcaaggcataccataagattgacagcattgggaaatcaaatgttcaaccatctccatactaatgctagacctgttcatcaaattgcttcaatggtcttaaataaataatgccccttcgtttatgtgtagctatcaggccaacacatcaaggccccatatggacatgtagcttaacttatttcttgggtggtttggtgccataaaataaccaacaaagtagatggtcttgctaacacagtgcgccagatgagctcttttgaaatatagattattttcagatgctgattagatgctgagtgtgggcttattagaggtgccccccctgaaatcggcagggattacgtctcccgcgatgggcgtgtcaccagacttgacagctaagcggagagccagtgtgctcttgagcggagccttggtgttgagtgtcca

SEQ ID NO: 15199 - DNA, 380 bp, Zea mays
  Clone ID: cC-zmpo14820004f09d1
gtaggaatcaatggcactcgaacaaataccttggcggcaatagtgtttctccatatactccattgtgctccgccggcgatgctagctacactatttccggatggctggtgcaccacgccagctcaccttacatgtgggggagggatccaagccctggccacctgattcttagcccgaactgacacacgatatataacgcggagatcaatgagcatgggggcgatgacttctcctctaccctgaaagaggacccgaccggttcgtgcacactcgacacgaaggccccggggaagtcccccatatgcatccggcttgctgacaagtctggtggtgaccgaatcgtccacgacgaaatccccgccgattcctaagttggcacc

SEQ ID NO: 15200 - DNA, 427 bp, Zea mays
  Clone ID: cC-zmpo14820004f10a1
gaatcttccctatctatgcataccataagttttaaaacatggggaactgaaatgtccaaccacctgcatactcatgctcgacctgaacatcaaatggcttcaactgtcttaagtgaaaagagccttccgtttatgtacagctataaacccacctcaccaagggctcttacggacatgcaccttaacttatctcttgggcggtttggcgccataaaattaccaacgaaataattggtcttgataacacatgcgccagagggagctgttttgaaacatagtttatattaatatgctcactagatgctgcgggtgggcttataagtggatccacccttgaaaacggcggggagcacgtcgtccgcgatacgcttggcaccagacttgactgctatatctgggccagtctattcttgagcctgccttggtg

SEQ ID NO: 15201 - DNA, 292 bp, Zea mays
  Clone ID: cC-zmpo14820004f10d1
ctcatactcaatggcccgcgaacaaacaccttggcggcattgtttttctccatatgcttcatggtgcccaggagggcgatgctatctactctattcaccgatggtttgtggaccacccagctcacctccctgggatgaaagggaaccaagtcttgccacccgatcccgacccgcaacggtgagacgatatttcaacccggagatcaaagagactaggggcgataactcatcctctactctgaaagagggccctaccggctcctgaacactctacaccaaggcacagctcaag

SEQ ID NO: 15202 - DNA, 287 bp, Zea mays
  Clone ID: cC-zmpo14820004f11a1
aagtgtcacaaatgtatatataaaccaaccggataatgagggggttcatgcatttcacacagcattcacaaacacacacaacgatggatatagatgctgactaactggtccgaggcatacaatacatacatgtttgcctacgccgtatgaccataccacaacacgctagctgaggggcggcaattaatcagttgattagcgcacacgcgggatctatgcttcccgtaattggtgttgcgaaacgcagtcgattttaccgggtatgaccgggccttgggcgaaatgaa

SEQ ID NO: 15203 - DNA, 413 bp, Zea mays
  Clone ID: cC-zmpo14820004f11d1
ccacccgatacgacaataaatctatggggcatcgcccacccactgcttgtggctactttcttcttttgggctgtaggatgccggcctctgggggcatgcgttttggaacggtaagggccaggtgcatggcggacgtgccgtaaacccactggctgacgagatttgttttctccacccattgcaagaggtttgcactgccactgccgggcgccttgcattcaattaccctgttcatagacaatttggccttgctgaacatgcaagtggtcgctttcgccaagctcacagcgcaggcgctgaagcacgtttcggtgacggcccggactatttcaccgacgcaagctcaggccctcttgagctgcgacacgatgttcttgaacacgcaggtcgccatttatgcggaacatctagcc

SEQ ID NO: 15204 - DNA, 258 bp, Zea mays
  Clone ID: cC-zmpo14820004f12a1
aagtgtcacaaatgtacatgtaaaccaaccggatcatgagggggtacaagcgttacacactgcattcagagacacactcccgagggataaagacggtggccacccggagcgaggcatacaatacaaacatgtctgcctgcgcggtacgaacacaccacgacaggcaagctatagggcggcacttaatcagtcgatgagcacacacgcgggatcgatgctagccggactaggtggagcgaaacgcagtcgacgttaccg

SEQ ID NO: 15205 - DNA, 462 bp, Zea mays
  Clone ID: cC-zmpo148024b08a1
acaaggacaattacggttcacaatttatacacacacatcatacaaaatcgctatcatacacaggcgttgaggtgtacacgcgcaacgctcccgtgccaacagccaggctcacgcgaaaaaaaagcccttccacgatgaccgaaaaacaaagcacatccaaatccatccccaaaaagggcaaccgcgacatgcgaaacctctcaaaaacgaccatccggacgttggacacaggccacctctcttcttttcatcgccgtcttcttcacgagaagccgatggtcttaccgagcagccacaggaacagagtccactcgagcataaatatcgtgtgcaggtacgaacggtccagcgtgaaaccgaacacggtgatcccggctctgttgtttttcaagtatgtcactagtgcctgtctcttctggaaggagatgacatgcgcgtgcggcatatgaatcttggtgtttt

SEQ ID NO: 15206 - DNA, 540 bp, Zea mays
  Clone ID: cC-zmpo148024b08d1
cttccgtaagttcatcgtcgctgcgctgctcatcgccacggttagccagttcgcctccgtgctcctcaccacgcgacgcgactctgtcgacgacctcctcaacaccggcgagctcgcgctgtgttcagttgtgctcatgtccgggctcatcataatcctgagcagcgccgccatgatcacccaccaggcgcaggccctcaccggtcacaccaccaagtggcatgcctgctgcaccatcgagcccgtgctggaggaaggggagcccgggtccaaccagaactccatgatcgaccaagaacccgagagtgacagtgacacagaggacagcgaggagaccggcgacgaacatcttctggagaacaccaagattcatatgccgcacgcgcatgtcatctccttccagaagagacaggcactagtgacatacttggaaaacaacagagccgggatcaccgtgttcggtttacgttggaccgttcgtacctgcccacgatatttattgctcgagtggactctgttcctgtggctgcttggtaagac

SEQ ID NO: 15207 - DNA, 322 bp, Zea mays
  Clone ID: cC-zmpo148024b09a1
ggttaaatcgaattgttgaactggtccagacaaatggcaagcaatggtacaggtgtcgatccctcactcgagggaaagaacaaataacagggcaccaaattaaactggtgcatcagcgataccaattcgttaaatgaaaatcaagtagaaagaggaaggaaaaaaaacaaacaaaaggaagacgaaggtgtgccactgccaccgccgtgcccaatcagagcacgcccacgcatcgggaatgcgcgggagcagcatagcagcgcagcgcagccaagtctctccccccaccttggtctcttccctccggctccggctcctcgtc

SEQ ID NO: 15208 - DNA, 322 bp, Zea mays
  Clone ID: cC-zmpo148024b09d1
gacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtctgctttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaacc

SEQ ID NO: 15209 - DNA, 445 bp, Zea mays
  Clone ID: cC-zmpo148024b10a1
cagcaagcaaagatcttttgatcagccggccacccgttggtacagtacagtactgggctgtgacatgatttaaggccagggatgccatgccatccatataatatacacagtttcatttacacgagcatcctacgtcctcctaataattagtaataaataatccctttgagcaccaccaccacgattaattagaaagagaaagaaggacaggcaaggtgtgtgtttgaagattgcttaattagctgcacagatttggagtacatgcgccgtctggggtctgctgctttttccaaatccgtccggggatcctgagcttgagctccttccggtccccgccggaaaagaagagcgccatgttcctttggatgatgaggccgtcgtggctgtccctcaccttgcggtggctgtcgcggacgctccttggggggcctctccaaaccatttt

SEQ ID NO: 15210 - DNA, 512 bp, Zea mays
  Clone ID: cC-zmpo148024b10d1
cccacgcgtccgcagggagcggaggctggcgggccggcgggcggtcatggacgtggactgtgtctcgctgcccgacgccccggcgggcgacgtggatggtggcgcctcccggccgaggcccaaggccgttaccaacggcggcgtccactagctgctggagtgccccgtgtgcaccaacttcatgttcccgtcgatccaccagtgccccaatggacacacgctgtgttctcacatgcaaggccagagtacacaaccgttgccctacctgtatgcaagagctgggcgacatcaggtgcctggcgctggagaaagtcgccgagtcgctggagctcccctgcaggtactactcgctggggtgccccgagatcatgccttactacagcaagataaagcacgaggcgcagtgcggcctgagacctgtacaactgcccctacgctggctcctagtgcggcgtggccgtcgacattccttccctcgtttcccacctgagggacaaccacaatgtggacat

SEQ ID NO: 15211 - DNA, 355 bp, Zea mays
  Clone ID: cC-zmpo148024b11a1
ggcgcggtcggcggcgcggctgttcctttcgccagcgccgccgccgccgccgcagtgcccgtcgccgcggcgctcgtcgtctccttcctcgccttcttcctccactgagcgacgtaccgtgcggagtgctggaaacctgagatggatcatcgtgcttggttcacccgattaataattaattaatcgttgttttattaattcacttattgcttgcggttgcctaattatgagatcgtctgatgttccttccttccttcctaccttggtgatgcgtgggtcgccaaggtggtttcgtctctgtcatcctgcctgatctatgctaatacttatgaacccaatttggtttttgccatcc

SEQ ID NO: 15212 - DNA, 376 bp, Zea mays
  Clone ID: cC-zmpo148024b12a1
ggatgaactataaaagaggtcatttgtattcgagatatatagaatttcttcccctttccctttctctcccctgtaatgcgagcgagcgacacagcttgcgagcaattttcagcgagaaaaatgcgaaacaccacgcacatcatttcatcaatcgggccgcggggcccgggacccgtaaggatctttcgtgctccttcaagtcaagctatggccggggcctcaccgcctcctggccagctggaacgtgcgctttaagaactggttggcggcctcgtcgtcgcgggggcacagcacccggaggatggcgttcgggtcggcggggtcccaccttcgcgttgtgggcggcagcggcgtgcacccgcctgcgccggcgcgg

SEQ ID NO: 15213 - DNA, 577 bp, Zea mays
  Clone ID: cC-zmpo148024b12d1
ggtgtccgtgctcgcggaccgccgcagcccgtggcggtgcggtaggtgatgcgcgcctccttcgaggcgttcctgatggtgctcctggcgggcggcaacgagcggagcttcgtgcgcgccgaccacgccacggtggaggaggacttccggagcctgaggcgcgccttcttcacgtgcggggaagggctggtccccgaggacgtggtggcgcgggaggcagagacggccgaggccgtcgtggagctcatggcacgctccacggactacctcatcgacgcgttcagcgtcgccacgtgcgacttcatcagcgaggacggccgcgccggcgcaggcgggtgcacgccgctgtcgtccacgacgcggaggtgggaccccgtcgacccgaacaccatccttcgggtgctgtgccaccgcgacgacgaggccgccaaccagttcttgaagcgcacgtttcagctggtcaggaggcggtgaggccacggtcatagcttgacttgtaggagcacgaaagatccttacgcgtcccgcgcctcgcggtccgaatgatgaaatgatgtgcgtggtgtttcgcaatttt

SEQ ID NO: 15214 - DNA, 392 bp, Zea mays
  Clone ID: cC-zmpo148024c03a1
aaaaattaagtttagttccataaattactcatgtgagggtccgagccactcatgaccgggagcacggttgataaaccaattttacactctacagaggttgcgcatctttacccaaaagtcgtgttacccatatgccaaggggtcattgatttcatacatttttaccgaggaaacgaggcagggtagcactacgaggcctttacatagtttcactagctttagaaaacccgcttcggtttttgagaagggcaatataggaatcccttgtccgaaaagccattgcagcatgacgacccgagaacctttttatactggagctcctctaccgcccttgccccttttgggtaagggaggcctccactagcttttctaattagtcagccaagggcgtt

SEQ ID NO: 15215 - DNA, 396 bp, Zea mays
  Clone ID: cC-zmpo148024c03d1
gacgcccttggctgactaattaggaaagctagtggaggactaccttacccgaaaggggcaagggcggtagaggagctgcagtatagataggttctcgggtcgtcatgctgcgatggcttttctgactatggattcctatattgtccttcttaaaaaccgtttcgggttttctgaatctagtgaaacttatgtaaaggcctcgcagtgctaccctgcctcgttttctcggtagagatgtatgacatcaatgacctcttggcatatgggtaacacgacttttgggtaaagatgcgcaacctctgtagagtgtaaaattggttatatcagccgtgctcactgtcatgagtggctcggacccttacatgagttatttatggaactaaacttactttttaa

SEQ ID NO: 15216 - DNA, 433 bp, Zea mays
  Clone ID: cC-zmpo148024c04a1
ggaaaaccaaatcatatatttcatcgcatgattacagaacgacttgacacaaatagataaattaaatcacgtttatgtaattaacacaacccgtcaccatgcatatatattcatatcacatcacatcaataataatatatggaaacagcggtgcatgtgacgtctttcaagttgaccaccgtatcaacagtcaccaagaactagcgaggcaactgtaatggtaacggtggacggatccatcgtcgtccatgcgcgcgtacgtaagcacgcacactcttagtggaggtagtatgcgaggagggagaaaaggagcgcggcggtcgcggcggtgagggcggacgcgcctatgttggcggagggccctctggtggctgtgtcagcggcagcgccagcgtcagcgccagtgggagtcttggcggacgactcttaggct

SEQ ID NO: 15217 - DNA, 278 bp, Zea mays
  Clone ID: cC-zmpo148024c05a1
gactgatgaatccttcgttgtctcaaaatctcagggggtcaagaacacaagaacgataattttttagatcttgataccatgagtcgatacagttaactaacaacatgataacacattgaaaatcaaacagaaagaaaaagagggagagcaaggatgtatccatggatgagtggatgaccacacattatcatggttttaaagacattgctctcatttttcttccatgtcttgttccaaatttaaccgggccgacgcggacgcgtgggcggacgcgtggg

SEQ ID NO: 15218 - DNA, 315 bp, Zea mays
  Clone ID: cC-zmpo148024c05d1
tcgcccacgcgttcgccctcgcttccgtgtctgcccggtcacatctggaacatgacatggaagaaaaatgagagcattgtctttataaccatgatattgtgtggtcacacactcatccatggatacattcttgttctccttgttttcccttactggttgactttttaatgtgcttactattgtcgtaagttataccgcactatactcatggttttcaatatctaatactctatccgttccttgcgttcttgagcctctgagatattgtgatcacgtatgatccatcattctaatctcatagactaagggtcggtt

SEQ ID NO: 15219 - DNA, 575 bp, Zea mays
  Clone ID: cC-zmpo148024c06d1
gcaaccacaagtgcaggtggagctgcagcagcaaccacaagtgcaggtggagctgcagcagccgcaaccacaaaaacaagcagcacctgttatgcgcagaggagcatctattgctgctcggcaagcagcaatggcacagcaatcctctggagactatacccgttccatcttcacccaagatcaagcgtcaaacatcagggagacctgcttcggtggcatccacaaagcctgcagcagctgcatccacaccaaaacctggcggtagcccaaagaaaggtgaggtcaaacctgctgtcgacccagttcaaactccagccacaagtgcagattcaccaaaatccgagcctagtgccccaccactttctgagaccgaataagtagacaacatggcaatcgatgacgtcagtggtgatgctgcataaggcgcggaagagcttgaccctgcgctcgaggagacgccgatggatgagacgatccgtgtgacgcgcgccaagctaagaagcgcacggcaccgaggattttgctgggaataagcttcatgccggtgttttccctgcacattgcattgaactttt

SEQ ID NO: 15220 - DNA, 302 bp, Zea mays
  Clone ID: cC-zmpo148024c07a1
ctcatgttattatcgttgcataggcaagaagaaacatactcaagaagaaacggattgcatgaatgcaatggtaagaagggatccctctttttcaataaaagggatcgtattttggagttggtaccggtaacccaaactcgcgttatcggtcaggcttaagctgacccatctccgtaggaatcagaatctgcgccggactatggtgctggggcgttggtggtgtcatcagaagatgggcctggtgcggctggaggactcatacgacgactattggcgctggtgcgcttgagggaccggatgag

SEQ ID NO: 15221 - DNA, 448 bp, Zea mays
  Clone ID: cC-zmpo148024c09a1
aacccctgaatttggttggtatttggagaagaaattttataccctcaaattcagggtgttacaccgtcgaacataatatatctgccggatgtctgtcgttttactgttgtgcgttaccaatggatagcatttaatgggcaatgcaaggacgagagaaaaattataactagagagatgggtcagtcgatggagggtctagaagcatgcaagctccttgaggcaacccttggtgctgcccttggcgttcgtgcatatagccatggtcttgttgttggtgccgctatacttcacgttgaccccatccatggtgacgcccggtgcatggtaccttggccgtgcagagcatgctaactgtcttcggggtggaggaggtgccggtgatgttcttgaaggtgacatctctgacggtgacttggaggctcccttggcagtacaaatcttgttgggg

SEQ ID NO: 15222 - DNA, 499 bp, Zea mays
  Clone ID: cC-zmpo148024c10a1
gaagcaaccgttagcaatcaatggccatctccctcatttcatgagcaacagaataaatgcaggtcagggacaattacacagagtttgctcaacgtaactcgtaatttcaatgaattcttaaatgaaaaccaagtgctcatcatgtccaagcattccctgcttgcggcgcgccgccaccttatgctggagtgtaagaacatgccaaacagtcgtccccggccgcatatgattcatatcatgtttgcaagcgtcatgcaattgttggccatctggctgagctccttatcgaacttacccatggggttggggacaccggcatgggtgaacggacggtcacacgagtcgaagtcctggacagcgagctgcagcatgatcttcgcggtgcccgtgtccttgaacccgatggctcgctgtgccccgccgatggcgtcctgcgttgtcatgtacatcggggtccaagtcctgagggcctgtgcctgcggcggtggaatattgcggg

SEQ ID NO: 15223 - DNA, 505 bp, Zea mays
  Clone ID: cC-zmpo148024c10d1
aacagaataaactatggggcaagcctacccacggcttgtcctcctcgccctcgtggcgttgttgtctgccggcctcttcccgcaggcgttagggaacggcaagggcaaggtgcatggcggcggtgccgtcaacctgctggttgccggcatctgctctcgcgccccattcccagaggtttgcacggtcacagccgggcgccatgcatccaagtacccggtcatcgacaatttggctcgtgctgaacatgcacgtggccgcgttcgccaagcgcacagtgcatgctcggaagcacgtcgcggtggcggcccgcactattccaccgccgcaggcacaggcccttaggacctgcgacacgatgtacatgaacactcaggacgccatcggcgcggcacagcgagccatcgcgttcaaggacacgggcaccgtaacatcatgctgtagcttcgctgttcaggactttgactcgtgtgaccgttcgtttacccatgccggtgttcccaaccc

SEQ ID NO: 15224 - DNA, 645 bp, Zea mays
  Clone ID: cC-zmpo148024c11a1
aacaaaaaaaggaaagaaaaaaaagagaaagagaaagaaaagaaaaaaaagaaagaagaaaaaaaaaaagaaaaaaaaaaaaagaaaaaagaaagaaagaagaaaaagaaaagaaggaaaagaggaaaagaaaagaaagaaaatgaaaagagaaaaaaaaagaagagaaaaggagaaaaagaaggaaagaagaaaagaaaaaagagaagagaagaagtagaaagaagagaggagaaaaaagagaaagaaaatgaatgaaaaaaaagaagaaaaaaaaaaagaagaaagaagaaagaaagagagaaaagaaaagaagaagaaaaaagaacaaaaaaaaaaagaaaaaaagaaaaaagaaaaaagaagagaagagaaagaaaaaaaaagaaaaaaaagaaaaaaaaagaaagagagaaaaagaagagaagaaaaaaaaagaaaaaaagaaaaaagaaaaaaaagaaaaaaaaaggaaagaaaaaaaaaaaaggaaaaaaagaaaaaaagaaaaaagagaagaggaaaaaagaaaaaaaaaagaaaagagaaaaagacgaaagaaaaagaaagaaaagaaagaaagaaaaaagagaaaagaagaaaaaaaagaagaaaaaaaaagaagaaaaaaaaaaaaaagaaaaa

SEQ ID NO: 15225 - DNA, 375 bp, Zea mays
  Clone ID: cC-zmpo148024c12a1
cctcctcccccccgccccttcctctccccccgctctttctctgccccccctgggcccactgtaattatcttcctctcttgtgatcgaaaccccccatcgcaaagcgccgagaggagtggcgagcgcaaagcggggcaaactaaaaaaaatagacagaagagcggaggcgaaaaaaaaaggaaaaaaaccaccccccggggggggggagaggggaagggaatggggggggagggggggaaaaaagggggggaaagggggggggggcgggggggggggaagaagaaaccaagcagggggggcccccgggggaggcggagggggccctggggccccgggggggcaaaaaaagggcgggacggccgggggggccaaaga

SEQ ID NO: 15226 - DNA, 411 bp, Zea mays
  Clone ID: cC-zmpo148024c12d1
ccacccgtccggcggcgaccagccgtctcctgcctcctgttcgtttttgctttggtgctattgatctctacgacggcgacagcgacggctacgacagttcagtcgcggcaggcggggctcacctctcgccaaagaggctctggatacccggcgtggtggagggatgtgctgtggccggacaggacggtcggcgaagcttgggcgccgccggcgcccaatgccaacagcaacgtcccaggagggcccttcggtcgtcgttgacttattcagatccagtcgcacccgccctatcgccatcgtttcatgacacatctaccagaagatagcttgcaattcccatctcactggcgcgtgtgattttagcttcttttaacgatgaataactagtggcgatgtttgaaataattcaac

SEQ ID NO: 15227 - DNA, 405 bp, Zea mays
  Clone ID: cC-zmpo148024d01a1
ggcaataaaaccgcttcaccattttatacgatgtctccctttatttaagagttgggttgggttcttaaacttggacattgcaatggcctttggggcctgaaatttagatcatgtttatattttgaatggaattatagatccccactagttgaatgaataaaaaagtttgcaaattgccagaggcctaaaaaaagactggcgagagtgaaaaagaaagaggtgaccaaaagtgagtgatggatgcaagtaggttcaaacgcaggcgagctccttctccatgccaaaggacttgccgatggcgttcttgcagacggacatggtcttggtggcggacctggtgcacttgatgtccaccgttgatgaactgcaccccctggcagggcaggttgttggcgcaattgaccg

SEQ ID NO: 15228 - DNA, 405 bp, Zea mays
  Clone ID: cC-zmpo148024d01d1
tcgcgctcaactgcgccaacaacctgccctgccagggcgtgcagctcatcaacgtcgacatcaagtacaacaggtccgacaacaagaccatgtccgtctgcaagaacgccatcggcaagtccattggcatggcgaaggagctcgcctgcgtctgaacctacttgcatccatcactcactcttcgtcacctctctctttctcactctcgccagtctttttttaggcctctggcaatctgcgaactttcttattcattctactagtgtggatctataattccattcaaaatatatacatgatctaaatttcatgccacagaggacattgcaatgtacaagtttaagaacacaacccaactcttaaatagagggagacatcgtataaaatggtgaagcgcgtttattg

SEQ ID NO: 15229 - DNA, 554 bp, Zea mays
  Clone ID: cC-zmpo148024d02a1
aactaacaatgggtattgattaatttccaattggcatgtccaaacgaatagtgtctcccattctcccctctttacatatcgaaattaacagaaaagggagaaatggcaaagcaaataaaatgaatggatcaatcgacatgttcagacccaaattaaagtacttaaatatatatataaacggaatccaaccgaatacaggcaatggcagccagcagcctctccctccgatcctcctttaattttactgcaggtagtaggcgaagaaggagagcacggaggcgcccagcacggtgccgacggccgggaacgcggccgaggaggcgctggtgggggcgggcgccggggcctcggcggcgaggaccacggtggcggaggcggcggcggcgaggacggcgcaagcgaccttcttcatcttcatcgcgacttgatgtggtttgccggagccgaacggagcgttgtcgggatcgagacgaggaagaacgaaaggcacgcaggcttaattacaagatggatcaacggatgatcacacttgctattattggttgcgcccttgc

SEQ ID NO: 15230 - DNA, 264 bp, Zea mays
  Clone ID: cC-zmpo148024d03a1
cttttcttttttttttttttttattttttctttttttttttattttggtgtgaaacaaagggagtttgttaagattgtgtccaatcgcgtacttaaaaaacaggaacctaatctccttgatctcaattatgaggctgcgtcttcccaaactttacaaagccgttcgggtttatcttccttatcaactaatcgaagcaacaaggactccctcttccccgggcttaaaaaagttcctgtccctgtccccctggggtgagggggaaa

SEQ ID NO: 15231 - DNA, 474 bp, Zea mays
  Clone ID: cC-zmpo148024d04a1
ggatcgaatgtcacatctttatatataacaggagttctatacaaaataaataattacattataaggagacaacggtccagcaacccaaagttgactgggagacgacgacctagaccactcacgaactcatcgtagcatcttccatgagcatcatcctacagtacctggtcttgacctgggacttgagatttcaggtaccaacttgctcttcaggtgacacgtgtcctcacttggattatgcgcactggtgccctgaccacggcgcacggcggaatgccccagactacacgacgtcggcgagcaatccccatgctccacaagtcctcaataccgccatgtgaggtcgcgaacgtgttcggtgtgctctggagactctccttgaccatcaaccaagcccagagtaaagcttctgacgggatgcccatgcgagcggacatacatcttcccatggtgctttgaaacgacatctttttt

SEQ ID NO: 15232 - DNA, 470 bp, Zea mays
  Clone ID: cC-zmpo148024d04d1
gtcgaccacgcgttcgagaagatgtcgtttcaaagcaccatggggagatgtatgtccgctcgcatgggcatcccgtcaggagctttactctgggcttggctgatggtcgaggagagtctccagagcacaccgaacacgttcgcgacctcacatggcggtatttgaggacttgtggagcatggtgattgctctccgacgtcgtgtagtctggggcattccgccgtgcgccgtggtcagggcaccagtgcgcataatccaagtgaggacacgtgtcacctgaagagcaagttggtacctgaaatctcaagtcccaggtcaagaccaggtactgtaggatgatgctcatggaagatgctgtgatgagttcgcgagtggtctatgtcgtcgtctaccagtccactttgggttgctggaccgttgtcttcttattaatgtaattattcatctcgtatagaaactcctgttatatt

SEQ ID NO: 15233 - DNA, 476 bp, Zea mays
  Clone ID: cC-zmpo148024d05a1
agaaaacttcttccaggggcacatttaacgaaggacatctttgaagccatgattaaggcctcataaatttacaagcaaccaattactggggtggttggacgtgacccaataatacattatatcaaagtttactcaacttttatagatatatgctcattaggaaggagggtaaaatacccctgtggccgtgattttcttcccgtagtcaagggttctttttccttgattttttcggggactagtagaacaaaaatttacaagcgattttcagcatatggccgaagaaccagcatgctttttcaaccaataggactgacatatccgggtgtcaaaacaccaatgttttacccaggtgattggatcaacatgtttatttgttcccggccatggtgaagttggttccaacaaaaagaagtttaaactggattgcttacttttttggttctgtgttttcatttggaggtttcttttccttc

SEQ ID NO: 15234 - DNA, 354 bp, Zea mays
  Clone ID: cC-zmpo148024d05d1
gatgacttcgaggttgcaacgaatagctcgtcagatctggattgtgtgagaccatctagtgccccaatagcttctggtttaacaaacggagggggctcagctgcaagaaagtcccaacttgaagggtgcataaagtccatacaatcatatgatggaattctgcaaaataagtcattttcgtttcagatatagctgattgctccctcacctacggtaactatgaagagcggaactgaatgaatgaaaactccaaatggaaaaacaggatccaagaagtaagcatctcagttgaaacttcgttttgaagtgaccaacttcaccatggacggggacagataatacatgttgatccta

SEQ ID NO: 15235 - DNA, 499 bp, Zea mays
  Clone ID: cC-zmpo148024d06a1
atcttcgttaaaaattatagcagtacaaatcatagcacattctgtaggtgtaggatacagtaacacagcagcagaacatcaaacccatcttctgccaggctctgagcaaacgccaaagcctccaacgtggcacctacgtaccgtaccccactcctggtacccagtcacccaccccacaccctacctcgctcgcagtcgcagcttccgctgtacgcacactactgcgcggtgcacgcaccgatgacacggcggcgcagcttatgtatgagtaagtatagggactcgccatacaggtagtcgtcgcagcgtgccaccccgtctagcgatcgaacacagtcgacggggaacgccggccggtccggtcagttggtgagcgcgacggcggcctcgtgcacgaggggctgggtggcgtgcgcaacgcccttggtcttccgcttcacctgctcccgggacgccttccgcgcgcccgggtccgttatgcgcttgacgaacgcggtga

SEQ ID NO: 15236 - DNA, 438 bp, Zea mays
  Clone ID: cC-zmpo148024d06d1
gagatggacaaggaccaggacctggcctacaccgaccggagtggccgtcggaactacgagtacgtctccctgggctgcgacgcgatgcccgtgctcaagggccgcacccccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgagtagcttgaatgcggctgctgaggcagtgggcaagccggagtggggcaacgcgggtccgggcgactccggcagctacaaggactggccggatgacacgggcttcttccggcgcgagggcggctggagcacggag

SEQ ID NO: 15237 - DNA, 269 bp, Zea mays
  Clone ID: cC-zmpo148024d07a1
aaaaaaaaaaaaattttttttttcacacaaaataggggggggggggaaaacaaaaacggtttatttggaaacaaactggcagggggacaggagcaaaaaaacaaaaaccttagggggcgtttacattaccccaaagggttgcaaaagcataacaaacttgaaactccgggagagttgtaaaaccggggaatttaagggaggggggggggacatatttggggggcctttacttaactcacactatttttaaatcgagagggggtcttttc

SEQ ID NO: 15238 - DNA, 218 bp, Zea mays
  Clone ID: cC-zmpo148024d08a1
aggagaaactgccaacaggcctttttattattacccaattaatccaagaaaaacacacatttgggggacaattcatttggagctccattgacgggttttttggaaaaaaacaattatcttaaaaaatgccccattaattggaaaacaattaattttttccaccatttaaaaagggtattctttgcggggtcagccggggaccaccttacttaaaacct

SEQ ID NO: 15239 - DNA, 412 bp, Zea mays
  Clone ID: cC-zmpo148024d08d1
tcggcggcggatagcggcgaggcggtggatgcgaaaaatatccattacgacttctgctcgacgctgtgcgagggcaagaaggggacggacctggtcgtgtgcaaggagatctgcgcgctctcccagtaattcaacctgatgctttacggtaggatccaatgcaagggcaagtgcacctatcataagggcattacggtgccgttcatgaaggtctgctcataggagtgcgacaaggcgtacgtggtgaaggcggccgaggtcaccaatgcctgcagcgtcacctgcgccaaggagaagaaccctcgcctcagcgagaactgctagaggtcctgcacccctcctccttattgaagctaaccctctttgaaatgaatgaaccatgcatgcatgccatgtatgcatgcgccggggt

SEQ ID NO: 15240 - DNA, 440 bp, Zea mays
  Clone ID: cC-zmpo148024d09a1
atattactatacggaaaaaaagaggagtacatgcatattatgtattttctgctgggagtaaaaggtgttgtaaaaccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggcggagacgggggcggggcttggagcaggtgactcggacacggtatccttggccaccttaccctttacccaccaccactgcttcgacgggctttgcgcgggatcatgttggaatcctcatgggttgccgctgatggcttgatcttgcgctta

SEQ ID NO: 15241 - DNA, 547 bp, Zea mays
  Clone ID: cC-zmpo148024d09d1
gaccatccctgcaaattaccgcgatggctcccaagatcctagtcatccttgtgttcctcgccgtggcctcaccggcggctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggcggagaaccacgtccttctcagttacttcgaccccatcaagctggacgagatgaagacacgcaccgccatccttcccacgctgctcttcgtcaccgacaagaaacttggtgtcctcaactacaccaaggccgacgacgggcaaacgtacttcggcgctcccggcgccccctgcgtggccaagctcgtgaaggtcggcgcagcgcggccgtactctgtgttcatcatggcgatcagcgagcccattttgccggccgcgttgccctccccgtcgcggtgccc

SEQ ID NO: 15242 - DNA, 506 bp, Zea mays
  Clone ID: cC-zmpo148024d10a1
aactaacaatgggtattgattaatttccaattgtcatgtccaaacgaatagtgtctcccattctcccctctttacatatcgaaattaacagaaaagggagaaatggcaaagcaaataaaatgaatggatcaatcgacatgttcagacccaaattaaagtacttaaatatatatataaacggaatccaaccgaatacaggcaatggcagccagcagcctctccctccgatcctcctttaattttactgcaggtagtaggcgaagaaggagagcacggaggcgcccagcacggcgccgacggccgggaacgcggccgaggaggcgctggtgggggcgggcgccggggcctcggtggcgaggaccacggtggcggaggcggcggctgcgaggacggcgcaggcgaccttcttcatctccatcgcgacttgatgtggcttgccggagccgaacggagcgtctccgggatcgagacgaggaagaacgaatggcacgcaggcttattagcaa

SEQ ID NO: 15243 - DNA, 439 bp, Zea mays
  Clone ID: cC-zmpo148024d10d1
tcgaggcaagggcgcaaccaataatagcatgtgtgatcattcgttgatccattttgcttataagcctgcgtgcccttggttcttcctcgtctcgatcccgacgacgctccgtatcggtttcggaaaaccacatcatgtcgcgatggagatgaagaaggttgcctgcgccgtcctcgccgacgtcgcctccgtcaccgtggaccttgccgtcgaggccccggtgcccgcccccaccagcgcctcttcggccgcgttcccggccgaaggcgccgtgctgggcgcctccgtgcactccttctatgcctactatctgcagacaaattaaaggaggatcggagggagaggctgctggctgccattgcctgaattcggttggactccgattatctatttatttaagccctctaatttgggtctgaacatgtttgatcgatccctt

SEQ ID NO: 15244 - DNA, 516 bp, Zea mays
  Clone ID: cC-zmpo148024d11a1
gacagatagagagttagagaccagattaatcaaatccattagttacataacggttgaccccataatgttacaagagcaaacgaagtgagcaaagcaaagaaacacttggtccctccctccccaccagacgagagcgattacagcacagccaattacgtgtccaccctaatgtctcaccgcgacacgaccatcgtcggtgagtttagtagaagaagatcatggtagcaacagcagcggcaacgccggcgatggcagctccacttccaagggcagcagcaccggcggagtcatcagcagccggtccctcagccgcaggggacgccgcggcggtggatgctggcggggaagggctcaactcctcgtccgtggaagaagagggtgtagaggcggtggctggcgcggtagctggaccagacttcctagacgacggcgatggggcagcggcggcgacggtggtggatgcggcttcgggtgcttcagcggtggcagcagttctcttggcagactcaggtgcct

SEQ ID NO: 15245 - DNA, 559 bp, Zea mays
  Clone ID: cC-zmpo148024d11d1
acccacgcgtacgcccttcgtaccatcacatccagccagtcaacaaaaatgtcgcgcgttacagctgcggtgctcttctacataccgcgccggtgctgccctcagcgcggccgaggccccggtagagtcaccgaaggaaggcagtgctgccaaggcacctgagtctgccaagagaactgctgcccccgctgaagcacccgaagccgcatccacccccgtcgccggcgctgccccatcgcctgcgtttaggaagtttggtccagctaccgagccagccaccgcctttacaccctcttcttccacggacgaggagttgagcccttccccgccagcattcaccgccggggcgtaccctgcggctgagggaaccggctgctgatgacttcgccggtgctgttgccctcggaagtggagctgccatcgccggcgtagccgctgctgttgctaccaagatcttcttttactaaactcactcgctatggtcgtgttgcggggagaacttatggtggacacgtatttggctgcgctgcaatcgttcttgcatggtggggagggaggg

SEQ ID NO: 15246 - DNA, 387 bp, Zea mays
  Clone ID: cC-zmpo148024d12a1
agagttcaaacaaactgggtttatcgatgccatcactgatacatttcttcctgatccatattgggtagaggcgtctttgacacgaatgcaattttggtgtaagatcaaaacgattacatacatgccgcaagcggatggatcaatggatcactcggaggcacggtccttgaacgattttgacttgaactggtcataaaacttggggatgaactccttcgcctgcatgtcgatggcctgtgggcaactggtggcaccggcattgccaccctcaggacccttttcctgggcgctggccatctggggcaaatcctcagcggacccctaacggttggtcatgcccaccttcttgatcttgaagcctaaccgtgcctgctacggcggcgggag

SEQ ID NO: 15247 - DNA, 524 bp, Zea mays
  Clone ID: cC-zmpo148024d12d1
cgcctatgatcgttgccgccgtagtgctggacaacaatggcgctgacgcggtctcctgcactgccatccctagcgtaacaataagtcctataggagaaagaaaatatcaatggggatgttcccacgatcacctcggccgtaagcaacgaggaggaggcgttgttcagtgtcggagaatccaccaaggacgatggccatcgcttgacgatggaatgctccactcccgtctcctccagtagcccttccactcgcaagaagcgcggggcgtttcagccttttcagggcgatgttcctgttcttcggccggagcgacgacagcatgaagaagacagacgacgacaccacgagccccaagaagagagccatcgcggctgcttgaatgacgattgcaagcctgccggtgacgagtcaacgtcctggaagcgcctcgtggacggtatgcgcccgctccggctccggggcagctggagtactacccgacgtcaccgacgtcaccgacggtgggccacgccgatgtgtaccat

SEQ ID NO: 15248 - DNA, 165 bp, Zea mays
  Clone ID: cC-zmpo148024e01a1
gttaacaaaacttcccggggaaaatgaaaataccaacgaattttttcaaatttttttatgggggggggttggattttgctgaaaaaaaagcaaataaaaaaactgggtcgggtttacacggtgtagttttgctgaatggggtcaatggcgaggcccttgagcttg

SEQ ID NO: 15249 - DNA, 279 bp, Zea mays
  Clone ID: cC-zmpo148024e01d1
agactgccttcaccaaccgtaccgactacggcatgggcgagcgagaggcgcagtgggccactgcacataggacgctgcacggcctcaaccaggccaccgtcacctccgacctttccggcgacatccagggcttccgcgagctgtaggagctagccgagcatgcggccatgcgcgccgaggtggccaggctcagggagctgctcacgctctagggacacgtctagtccttcgttaagcttaagggcctcgacattgacaccattcagcagatgctcaccg

SEQ ID NO: 15250 - DNA, 318 bp, Zea mays
  Clone ID: cC-zmpo148024e02a1
aagcagggatagcagatatcactgtccttcaaagttcgaacctccgttttagtcatgcatcagcacatagcacaagcagactaaaaaaacagggaatcaccggccaaatccagttgcattgagaccaagcagcatttttccgttttccccaaaaggaatgtatgccacatttggggagcgagccagctttgcgggaatctccttggccgcctcgatcctcctgagctccatcagccctgtcccagccattgccgtggcctcaaagatgaggcgcgcggactcgctttttcccttagtgcgcacaaaggccgcccgcct

SEQ ID NO: 15251 - DNA, 525 bp, Zea mays
  Clone ID: cC-zmpo148024e03a1
ctttttccttttttttttttttttttttcttctctctcctggtttggttcctctttctcttctctcttcttcttttctttctttttttctttgtgggaaggccgcccaaaaggccttttaaaaaaaaagaaaagggcgaacacggggccaaaaagaaaaggggaaaacctttggggggaacaaaaaaacttaccccttagaaaaaaaagaaaaagggggtgcccacaaacccggaaaaaaccttgttcatcccaatgaaaaaaccccccccaaagggaaaaaaaacggggggggggggggggaaaaaaggcccccctcgcgtggcaattttggggcccaaaaaaataaaaacacttcccgggcccaaagggggggcccaaacccgtgttccaaccccggggaaaccaacattttatgaaagggttcaacaaccccaaaaaggtatccccaaacaaaaaaccgtgcccctttttgggggggacaaccccctctttctttatgtcttatagaaccagggggggaatt

SEQ ID NO: 15252 - DNA, 531 bp, Zea mays
  Clone ID: cC-zmpo148024e03d1
tgggtcgactccacgcgtacggtcgtaccacaggtatcgtgctcgactcgggagatggtgttagccacactgtccccatctacgagggatacgccctccgccacgccatccttcgtctcgacctggctggccgcgacctcaccgactacctcatgaagatcctgactgaacgcggatactccttcatcaccactgctgagcgggaaattgtcagggacatgaaggagaagctcgcctacattgccctggactactaccaggacatggagactgccaagaccagctcttctgttgagaagagctacgagctgcctgacggacaggccatcaccataggcgctgagcgctctctgtgtcctgaggtcctctttcagccatccttcattgggatggaagctgctggtttccacgagaccacctactactccatcatgatgtgcgacgtggatattaggaagggatctgtatggcatcatcgttcttctccggtcgttccactatgttccctgtcactgctgacaggatgagcat

SEQ ID NO: 15253 - DNA, 440 bp, Zea mays
  Clone ID: cC-zmpo148024e04a1
ggaacaaaaagaggggggttttaacattgaacatcggccccgggggggtcaacttattacctgtgttatttacaaacccgggcaacttcacttttgggggggggggaaccccccttacaaaattccatgggatccccttttttttaaaagggccaagcgcgggggaaaaacccaaactcagcggtcgggggttaacccccaccccttgcagaaaacagggatgacccgttggttgcgggccaacctcaaaagaacagttttttttccccagattttcagggggagcctcctggggggccgcgcttgggagcccccagttccaaaaccccctaaatgcggttttggctcgaaactgggcccgggttttaaagcttttttcccacaatttactggccattttaagggccggggcgttgggttaaaccctctgggggggggtt

SEQ ID NO: 15254 - DNA, 588 bp, Zea mays
  Clone ID: cC-zmpo148024e04d1
tcgcgacgccgttgagggcgagagtggagtggtgatgcgggtggccgttgacgcgaatcgcgcagcggtgggtgtaggcgctcggatgcttttctacccgacgctggtgtacaacgtcgtgaggaatcggttcgagaagcacttccactggtgggatcagatcgatgagcatgtcctgcttggtgctgttccattccctagcgatgttcttcggctaaagacgcttggagtttgtggtgtggtgacacttaatgaatcattctagaggcttgttcccacatccctgtacgaggctcatggaatagaaaatctggtgctaccaacaagggattacctttatgcgccttcatttgttaacctttgtgaagctgctgactttatccacagaaactcttcatgtgggaaattgacgtatgtgcactgcaaagctggacgagggcgttgcactacagttgtcatttgctttttggtgcaatataaaattatgactcctgcttgatcttatgaacctgttcgcttgccgttggctagggaattatttgcttctgtacgtaggctagctgagcaagatttttccaactaacgggt

SEQ ID NO: 15255 - DNA, 361 bp, Zea mays
  Clone ID: cC-zmpo148024e06a1
ggggggattaaggacaaccttgtttggaacaatttataacagttctgcttacacagttacagtttttccgggagggtaacacaactccatgccaaaatcgccattgtcatgagcctcattaaacgtaacgaagggttttgggtcacttacagccagctggacaaaaaaccgagtttacggggagatagatgaaaggggggaataaccaagtcgttgagaaaaagaaaagaaaaatgggaaaccccaacttgagtgtgaaaatgggtgaatgtgtgggtgtgcgtttaaaaaataatgggggggggcccttcctcctaaggggcctttccttccccgttttgggggggggccggttccgggg

SEQ ID NO: 15256 - DNA, 560 bp, Zea mays
  Clone ID: cC-zmpo148024e06d1
cttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccggtagcttctccaagaacttcacgccaggtggcaagtcttcagacaagggtgaactgacaagggcccccagcaagctatcatctgcgttttctggtactcaggataagcgtgcagcttgccagaaaacagtgtacccgctggagaagttaactctggaaggcgagtcctaccacaagagctgcttcaagagctcgcacgggggctgcatcctcaccaccttcttctacgccgcgctcaacgtgcgttctgtactgcaagatccacttagcgcagttgttcatggagaacgggagctacagccacatgatgaatacaagcccgttccaggatacgctgccggacatggaagtcgacgtgcaaccgtcggaaccggcgccaccgcaagacggtgatagagaggacatc

SEQ ID NO: 15257 - DNA, 158 bp, Zea mays
  Clone ID: cC-zmpo148024e07a1
gttgactgatgcacgcgtcgtagctgatccttagagcggcgcctttttcttttttcttctatcccttttcttttttggtgggtgtaccgcggtttccgggggaaaattttacccccggacaaatcccggttttggatgacctctaacttactaaacat

SEQ ID NO: 15258 - DNA, 349 bp, Zea mays
  Clone ID: cC-zmpo148024e08a1
gcaccaggaaaaacagccaaaggaatgcaaatggggaaggtacaaatgtcatcctttctgttttccgacccctttgtttgcaagtttaagtcattgtacatacacacaaacatgtgtgcccccccccccaagcgtttgtgccaccttattatttatgatgggatgtttgccatgccttgcggcctttaaaacttgaaaccaattttgtgcggcgcgccggtgtacttgagccacatggcgccgcttatgaacggcccgggggtgaacggttcggcttcctttcgtccgatgacgtggaagccgggccagttgacccttttgttggggccggcgccgggcccggggttgt

SEQ ID NO: 15259 - DNA, 349 bp, Zea mays
  Clone ID: cC-zmpo148024e08d1
acgcccacgcgttcgtagatcgcgagcggaccgcccttttttttatttttttgtgtgataatatataagggggttcggttctctccaaaaacctaccaccggcaattaacaaccagcataggtatataagaatacacagtactagttcatgtttagggtctcggcatgcatgcaggtcatcacattttgggctcatattatcagcttgcgcacaaccctccctatcgattgattcccggccggttcgtgtcgatgatcagttgagggcaacattgtttgagtcctcgacctatcaccgacgtttgcttgtcctcctccttcttgccctgcaggttctggaccatttaag

SEQ ID NO: 15260 - DNA, 207 bp, Zea mays
  Clone ID: cC-zmpo148024e09a1
gtgccctcctacttattgttgcatgtcgcttgcccagatggccgggtgggggttgcgcgctttatctccttccattttctgagctagttgattctgtacgtgagtttgttcacactttttatcgtatttcttcttttatgatcaccgtcctgctgttttaatcgacctacacttctttgtgggttctatggttttgctgcgcaattt

SEQ ID NO: 15261 - DNA, 356 bp, Zea mays
  Clone ID: cC-zmpo148024e10a1
aagcatgccctttatttatcgaattaacgagacaaaaaattaccggaaaggcttatttgggtgacggtacattaattgggctgtcatatatgggtatgaagcacgtcgacgaaactattcattggggggcataaaaagggtagggatacccatgcatgcatgcctcaaaacgtcatcgcatcccatgcatgcatgtatatatgatgtatcagggattcagtggcacgcaagcaggcaaaaaacgacgaccggggggcgtgctttgcggttaggaaggaggaggggtgcaggaacttctggaggttttggtgtagaaaggctggttttccttggcgcaggtggtgttgcaggccttg

SEQ ID NO: 15262 - DNA, 483 bp, Zea mays
  Clone ID: cC-zmpo148024e12a1
aattaaaccctcgcctaattcacttacttttaatcaaaaggaaaagagagagagagagagacaagaggtaacacctgaatttggttggtatttagagaaaaaattttataccctcaaattcagggtgttacaccgtcgaacataatatagctgtcggatgtctgtcattttactgttgtgcgttaccaatggatagcatgtaatgggcaatgcaaggacgagagaaaaattataactagagagatgggtcagtcgacggagggtctagaagcatgcaagctccttgaggcaacccttggtgctgcccttggcgttcgtgcatatagccatggtcttgctgttggtgccgttatactcgacgttgacgtcatccatggtgacgccggtgcatgggaccttggcagtgcagagcaggctaacggtctccggggtggaggaggtgccggtgatgttcttgaaggtgaacgtcttgaccgtgacctt

SEQ ID NO: 15263 - DNA, 514 bp, Zea mays
  Clone ID: cC-zmpo148024e12d1
agaatattaatatggaggacttacccaaccctaactttttcgatttgaagtactgtcccaacaagttgggtactgtcaactgctcctcctaggtcaccgataaggacgttaccttcaagaacattaccggtttccttctcatcctggagggcgggagtctgttttgcactgtctaggtttccaagcaccggtgttaccatggttgactttaacgttgagtttattggcactattaactatactcatggttttatgcacgaacttcaagggcagttcctagggttgtcctaaggagcttgcatgcttttaaacctttcgtttactgacccatttctttagttataaatttttattcgtctcttgcattgaccctttacatgctatctattggtttccgcacaactgttaaatgactacattcgacagttttatttatgttaactgtgtaataccctctatttgagggtataaaatctttatttttaaataccaccaaatatcaggtgttacctta

SEQ ID NO: 15264 - DNA, 222 bp, Zea mays
  Clone ID: cC-zmpo148024f01a1
atgcaacaattcatttatcgtagttaaaaattacaaaacaatacccaaacaacaaacatagaaacaaggtaaccccgaataggatgaatcgaaaagcctaaaaaaccctaaggagagattcagagactcgtaataaggcgtagtcattgggtcccacaaccatgcatgcatgaccatattaaactcagagcgatcgtggtccgttagaaacaaaacatgggg

SEQ ID NO: 15265 - DNA, 360 bp, Zea mays
  Clone ID: cC-zmpo148024f02a1
cctctctcccttttcttttcttttttttcctctttttctttgggttggttttttttaacattttccttactctcaatatcactcccctctctaaatccttcttacctcctctaatcaccttttaaaaacccaaaaaaaaaacaggggtacaaaaaaaaaaaacccggggggaaaaaaaaggggaaaaacaaaaaaagggtctcttaaaacagggggggcccaccaaaaaagacccacccccaccaaaccgcttatcccaaaggagaaaaaaaaaagggggatgttcttggtgaaaaaaaaacgggaaatagaggtacaaaacccaaaaatataaattattcggccccccccccccccaga

SEQ ID NO: 15266 - DNA, 386 bp, Zea mays
  Clone ID: cC-zmpo148024f02d1
actagttctaagatcgcgagcggccgccaatgcagaggaaaaggtctccaccgccgccgagaccacgacgacggtggaggcgaagaagaaggacgtcgaggaggccaggaaggagaagcaggcgcagcaaagctgaccgactgtccgtgcatgcgcgtgccaactaatataattattggctgatgatacctgatgatcagtgtgtgatcgagcaaggagacgacacttgaattctctacagttggcatagcggcataggtcgggagagacactctcgactggccacaccatgtaacaaactaaccttcttcgatgtctcccattattttcctccacggagttcttctgatgaaacaacatgttctaattgggcttaaaaaaataaa

SEQ ID NO: 15267 - DNA, 297 bp, Zea mays
  Clone ID: cC-zmpo148024f03a1
aaaaacgattggttaataactgagaatttaaaatcggatccgatagacggataaagctttacatagaggaaccttatatataacggagcggacaaaaggataaaacaggatcaaggagaaagagggtaaactttaaaaaaaaaaaaaagaaaaaaaaagggaatataaaaagaaaaaataggtggggcaaaatgaaaacataaatcaaataaaaatggctagagttaatggctccagttacaaaaggaaaaatgaggttcacaaagtgaataaagaaattaaacaaaaatcgaggaa

SEQ ID NO: 15268 - DNA, 51 bp, Zea mays
  Clone ID: cC-zmpo148024f03d1
tcgaaaaaaaaaaataaaaataaaaattaataaaaaaaaaaaattaaattt

SEQ ID NO: 15269 - DNA, 460 bp, Zea mays
  Clone ID: cC-zmpo148024f04a1
gggttaaacaaaactttttaaataaaaaaatagaataggacaccataacaacatacaacagctttgccttgatcgagagcatgcatgaatcacagggggcgtcgaattaaaagaaagggagaaacaaaatgatgtggggggggggggtttggtgcatggccgctgttgttaaaattcgacacacgacaggtgggtaaatagacctaggggaatcgggtgcccaaaccaatgaaagagcgagcgggggaagcaaaatttggggggggggatgaattgatgattgacgggagcgcggggcggcctggcaaactgggcctaggcacctggtccgatccatttgttttggtgggcctaggccccgccgcggggtttgggcatggtcctcttcttttttttcccaggggcgcggccccttctggttggggggctctttggggccggacggtggggtgacccggga

SEQ ID NO: 15270 - DNA, 410 bp, Zea mays
  Clone ID: cC-zmpo148024f04d1
gcgccgaggaggccgtcatgcaggagggggcggctgccctggaggataagaagaagaggaacatggccaaactccgtggcggtgcctatgcccatcagagcacatggatcggagcatgtgcctaggcccagtctgtcaggccgtgccgtgctcctgtcatgatctattcatcttctcacccagattatgcttccctcgctcgctctctcattcgtttgtgcagctgattacgctaggactatttactcatctgtcgtgtgtcgaattttaacagcgacggccatgcaccaaatcctcaccttacacatcattttgtttcttccttactttttgattctacgacgcctgtgattcatgcatgctctcgatcgaggcaaagctgatgtatgttgttatggtgtactattcta

SEQ ID NO: 15271 - DNA, 525 bp, Zea mays
  Clone ID: cC-zmpo148024f05a1
agtcaaatagtattttcttatctatgttacagaagaaatgatggtctataagttgtcaacaccagaattcgaactgctaacatcacaactccaaagataacggtcggtacaagtgaaaaaagaatgcaagctctccttccaaataaattcatggacaagaaactcaggtcaaccaacggggccaaggttcattcttctgccgcacatcagtacaagtgcagagaccactgtggcctgcaaagtcccagcactgctctatgaagacccaagttgaaaatgctgacaaggtggttttctacaaaagcttcagaccgccagtaacatcatcaaccatatcagctggccccagaatagccatgactgtccttgaatttggagcaatctgtgttcttccagcgtctatggttatgtgagttggcagatttaaagactttgctctcccttgtaaaactagcatgtcttcctcgctttctattttcacaaccactttaacttgcccacaccgctctcacctttttagtgatt

SEQ ID NO: 15272 - DNA, 418 bp, Zea mays
  Clone ID: cC-zmpo148024f05d1
agcaagcctaatcccagaaccccacggtcgtgagaccctagctgccgtcgccgccgccgtcgccgccggtgaccggcgacggcgatctagatgggggcgtcggcctccgtgctctcgttcccaacggccgccgcgttcccagcagccgtcaccgtcgtcgccggggccgccggctgcttcgcgctcggctacctcctggccttcacccgcctcccgtgccacgccgtcggccctggctcgggagggacctccgatgacgattccgaggatgactcggatgatgattgatgacgaaaacttcggtcgcagtcgcgcggcgaagcggtcggtagggcagaagagggccgggctccggctgctctactgggtacggatcgtggtgaccaagtgcgactctgtctgggaggctgataggtcc

SEQ ID NO: 15273 - DNA, 296 bp, Zea mays
  Clone ID: cC-zmpo148024f06a1
ggcagcatctcctttgcaaaattgcataaatgagggggggggacaacaatgtataaacatatatcatgacaaaaacataccaagtattattaatcggctagcaaagggaagttaaacatactacatgaactgaattaaccagtgcgcacgactagcaaaaaaaaataacttcttttgacaacaagtttctaattaaatcataatacctgctcaccaggcgtggtcatgatttaattacaaacttgtttgtaaaagaagcctgtaagtaaaccatattgctctctcaggcgtagcgt

SEQ ID NO: 15274 - DNA, 477 bp, Zea mays
  Clone ID: cC-zmpo148024f07a1
ggatcgaatgtcacatctttatatataacaggagttctatacaaaataaataattacattataaggagacaacggtccagcaacccaaagttgactgggagacgacgacctataccactcacgaactcatcgcagcatcttccatgagcatcatcctgcagtacctggtcttgacctgggacttgagatttcaggtaccaacttgctcttcaggtgacacgtgtcctcacttggattatgcgcactggtgccctgaccacggcgcacggcggaatgccccagactacacgacgtcggcgagcaatccccatgctccacaagttctcaataccgccatgtgaggtcgcgaacgtgttccgtgtgctctggagactctcctcgaccattaaccaagcccagagtaaagctcctgacgggatgcccatgcgagcggacatacatttccccatggtgctttgaaacgacatctttttgcac

SEQ ID NO: 15275 - DNA, 215 bp, Zea mays
  Clone ID: cC-zmpo148024f07d1
gtgcaagaagatgttcgtttcaaagcaccatggggagatgtatgtccgctcgcatgggcattccgttaggagctttactctgggcttggttgatggccgaggagagtctccagagcacaccgtacacgtttgtgacctcacatggcggcattgaggacttgaggagcatggggattgcttgccgacgtcctgtattctggggtattccgccgtgc

SEQ ID NO: 15276 - DNA, 469 bp, Zea mays
  Clone ID: cC-zmpo148024f08a1
tttcttttttttctttttttttttttttttttttttttgggtttttttttttttttttttttttttttcttaaagcccaaataaaacatttggttttatcaaaaaaactcctggggggaaaatattgggagacattaaagggttcctttgtaaatgggggggcccgactaaagtgtcttcccccccctatgccaaactgggaaaaaattaagggtcggcttcttttttgatcccagtatccccccctgaacttaaggcctcattacccacctttattaattggcccccctgcccggacagttcattatttttgctgggccagcttttttctttccgggctctttggggtttttttttctcttccccccttgctgggatcctggggggggggcaaccttttccttttaatgggcctgtgtccctgttttttcccttccaacaacgggtttttaccagggttccctcctct

SEQ ID NO: 15277 - DNA, 53 bp, Zea mays
  Clone ID: cC-zmpo148024f10d1
gcaaaaggataaatatacatgccatttttggaggctataaaattatatataat

SEQ ID NO: 15278 - DNA, 485 bp, Zea mays
  Clone ID: cC-zmpo148024f11a1
aacaggaaaaaatgtttcacagtgctgatcattatgcttctattggtgaaaggaacaggagttccatgcccaacaacttctgctacaagaagaaaactggcaaaagatgatcacaaagagccctacagcctgatgctcagtcgagcaaggtcctagctctttgagaaaggggaaaagaaagagaggatggactgtaattgcatctccgaagagactgcacttaaataacaatcgactaagaggggtgagtaaactgtcggagacggtctaagaggatggctccaattgtgatggctgaaccactgaaggagccatgttctcctcagatcggctgctccagcagatgtcgctgagtgaaggtcttaggcccttgctgcagaacatctcatactccagcgtgtcgcctgccgacttcttcacctcgacgacgtgaaaggccggtgtcacctcgaagatctcggcgtcgatcgcgagctgtccctttc

SEQ ID NO: 15279 - DNA, 443 bp, Zea mays
  Clone ID: cC-zmpo148024f11d1
tcgcaacaagaagggctactacggggccaaggccgacatttggtcctgtggcgtcattctcttcgagctgctcgccggttacctcccgttccacgacgccaacctggtggagatgtaccgttagatcatcatagtcgacgtctagtacccgcagtggttctcccttgagctctggcggttgatgcccaagcttctttaaccgaacccaaacaacaggatcacgatcgagaagctggtcgagcacccctggttcaagaaggggtacaggccggccgtcatgctggcacattcgtcacggttccagcagcctcaaggatgtccaggtccccattcagcaactgccgaccacaatgacagcatcaccaagtgtggaacagttcggggacagttccttgaatccggcgagcctgaacgcgttcacattatcttccacttcatagggt

SEQ ID NO: 15280 - DNA, 498 bp, Zea mays
  Clone ID: cC-zmpo148024f12a1
gaactcccgaaatattcacaaattcccccttcgcccatttccagcgttcatgacattactagtatgtacataacctcctccgccatcaaaccaatctgaaaaccaatgggaaggcgaccaatgctaatccacatcctctattctaatgttccacggctcctccctctccggctcctgctgcgcctccgcccgcccgcctccgaacacgaggtagctgacgacgaccgcggccctgggcctccgcctttcctcctcgccgccctccgccgacgccgcgctgtcctcctcctcctccttggccggcgctggcagctcgcggcggcagacggggcagttgccgtgcacgccgagccaccgttccaggcagcgcccgtggaagcggtgcccgcacggcatctccttgccggtgcccttcaccgcgtccaggccgatggcgcactcgcccagcgcgtcctcgccctcgcccttgccctccccggccttcacctccttagcgcg

SEQ ID NO: 15281 - DNA, 451 bp, Zea mays
  Clone ID: cC-zmpo148024f12d1
cggacgcgtgggcggacgcgtgggcggttccacctcttcccttcctctcgtgctcgatccatcgccggtgcctaatccccatggcctcagcgaacaacgacaaccgcgaggcggcgggcatcctgcggctgctgatggggatggcggcggcggcgcccgcctcggcattgcctcgggggggcggcggcggcggcggcggcggcctgatggtggtgcagcacgtcatcctcgacgtcgacggggaattgttctcgggcggggactgtggcggtggcgtgccgccggcgtcgaaagccgcgatcgccgcgctgaaggaggtgaaggcctcggagggcgagggcgagggcgaggacgcgctgggcgagtgccccatctgcctggacgcggtggagggcacctggcatgagatgccgtgcgggcaccgcttccaccggcgctgcctggagcggtg

SEQ ID NO: 15282 - DNA, 346 bp, Zea mays
  Clone ID: cC-zmpo148024g01a1
ctccctctcttgggtttaatttttttacccttcccatcccttctttctatctacaacatagccgcaatccccgaaaattcccaaaaacaaagacctccccccgtccgataccaaaacgcttttatcaaaaaaaatctcctggcaagaccaaacaagccgcgagcgcgtaaggaaagcccctgcacgcaaaacgcagagcacatctggtgaaaacaccaacgatatcaacgctataaaccggaacccgcggcgaccacccgactaccatcaaaaaactgcaataccgcccgccaaagaacgcaccaaggggggaattacctgcaggactaggcgattaaaaaaagag

SEQ ID NO: 15283 - DNA, 445 bp, Zea mays
  Clone ID: cC-zmpo148024g02a1
actggaaacaccaattttctttataaattcgaaaggtcacattttttatctttgaaacacaacacaatccttaaagacatacacgatcgagattcgtacagagtacagacgttgccgaatggaaagctcacttcgaccgagtttaagtggattctgaacacaaataagccaaaacaacagcacacatgttggctgacgcacatctctgtcgcagcaataatggcacaatggtccgttaagcagccagcgtggccgtggccgtggcatcggccgggccttctgcctccggagccaccagctgggcgatgttctccacagcacatatcctgccgctggccagtccggccgtcaggtcctcgacttccattttcaccacatcacggcggttgccaatatcagctgcatacctgctcgcgcagtacaccccgacggccattaccgccat

SEQ ID NO: 15284 - DNA, 346 bp, Zea mays
  Clone ID: cC-zmpo148024g04d1
gtttcctccgtcccgcagcatctcatccccatggccaatatcaagatcgggatcaatgggttcggcaggatcggaaggctggtggccagggtggccctgcagagtgacgatgtcgagctcgtcgccgtgaacgaccccttcatcatcatcgtctactgacctacatgttcaagtacgacactgtgcacggacagtggaagcaccatgaagtcatggtgaatgactccaaaacccttctctttggtgagaaggaggttgctgtgtttggctgcaggaaccctgaggagatcccgtggggttcggctggtgctgaatatcgttgctgagtctactggtgttttcactg

SEQ ID NO: 15285 - DNA, 283 bp, Zea mays
  Clone ID: cC-zmpo148024g05a1
cattattctatttttcctgggtaggatttcattccttttttcccccatttcattctgctctcctcctccctctttatggaaaaaaaatctcccgggaggctggtaaaaaatataagggggggaacttcccatgtagtcccccaataaaaacatgttgctcataaaaaaaaacccctgtggggggaaaaaagggggagaccttaagggggataattgataatgggggggcccgtaaaaaatagtctttccccccttatccccaaatgtaagaaaatcaagagtc

SEQ ID NO: 15286 - DNA, 138 bp, Zea mays
  Clone ID: cC-zmpo148024g05d1
cgcgtcctagcacctactctttccccgccgggctacaactcagccgtctgcaaccgtctcatcaaccatgggcgcctgcgcaaccaagcccaagacgcttgaggggcaggccccatctgaggccgtcgtcttcacacc

SEQ ID NO: 15287 - DNA, 222 bp, Zea mays
  unsure at all n locations
  Clone ID: cC-zmpo148024g06a1
acgnaaaacaactgaatatattatacgtaccgtctggatctggagacatgaatttttgaacagatgaattaaatggagacatgcatgcatgaaccaacagatcggagacatgaatcaaaccccgacgggctggctggctggttgacggatgatcagcgccccattccctgcgaggccggcgggcacatggcgacgccggcggcggccctttgggcgttgaag

SEQ ID NO: 15288 - DNA, 253 bp, Zea mays
  Clone ID: cC-zmpo148024g06d1
tcgcttcaacgcccagagggccgccgccggcgtcgccatgtgcccgcctgcctcgcatgggatggggcgctgatcatccgtcgaccagccagccagcccgtcggggtttgatccatgtctccgatctgttggttcatgcatgcatggtctcattttatccatctgttcatatattcatgtctctagattcatactgtacgtataatatatttcagctgttttacgtaaaaaaaaatttctactaaatattcat

SEQ ID NO: 15289 - DNA, 490 bp, Zea mays
  Clone ID: cC-zmpo148024g08a1
ataagaaccagttcattacttcattttataggaaaaatacagaaacgggaaaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaggcgtcatcggctcgtcgtagatgccaaccacgagtgcctgccctgtctttttcacggtgatgcctcctgatcccttttgccacggatgacggcaccaggctcgccttggatgaccatg

SEQ ID NO: 15290 - DNA, 287 bp, Zea mays
  Clone ID: cC-zmpo148024g08d1
tggacctaccaagtacatggtcatccaaggcgagcctggtgccgtcatccgtggtaagaagggatcaggaggcatcaccgtgaagaagacagggcaggcactcgtggttggcatctacgacgagccgatgtctcctgggcagtgctacatggtggtggaaaggctggctgactacttgtatgaacagggtatgtaactactacttacccagctggattgcattgtgacgaagatggttttcagttttgactttcaatatttgtatccacaatgcataggcctttctt

SEQ ID NO: 15291 - DNA, 315 bp, Zea mays
  Clone ID: cC-zmpo148024g09a1
ctttttttttttttttttttgtatatcactatcactaaatgtgggggggatctctattcttttttctttcctctttttttccttatttccttagggcaagcagggggaaaattacgggtttaaaaacaaatattgttaataggtcaaagtcttttctctttttttaaaaaaaaaaagggaaaacaaggggccgatgaaccccaccttctaaaaccttaaaagtacaaatgggggggctaccccaattttacaaaatccaccttttacttaagcacttcaaaaggggagaacattttctgggtcccctgggaattt

SEQ ID NO: 15292 - DNA, 441 bp, Zea mays
  Clone ID: cC-zmpo148024g09d1
ttagtactaagatcgctatttataactaaagcggttttcaccaacacgatacatagctcggcactagggccttcttatgatatcaagtgtgcatgtgcccacaccctagggtctgaatttatattagcatgctatgagttgggctagtgatggtaatttagtccctatataaatgatagaatgctggacccggagcgttcgtacatattactactctacctgttgttcatagattgatcaaaccgtggatccacgagactgctgcacctgatgagaggctttagcttaattatggatttcataacaagcgggtgctcaactcaattgcactatttatgacttcaaacgtgcctgtcatctgaccttctggttaccttattcttctttcaagaaatgagagaacattgtaccttgagcaataagtatttgatcatcgaattt

SEQ ID NO: 15293 - DNA, 189 bp, Zea mays
  Clone ID: cC-zmpo148024g10a1
caatctaatggataatcaaatcatatatttcatcgcatgattacagaacgacttgacacatattgataaattaaatcacgtttatgttattaacacaacccgtcaccaatgcatatatattcatatcagatcacatctataataatatatggaaacagcggtgtaggtgacgttttccaatgtctacca

SEQ ID NO: 15294 - DNA, 479 bp, Zea mays
  Clone ID: cC-zmpo148024g10d1
ggagaaccagcatcctccaatatgagccatccagagaaactaataaaactctcaccgccgtcatccgagagaacaagccaaccgaccctgttcctaaggcaatccgtcgccgacgtaccaccgtcaccgtaggagcgagatggatatgaagaggatcctcttcgtcgttctcgtcgttatcgccgtctcggtcaccgtagtgctggccttcaccgaggccgctgccgtgggcgccccaactgtctccgagtcgtccgccgaggctcccgctggcgctggcgctggcgctgccgctggcgccgccgtcgtggggtcttccttcagcagtggcgcgcccgcccttgccgtcgcgcccgccgtgctttcttttttacctatctgcctactacctctactaagcgtgtgcgtgcttacgtacgcgcgcatggacgacgatggatcccttcatcgttgtcaatgtagttgcctcgttcgttttt

SEQ ID NO: 15295 - DNA, 466 bp, Zea mays
  Clone ID: cC-zmpo148024g12a1
gtacatgctgattgatgatgattaattaatatctgcatgcatgcattgtagaagcaaagaaatgggaggtagcttaggcatgcatgcatgatgcatggggccttaattaattcatccacggccacgggtcgtcggtgatgatagcttgaaccctctgagcgcggacacgccggcggcggcgcctcgctcttgtgctgcttgtggtgctgatgcaggcgcttctgctttcgctaatacagccgacgtacctaaggttgtgatcccgacttctccgtagcatgcgctggcacaggagagctggcagacgatggtccagccgttgcatgcagccaacacaaccaagcacagcagcaacgccgacgtctgctgcacctgcatcatctgcatccccgtcgtcgttgccgccatggcgccgatcttcttttaattaatttccttgcttgcagttgcagatactgagagacag

SEQ ID NO: 15296 - DNA, 521 bp, Zea mays
  Clone ID: cC-zmpo148024g12d1
cggacgcgtggggtgacgacctctcctcctcgctgtctctctgtatctgcaactgcaagcaaggaaattaattgaaagaagatcggcgccatggcggtaacgacgacggggatgcagatgatgcatgtgcagcaggcggcggcgttgctgctgtgcttggttgcgttggctgcatgcaacggttggaccatcgtctgccagctctcctgtgccagcgcatgctacggagaagtcgggatcacaaccttaggtacgtcggctgttttagcgaaagcagaagcgcctgcattagcaccacaagcagcacatgagcgaggcgccgtcgccggcgtgtccgcgctcagagggttcaagctatcattaccgacgacccgtggccgtggttgaattaattaaggcccccatgcatcatgcatgcatgcctaagcttccttccatttccttgcttctacaatgcatgcttgcccatattaattaattatcattcaatcagcttgttcatacgagccccataaaaaata

SEQ ID NO: 15297 - DNA, 243 bp, Zea mays
  Clone ID: cC-zmpo148024h01d1
cgacccacgcgttcgcccacgcgtacgccatgggccgggccgggcgttccggcttacggagagaacagaccggctcgaccgttcagcgggtgatgcgctcttgtccttaactggacgggacgtgcctacggctctgttactttgaagaaagcagagtgctcattgcatgcctattgctctggatacatgtatcatgggatatcaacatacgattgcccgtcctattgctgaatggcccttagg

SEQ ID NO: 15298 - DNA, 446 bp, Zea mays
  Clone ID: cC-zmpo148024h02a1
aacaaaaacgaaaattttttagatcttggtaccatggggcgatacagttaactaacaacctggtaaccctttggaaatcaaaccgaaagaaaaagggggggagcaagggtgttttcttgggtgagggggtgaccccacattatcaggggtttaaagacattggttttattttttttccatggtggggtccaaaaataaccgggccgacggggggggcctcaaatgggggggacaaaaacgtgatcctcattggctgacaggcctttgacaccctggggggcaggggcaaaatacggccccgtaggtccaaggggtggggccgtaaccccaggggcattgggggactttgcctcggccattggggtctcgaccatggggaaaaaaaggagaggggtaatgcaaaaacaacgcttgggcgagccatggggaccgggtttaacttttta

SEQ ID NO: 15299 - DNA, 498 bp, Zea mays
  Clone ID: cC-zmpo148024h02d1
gcacagagacaccaagcgttgaactcgcctaagcagctatcaacctaccctagaaagctagacaccgtacccatggctcgcgctagcgtcgtctttgtcattgccgctctcctcttcgtcgccatggtcgtagcaccgatggccgtagcaaagtccgtcgatgcccctgtggctgacgcgccagccgatggacctagcgggccggctgctgcacctggcccccagggtgtcgaaggcctgtcaggcaatgaggatgacgatgatgactccacctattgaggccacacacgtcggcccggttaaatttggaacaagacatggaagaaaaatgagagcaatgtctttaaaaccatgataatgtgtggtcatccactcatccatggatacatccctgctctccctcttttactttctgttagattttcaatgtgttatcatgttgttagttaactgtatcgactcatggattcaagatctaatacattatcgtaccttgta

SEQ ID NO: 15300 - DNA, 163 bp, Zea mays
  Clone ID: cC-zmpo148024h03a1
agctaaccgtttcttgccatgttcttttttttttctctcttcttcttgcagggtttgtacaaattctagatctaaccggactaaccagaaaacaaaacaaaaaaagacgaaagcatgagccacttcgccgccgccatgaagagcccccttgcggtcgccgtcg

SEQ ID NO: 15301 - DNA, 206 bp, Zea mays
  Clone ID: cC-zmpo148024h03d1
attccttggtcgactccacgcgtacgcgacggtgaccgcaagggggctcttcatggcggcggcgaagtggctcatgctttcgtctttttttgttttgttttctggttagtccggttagatctagaattagtacaaaccctgcaagatgaagatagaatttattctgatcatggtacgaaactgttatctaaaaaatatatttcaaa

SEQ ID NO: 15302 - DNA, 358 bp, Zea mays
  Clone ID: cC-zmpo148024h04a1
agggatgccgtattttttttccttttaaactggttacagatatacagatgaatttacattatgttagtacagggctgcaatcaggggggaagcaaggaacatccccaagccgctgttgggtcaccaactggtcatttgttggcgtcttggaggacggggaagtggaactcgatttgcatccgccggtgcggggcgccgccaccgatgacgccggcggggcccctttttttgatctccagcttctccctgagcgggatgggggccaaaaattttttgatgaactccctggagcacttttttccgggggcgatgacctcgtccgtgccctcagcctgtatttgggacgagccggcgaacc

SEQ ID NO: 15303 - DNA, 392 bp, Zea mays
  Clone ID: cC-zmpo148024h04d1
cgctgtccggcgccatgtcgttcgacgacatctggcgcgagatcggtgggggcgacggcgaacgcgagctcagccgcgccgacgtgtacatagtcagctggaacgaccacttcttcgtgcttatggtggagagcgactgctactacatatttgactcgctctgctagaggctttactagggctgcgactaggcctacatgctgaggttcgacggctcgtcccagatgcaggctgatggctcggacgaggtcatcgtcaccgggaaggagtgctgcatggagttcatcaagagattcttggccgtcatcccgctcagggaggagctggagatcgagagaaggggcgccggtggcgttcacggtggcggcgcgccggaccggcggttgcagatc

SEQ ID NO: 15304 - DNA, 255 bp, Zea mays
  Clone ID: cC-zmpo148024h05a1
accttactatatcttctcatatcccatcttccaacacataccccctcttaccacaaacaaacgatcccgccacctacaaaaaaaaaaaaccagtggttacaaaaacacacagaaaacaaactttttccccccacccaaaaaaaaaacgggggaccaaaaacacgaaaaaaaaaaaccacggggggggaaaaaaaaaaaaggcgggcccgcattagacccaaagaaaaccagggggggggggccccccacaaaagg

SEQ ID NO: 15305 - DNA, 265 bp, Zea mays
  Clone ID: cC-zmpo148024h07d1
gcgagcggccgctcgcgatctagaactagtgtgagttaagtaaagcatgcaagatatgtcgacagacactacatgagatgacacggttctacaactttaccggagtctctagtttgttctgcttctgcatgcctttggtcgaatgtaaacgaacgctaaggtttctgtaattttgctgctgtcgcgctggcattttggttcctgatgaaccgttactgatcttgtacaccacactaatctgtgtgagaaagaaatattgttattt

SEQ ID NO: 15306 - DNA, 420 bp, Zea mays
  Clone ID: cC-zmpo148024h08a1
ggtggcgccagcatcactgtcgtaatagggtagtggtagcaaatagatatcacggtccaatgcatgcatgtgtaatgcattgcttgggatccaacccaatctagtatagctagcataggtcggcttaaagtattgtcagcactaaagttaattatttggcggtgtaggcggtgttggccttccagttggcagggatgacatcgtcgtagacggacttggtgcctccctcggtagtgaggcggacggtgaggggtcccttaagcggtttgtcgctgtccttcctccagatggcgccccaggagtgctttagaggctcgtacgtgtcggagcccttcttcttgacgtccactgccacaatggcaccgtcgccgtcgacgtacttgaccagcagtgccaggtatgttggggccgcaccccttt

SEQ ID NO: 15307 - DNA, 258 bp, Zea mays
  Clone ID: cC-zmpo148024h10a1
ggtagtagcctcattaggcgtcttattaaaattgaatgggccttaacatattgggttcaaaaaatcacaggtgaaaagcatagggtgcgatcctcattgcagccttgatgaataggggaggaaagcggcgggccattaaccgggacaaaattttggttgggctaaagaaaaaacggcaactaaaacgggggccggaaaggctggtgggggtaacgggttccccacgggttgtacccaagcgtccgcccaacccttcgt

SEQ ID NO: 15308 - DNA, 324 bp, Zea mays
  Clone ID: cC-zmpo148024h10d1
cggacgcgtggtcggacgcgtgggtgcaagccgtgggggagccgttaccgtcgccagtctcttctgtccccgttttcgatgccgtttcttcattagcgcgaacaaagttttgtgccggtctatcggccgtcgcctttcctcccctattcatcaagactgcaataactgtcgctacctatgcttctcacctgtgattttttggacacaatatgttaaggtccattcaattctattgagacgcctgatgaggctcctagcacactaaaaaaaaatttatatatgccccaatacatcacttaatattttatttttaaactaacaatt

SEQ ID NO: 15309 - DNA, 525 bp, Zea mays
  Clone ID: cC-zmpo148024h11a1
gaaatgacgaatctagttttttcagggttctagaatcaatgataaaattctgtggggggcgtaaataataatgacatggcaggaactgtaatttgggctggaatggaatcccgtgagaagtcttgggactgcctgctaatctcgattctctctctgcagctctctcttcaccacacttctcacgcatggagttcgaggatcgctgccacaaggtccaggagcccaagttcgactgtctgctcttcggtaagccgctgctccgcttcctgcagatacgccgccgcctggcccgttgctgtctcgtttttgtatcgttctgatgtcgccttctcctccttcttcttctgcctcttcacggaatgcaagggttttctgacctgttctcgcctacagacctcgacgacaccctgtatccgctgagctccgggatcgcgggccatgtcaagatgaacattgaaggtgaggttcctcttctcctgctgttactgaccgctgcttgttttttttaccttatctgaactttca

SEQ ID NO: 15310 - DNA, 437 bp, Zea mays
  Clone ID: cC-zmpo148024h11d1
gttgggcttgcacaggacgggggtcttgggaagctcggcggcggtgccggagcgggcgaagtggccggcgatgtcgaagatctcgggctcccggtctccctgcggtgggcacggcgggttcagggtctttaagcagatgatcccctcgaagcagtcctccaggcccagcctcttcagggctctcacggcgtggaccttgtcgccgttggtgaatatttgaaacaccacaccacaccacaggttcttgagaatgtgcttgagaacagggtcgggcttgatgttgtcgtacggtagccttccgtggacgaaggcgtggtactcattcgaatcgaagctgtagtcgatcgcctggggaatccatgcatgggaacctttttagttcaccgattcactagtagaaaaaaaaactgaacaatttcagggatttggaaagactc

SEQ ID NO: 15311 - DNA, 381 bp, Zea mays
  Clone ID: cC-zmpo148024h12a1
ctatcttatatttttttttttttttattttctcttgatttttttttttttttattttggaaaccttagggacaacccggaaaagccgaaccgggacactaaggagcaaagacagtacaaaaacgaggtcgaaaaaagagtaggcctaataagggataaagcagaaaccggggaaaaatggtaaaccgataaaaaagtaccaaagcaaaagagccggaagcaaaaagggaaaaacccggagggccaaaggggggggcctacaaacaggtaaaggaaatgggaaaaatgcgcgtttcccagcgggaaaacctgaagggccaaatctccaaatgaaataggcaaagtacggggaaaggaggattgagaaaaagggcccacgggg

SEQ ID NO: 15312 - DNA, 380 bp, Zea mays
  Clone ID: cC-zmpo148027a03a1
ctattctatcccacaacacttgattgactggggttgggtttcatgctgtccccaactgtacattaataggcaacacatgaactaccctgactgacccaaaccccattaagtttacaatccgacattcacaagaggtgaaaatgcgattgcttcgtgtggcctgttcttcttccttcacctgctggcatgagaaagagggattctgacccactgcagctgcagcttaatctccccgctatccacgttcctgatgtggaggatcatgttctgcgcgaacttgccgttcctacaaaacacctggttcttgtcggagaggcaattcttggtgccttgccgtactcacaggatgatagccccgtttctaaagctcggctccgggc

SEQ ID NO: 15313 - DNA, 340 bp, Zea mays
  Clone ID: cC-zmpo148027b01a1
aatcatcatttacgtacggtataagaaaggctatgtgatcttgtcaacaaatatatatatatatttcttttaaaaaaaaagaggaccccaaaaagcttatactacattcatacaatgaatgttacacaagtgtaagagatcaaacgacaaagctcctgcttgtgctcgttttatgaagctttcttggtcttggcaatgctcaagaggttgcctaaaagcttttcttctggcttcgtcgccgcattgggtggtgctcgtttagtctggtaccacgagttaacctgcaccgagaggccatacatgctctgttacaatccctttcgcgccgttgaacccatac

SEQ ID NO: 15314 - DNA, 334 bp, Zea mays
  Clone ID: cC-zmpo148027b02a1
cctccattatccattcacatgttagggtattaatttgtaataccatttctctccactcgtttgaaaattcctcttccgtcgtgtgcgatgaaatctattcccagtccatgttcatcgtccgttcagttgatggcaacgactttgaagtcctcttctgttcaccccctagtttaaggcctcctcctcctctggggcggggctcttcttcaccttgagctcctccatcttgtctattgcggtcttgagctcctaccttctgttcacgttttctttcccattactccttgccgacccttattagcattaccatcatctccttgtcctccttctcctc

SEQ ID NO: 15315 - DNA, 326 bp, Zea mays
  Clone ID: cC-zmpo148027b03a1
tcctttttacgattacattaatacgggcccgacgtatattagagctgcgggaaggcctctatatataggagtccaactctatttagcaggatcatcagactatagatgtcccgctaaacaacttggttgaaacacaatcgaatttggaaaagcgaatgaagcggaaattaaaaagaactagtgagctacatcatcatcaaggatgacataccatgcatgcatgcaaaaggaaggtcatcattagaccaggcaagccagtgcctctatgcttcccttggcggtgcccctggcgttgctgcaaacggccatggttttgttgttctttg

SEQ ID NO: 15316 - DNA, 280 bp, Zea mays
  Clone ID: cC-zmpo148027d01a1
acaaaccccacggctgtcattatagagactgtttcattaacaaatacacatctatcctttccattcatcacatatgttgcatacattaatattaaaatctgatagcgtcatttagaggaaacatatttaataacactgtactactctttattgatgcaagcacattccttcggtgcttgattatttccgaagaatctgtactttgcattgcattccaacaaaactttaactctatctccctgtacatagatagctacatcttccgttcagcgtttatcta

SEQ ID NO: 15317 - DNA, 404 bp, Zea mays
  unsure at all n locations
  Clone ID: cC-zmpo148028a01d1
atatccaagtgcagaaaggagatggatgcggcaccatcccggctcttacaactggcaggccggccagcgcgcacgcggntagtgcccgtgcttgtgcgcgtgctccggctggttgacgacgacgaagatgttgaggacgttgtcgacgaggcggtagacgttccgctgcatgggcaagaatggggacctaatcgccgggaagtcggcgaaggcgttgtcgcagtcgctggcgctcgtgacggcggccgacagcttcgtgttcatgtcgtcggcctgggcctgggtgcccgccgccggccgcgtggcaacgatctttcgcgcctcctcgagcgtctgcacaacgttgtcgtacccgttgctgcaggctccgaggatggactccatcggccggcccttgtggtttc

SEQ ID NO: 15318 - DNA, 351 bp, Zea mays
  unsure at all n locations
  Clone ID: cC-zmpo148028a02d1
aatcgcngaatggattcaaacaggtggcgtgtgattatacaagcgttaatccctctctcagggggaagaacatcagcggctttgcataaatccgttaaattaaggagaaagagggaacaaagaaaaagaggacaaaaggtgtgtcgaatcaaaaacatgcccacgcatcggaatgcgcgcagccatgtcactctctctcccgcttcgtcttttcctcggcctccgggcgaccggccgcggccggctcactgaatgtagtatgcgaataatgaggctactgcggccccgagggcggcgccnactgcaggcgctacagcggaagagccgctggtggggcccggagccggatcc

SEQ ID NO: 15319 - DNA, 485 bp, Zea mays
  unsure at all n locations
  Clone ID: cC-zmpo148028a03d1
agaattatcttatattgnccatatgattagtgttgagcatgcaaagaacctgtgctaactatacacaactagtataaataatctgaattccaagcttggtaaataaatgaaagaaaccagaaagaaaaagggttacaaatgagagagccgaggaagatgtacagttttgcaaacaaaacttctgctgcctagaacagcgagatgtaaaactatttccttcgtagctatatttcatgaagtcgtcaaggagctaggcagtaggcaccaaagcggatggcattccatatttctttagtcgtctgaaacgtctcttaactaacaaaatcccctccttgatagttgatcatgttttcacagtttcactattaacatggctttcattctcaatttgctttccattcatttgtgtccggggccttcgatcagctgaatccatagagttaccattcagcaatcttggattttcttctttcaactgggtatct

SEQ ID NO: 15320 - DNA, 474 bp, Zea mays
  Clone ID: cC-zmpo148028a07a1
ccacgcgtccgccacgcgtccgcgacaagatggcatgcactttcaattcgatgagagccttgttcctcctgggcctcttctgcatcgtgcatggtgagaaggaagagtcaaagggcatcgatgcgaaagcgttccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaggggaaccttgcgggcagggccagctgtgtggagcagaact

SEQ ID NO: 15321 - DNA, 520 bp, Zea mays
  Clone ID: cC-zmpo148028a08a1
acgtcgtacgagaacctttctccctcctccacctttctttttttctttccacggcaaaacaccttcgccggggagaggatggcgatggcgtaccgtgtcctggaggtcaccctggtgtcggcaaatgaccttaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgagggcccgtgagctaccacgtgcgcaggccgcactctggccgcgccacggcgttctttacttttgctataagtcaccgaggtccccgccgtctcttgtgt

SEQ ID NO: 15322 - DNA, 425 bp, Zea mays
  Clone ID: cC-zmpo148028a09a1
ttcggcgagatcacgaccaaggcgaccgtggactacgagtttatctttcgcgacacctgccgcgagatcgggttcagctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctgagccacgtgctggccaccaagctgggcgcgcgcctcaccgaggtgcgcaagaacggcacctgcgcctggctgaggcccgacggcaagacccacgtgacggtggagtacgtgaacgagggcggcgccatggtgcccgtccgcgtgcacaccgtgctcatcttcac

SEQ ID NO: 15323 - DNA, 580 bp, Zea mays
  unsure at all n locations
  Clone ID: cC-zmpo148028a10a1
gcctnctccatggaccaacaannaagcctccccgaccgtttcatttattaggngcagccatgggtgccggggcagggaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaggagatatagatggagaaggagaaaccatcgctaagctaattgactgcatgtcaattggctgatgcctgatgatcaatgtgcaagaaagagatcgaccactaattggatacatgttt

SEQ ID NO: 15324 - DNA, 463 bp, Zea mays
  unsure at all n locations
  Clone ID: cC-zmpo148028a11a1
cagatncaccaaaatccgagcctagngccccaccacttttttagatttaagaagtagacaacatggcaagggatgaggtcagtggtgatgctgcagagggcgcggaagagcttgaccctgcgctcgaggagacgccgatggaggagacgatccgtgtgacgcgcgccaagctaaggaggcgcaccgccaccgaggattctgctgggaattagctgcatgccgttgttttccctgcacattgtattgatctttttccgagttttaggctcacatgttgtttgctggaatggagatatgttgttgttcacttggttcttgtgacacagagttaattatctagaaaaaaaaaaattatataaaaaacaaaaaaaaaaataaaaataaaaaaaattaaaaataatattaattaaattatatataattaatttttcttattattaatctcaataaatatttggggggg

SEQ ID NO: 15325 - DNA, 535 bp, Zea mays
  Clone ID: cC-zmpo148028a12a1
tggagtccgctgccggcgtcgccctcgaaggcgaccagcttacccctttcggccggagcctcttcatcgggggagccggcggcgagcatggcgtggcgctgggcgactacttcctcggccccagcctcgacgcctttggtacagcagctcgccgagaacgatgcggcgcggcacggaacgccgccggccaagaaggaggccgtggaggcaatgcctaccgtggaaatcgccggcggcaacgatgacgacgacgcggccagctgcccggtctgcctggaggactacgcgcccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcggcggtgatggtagggcaagctctccgggcaacgccgagctagctgaagctg

SEQ ID NO: 15326 - DNA, 407 bp, Zea mays
  Clone ID: cC-zmpo148028b01d1
aatacacttatatacatacatgagctggggtacgactacgacgaagaagaatgaacagctagcagacgtaccggcggccgattcacaagtgtacagaaaacgatcgactccactccaactatacatatcctactatggcttttgctacaacccgatggatcagaaggcatgcatgcatgtacaggcaggcatggccatggcgatgcctgcaggctgcaaacgaatttcatcagatggctgacaccttggggacggcgacggggtacctatcgatgtcctccattcaggggttgccccgcttctccttggccgggttcaccgaccggagcgccttccacacggcgctgttgcacttgaatccggagccgaggcgatctgccaggtgcggtccccctttttgatccggc

SEQ ID NO: 15327 - DNA, 432 bp, Zea mays
  unsure at all n locations
  Clone ID: cC-zmpo148028b02d1
cacaaacntaatatatttgaactcgttgaataatcgattccatcaaatgattacaccaaattaaacatgcctcctccccccaaagcatatacccgtacgcacctaattaatccgtatgccgaccctactacctacatcaacctccggtctcaccgcggcggggcgtcggcggcaccggcaccggcggcgaggactgcctcgagcgtggtgacgaccctggccatggagggccggaccttggggttctggctgaggcagtcttactctaggcgggccacgcgctgcaggcccatctttcagcagacctctcccatccgccggtccaagatccccttcaacttttttggcccgataaagatgggccgcgcccaatccaccatgctgccgtcgctggcccccgcccggtttggcttcagcgcgcgcctttccacc

SEQ ID NO: 15328 - DNA, 122 bp, Zea mays
  Clone ID: cC-zmpo148028b07a1
tagctgccttgcctgtgttatgtttatttcacttcttttttgtttatatcttgagtatatacccaggctggaggaggattacattcataatgagagacaagcgggggttacatgtttaagac

SEQ ID NO: 15329 - DNA, 394 bp, Zea mays
  Clone ID: cC-zmpo148028b08a1
aaaaaaaaaacggaaaagcccacaaccaaaataaaaaaaaaataaaaaaaaaaaaaaaaaaaaaaaaaaaaaagaagagagaaaaaaaaaaaaaataaaaaagaaaaaaaaaaaaaaaaagaaaaaaaaaaaaaaaaaaaaaaaaaaagaaaaaaaaaaaaaaagaataaagaaaaaagaaaaaaaaaaaaaaaaaaaaaaaattaggaaaaaaaaaaaaaaaaaaggaaaaaaaaaaataaaaaaaaaaaaaaataaaaaaaaaaaaaaaagggagaagaagaaaaaaaaacacaaaaacaacaaaaaaacaaaaaacaaaaaaaaaaaaaaacaaaaaaaccaaaaaacaaaaaacaaaaaaacacacaaaaaacgaaaaaaaaaaaaaaca

SEQ ID NO: 15330 - DNA, 529 bp, Zea mays
  unsure at all n locations
  Clone ID: cC-zmpo148028b09a1
tagatcggtggcgcctgcctctcgccgccgatacggngtttctcgttttctcgctccccctcgcaggtctggggggggttttagttcctccctttgcttcttggaggtgtttgttgccgtctcacccgcacttccttgaaacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacantcaatcttgtcagaccagtgagtagcatagctcatgtgaactgtggccagtgccaaacagcgttgatgtatccataccgagcaccgtcttgcaaatgtactggttgcacctcaatacaaatgttggcggggtgactcccatgataccttttgcaccaccagcactaactgcattaagtg

SEQ ID NO: 15331 - DNA, 406 bp, Zea mays
  unsure at all n locations
  Clone ID: cC-zmpo148028b10a1
agaaaccnnnnatgcaatacatacatnnatnngagcccttttccgttttgaggcccgaccggagnccacacgcacacggtgtcgatggcggccgtaataaggagccgccgccgcgtgtccgttttcttctacgttcgccctcgccgcagctgcagctgcagccgcggcgcaggcatccaataacgtcacctccgacgaggagtactgggcggagcgcgccgaggtggctcggtcgcgcaacctcgccgcctacgtcagcgaccccgtggccgccacgaaccgcttcaacgcggacgtgctgagggccacgacgcggcgggcgctggtgaggtacgaaggcccgtgcatggcgaccaaccccatcgaccggtgctggcgcttccgcgccgactgggcgacggaccgg

SEQ ID NO: 15332 - DNA, 395 bp, Zea mays
  Clone ID: cC-zmpo148028b11a1
aaaaaaaaaaaaaaaaaaaaaaaaaaaaaaaaaaaaaaatttaaatttaaaaaaaaaaaaaaaaaaaaaagacgaacgagtgaaagcaaacaaccggaaacgccccacccccagcaacacaaagggaaagaaccgcgccgcccccccaacaacgggccccactagaaaaaccccggcccgacccaaaaaaaccgcctaacaagacaacccccactagccacccagcccactacccaaaaagcccgcacccgtcaaaaccccccaacagtaccccaaaaagaaagccgaatgcaacccccccacaaaagggccatcaaacacaaaaaacgcaataatcacgcccagggcgacaaaaacaccagccagaacgcaaacaccccccccccccccctccc

SEQ ID NO: 15333 - DNA, 499 bp, Zea mays
  Clone ID: cC-zmpo148028b12a1
cctcatcgcttccctgtaatgccaccaccatcttcatttccatcgctcgcccggatcgtcagcgtgggggccgccctccgtgtcgtcatcgccgtcctcgccgtcgtctcggtctctctccggcgcgccacggcggccacggtccccaccgtcgacgaggcgtgcaagcagtacaccaagtacccggagctgtgcgtcaagtccctgtcgtccgcggcgccggaggcgaaggcgaaggcggagcggggcgggctggcggggctggccgggctggcgctggcgcaggcggcgcagtgcggcgccgagacggtggcgttcgtcaagggcctggagaaaatgccggggggcatgccgcccgtgtgcctgaacgagtgcgtggccaagttccagggcgcgctggtcgacctgcagcggtccaaggtggcggtgcagaaagccaaggacgaggccgccgtcgacacgtggctcacggcggcgaagctcgacggcgactcgtgcc

SEQ ID NO: 15334 - DNA, 332 bp, Zea mays
  unsure at all n locations
  Clone ID: cC-zmpo148028c08a1
ctaatcaaaggctcggnngcatatatncctccaatttccctttttctcccaacaaggcaacaacaatgctntggttccgttaaacaaaacccaaaaacaaaaacacactgaacccaataattctatcccacacaaacttttctttctgtccgttctatccatctttgccgtgtcttttgccatacaccatcatcacccaaaaccatttcctgcaacctgtttcattgctccaccgccgcctctgcgaccgtcgtgccccgcaccccttgccctgctgcatccgcatccgtttccttcttctaaaggaatccttctttcggcatcctgcggct

SEQ ID NO: 15335 - DNA, 321 bp, Zea mays
  Clone ID: cC-zmpo148028d01d1
aaacagagttaatttttcattaccattaatccttacccggcaaacagcgcatacattctatctttcttttaaaactgttttttcatcatcacatcaacacccatatccggtgagtttcccccaagcaatgcatacatgtgaatccaacatcgacttcgttcttcaaatccatccagcaaaaatgaaaacccccggccaaccaaaacaaaaaaaaaacctttttatcccgaaaattgcaaaacaacaatcttggccaataccgtataatatatgcccatggtgttccgcagacaactcttattataacctgccccgtgcatt

SEQ ID NO: 15336 - DNA, 294 bp, Zea mays
  Clone ID: cC-zmpo148028d02d1
ttcccctttttttttttcttttgccaagaagcactttacactcaggaatgggtcaggttacgcttacaccctatataggatccattaaattatacctagcataaacttaaatcttagatgcaaccaaactgtattatcctcttgcagcatcatgcggtaggtagtgcatgatgcataaaatctttcaacgcaaacagaagaggctgactgaaaccaaggaacagcacaacattcataaatttgacctgatcaacctgagaccctttaatcctcttgtccggcgaaaaacaacaa

SEQ ID NO: 15337 - DNA, 97 bp, Zea mays
  unsure at all n locations
  Clone ID: cC-zmpo148028d07a1
gacgcgtgntctggaaaacaaaaacaacttttttcactcatacatttttgttcaattaaaaaaaaaaaaaagaaaaagttataatttaaaaaacaaa

SEQ ID NO: 15338 - DNA, 535 bp, Zea mays
  Clone ID: cC-zmpo148028d08a1
gaaagtgaaactgaccagctttacaaaatatgcactgtgtttgggatcccctgattgcactatttggccagggggaatgaaccttcctcgttcatgcagctctaacttttttcagaatcctccaagaaacttattgggagccttattcctaatgcttcatctgaagcaatcgatttgatccagcaactttgttcctggcatcctcgaaggaggccaactgctgagcaagcattacaacatcctttcttcaatgtgtgcaattgggtaccaagacctgtacatgatgcttaccatacaaaaacaaacggacctaaagctgaaccaagattggaactgaacctgtgggatttcagcacagaacctgatgattgtgtccttgatttaactctcagtctgaagccaagtttttctggaacagaccttggttagcatgttccacgacgtacagaagaggaaattcttctgtaccccgcatttgataatacccctgtgaagtccggttttttgcctttggtgccatctgatcgttccgttg

SEQ ID NO: 15339 - DNA, 287 bp, Zea mays
  Clone ID: cC-zmpo148028d09a1
ctgcctttcctctacgcgttccttgccgccatcaccccccgcgggcggcaatcttctgcacgttctttcagggccgaaaatatggcggtcctctcaggcctcgctggcttttgcttcctatcgctataatgctcagacgtgaactgaacaaaccacaatgacactattttggtgtcagattggatttattgcctgtgacagttgagagattggagattttcatacatggctccgtttactaaagcaaggttgtcttggatattgtgtccctaaacaaggactacttg

SEQ ID NO: 15340 - DNA, 506 bp, Zea mays
  Clone ID: cC-zmpo148028d10a1
ccacgcacgattcctctcctccgcccgtcccactgatctttgctctctctctcttcctccgtggcgtggggtcggtgtcgccatcgccggccatgggttgcggtggctccaaggaggccctggccaccggcaacaccagcgccggcagcaaggtcctccggaggaagccctcctccgtctccaccggcgcaagccacacatccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggaaggcaacaacaaggtggccgtggaggaggatctgcttcctgaatccaccatggccgacgaggcgcttgctgtggaggaggggcccaacgtttgacgaaccactcaaaatcaaagacggggaggaaaagaccgttgaaagccaacacat

SEQ ID NO: 15341 - DNA, 364 bp, Zea mays
  Clone ID: cC-zmpo148028d11a1
ggacgcgtggggtggaagtggagagagtggtgcccagatctgcggtttctcgacaacggtgggtggttcatgggaaagggcggacagctagcgggcggtccggtgatcggtgtggccggtggcccgtatgattcagttagagagcgagctttttttttgatacgggggagttaaaaaatccaaaaatcttggtgtatgtacagttctgtctatgagaaatactaacgcgtcttgcagtgctgctgcctgctgcctcatccttttgagggtcgtcaaattaaatttaaaatttttctcattattctatataaaatttaattaatttttataaggtgggtgataattatatataaataattattgg

SEQ ID NO: 15342 - DNA, 501 bp, Zea mays
  Clone ID: cC-zmpo148028d12a1
ggccacccaagggcaacgactggttcgagaagcagattgcattttcgctcgacatcctgtgccctccgtggatggattggttccatggcggcctgcacctccacattgagcaccatctgttccccccccctgcctcggtgccaccttcggaaggttgcgccggcggtgcgtgacctttgcaagaagcatgggctgacctattccgcagcctccttctgggacgcaaatgtgcttacatggaagacactcagggctgccgcattgcaggccaggagcgccacaggcggcggcggcggcgctccgaagaatttggtctgggaggcattgaacacccatggatgataaacgggacgaggatatggctgaggggaaggcaacttctggtgtttcacctttgtgccgacgcgattgtctggttgcttctaatctcacttgtttagattgtattggtcattgaaccccgtccaatcgggctggaatttttgtgttgacaagtgaccg

SEQ ID NO: 15343 - DNA, 257 bp, Zea mays
  Clone ID: cC-zmpo148028e03d1
agccccccttttttttttttttctgcaatgaaaagtatgttcttaaaaacaacccactattattttcgataataaaattcagacatatctctgactgccacctaataaaaccatctcttaacccgctcaaacgctcgtctatatcccatccctttcactatcccccacccaccgctagacccagccacccatccatcctcgctccttccctcactaccgcttctcttatgtcacccgttgtggaacacttttccctt

SEQ ID NO: 15344 - DNA, 464 bp, Zea mays
  Clone ID: cC-zmpo148028e08a1
gccacgcgtccgcccacgcgtccgcgatcacgactttatggtttgcacaaacaatgcgatgagagccggggtggtcctggtcctcttctgcatcgtgcatggtgagaaggaagagtcaaagggcatcgatgccaaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccacgtggatggcaatctgctggcgaccacggacctaaaccagtaccaggaccatggtaattggatcgagaatctacccgtggataacctggtcatcaccggcaagggaaaccttgacgggcagggc

SEQ ID NO: 15345 - DNA, 157 bp, Zea mays
  Clone ID: cC-zmpo148028e09a1
gaaccccccctgtagcggcccaaaaacccccccgggcgtgggggtaccccccacacgaaccccaacacttgccaacgccccaaccccccctccattcccaatctcccctcccttcccgccccgtcgcccgctttccccccaaccccaaaacgggccc

SEQ ID NO: 15346 - DNA, 483 bp, Zea mays
  unsure at all n locations
  Clone ID: cC-zmpo148028e10a1
gctcctccnctgccncgccctcccgnctcatttgaattttttnccncggcaangccacacccagcgaggttaggcatattgagaagccttttacacagtgaacgaggcagaacctgtgaatgtgacaaaaccctttaccacacaagctgctggttctaggaggaagtggtttcgttgcatcacacgtttgcaaagaggctttggacaaaggtttagttgtctctagtcttaatacatcgggaaagccatccttaaatgaaccttgggctgacaaagttatatggaaccaaggcaacctccttgaaccatcttcatttaatgatgctatggataatgtttcttcantggtatcttgtgtcggaggttttggatcaaattcattcatgtataacattaatgggactgcaaacatcaatgccatcagggctgcagctgagaaaggtgtaaagagattctgatatttgtcagctgcaaacttttgat

SEQ ID NO: 15347 - DNA, 405 bp, Zea mays
  unsure at all n locations
  Clone ID: cC-zmpo148028e11a1
cacgcgnccgnccacgcgnccggcacggcgnttttcgcttttgccaagaagggcgaggaggagaggcngcggaaggcgggcancaccgacacgcaccncccaagggnnaagngcaagnacgacnccaaagncaccnaccacccagaaaaggggngcggccccaacnaccnggcgcagcnggncaagnacgacganggcgacggngacancgnggcagnggacgncaaggagaagggcncngacacgnacgagccccnaaagcacaccnggggcgccaccnggaggaaggacagcgacaaaccgcnnaagggaccccncaccgnccgccncactaccgagggaggcaccaagnccgncnacgacgacgncancccngccaacnggaaggccaacaccgncnacacc

SEQ ID NO: 15348 - DNA, 414 bp, Zea mays
  unsure at all n locations
  Clone ID: cC-zmpo148028e12a1
cagcgcnncaacgacggcgngcttaggttttcggcgacgcggncgcggncccgggcgcggggggcgcggggccccngcacggccaccaaccccaacgaccagngcnggcggngcccgcgagacggggcccgcgaccgcaagcgccnggccaggngcgccangggccncggccacaggaccaccggcgggcnggccggcaagnncaacgnggngacagaccccagcgacgacgccgccgaccccgncacccccaggaagggcacgccccggcacgccgngacccgggcccgggcgccgnggancaccnncccgcgcgacagggngancgagcncngccaggagccncacgngagcagcgacaagaccancgacgggcgcggagcgcacgngcacaacgngggcgcgcagaacacg

SEQ ID NO: 15349 - DNA, 451 bp, Zea mays
  Clone ID: cC-zmpo148028f02d1
cccccctctccctttttaaacccaaaaaaaaacctttcctttttaaaaacccaaaaaaaaaaacaaagggattttttaaaaaatcttttctatcctctactaaaaaaaaaaaaaccttttacttaacaataataataaatctcgtcccccaaaaatttaaaaaaccctccctttttttttcccctcccaaccaaactaaaaaacaaaaaatacccttacccctccctataaaaaattccttttccctcccactaaaataaaatgtaaaaaaaaaaacattcttcatttatataagcaccttcttttttttcacacatcataacaaaccaaaaaaaaaatttcaccccttttcctttgacattatttccccccccttctaacattcttaaaccaaaaaaaaattattttacaaaaataactataccataaaaaattttattttctcataaaa

SEQ ID NO: 15350 - DNA, 115 bp, Zea mays
  Clone ID: cC-zmpo148028f03d1
tcttttttttttatctttaaaagggacagccacccaattacattgttgatttcctttcccttctcagccacataccctgtaatccaggtgaaaaagacttcttggtttaattccc

SEQ ID NO: 15351 - DNA, 458 bp, Zea mays
  unsure at all n locations
  Clone ID: cC-zmpo148028f08a1
ggacgagggaggncaagggggaaaagcggaagcggcagttttaatttcagaggagcagcangcgcctgaggcaaggggtcgacagggcaggcggcancactcctgcctgncctgatgacggcgaggcgaagctcaacaccggagcggggggccactggtataaccgacggggacctggatgagctgaggggatccatggatctcggcttcaggttcgacgagcagaagggcggccaggacctctgcgacaccctccccgccctcgacttttatttcgccgtcaaccggcaggtgtcggagcccatgatgtcgcttcccacaagcacgagctcagggccgtctctgtctgccaccaagtccttccccaacctttgcggcacgcccagcccaagtagccctggtgcgcactctaataacgccttggagtcatggaatatttgcaacccaagagaaaaccc

SEQ ID NO: 15352 - DNA, 227 bp, Zea mays
  unsure at all n locations
  Clone ID: cC-zmpo148028f09a1
caaccaaccanccaccacgaccaagccngaaggcggcaggagcggangggaaacagcagcaccggaagaaggccgaaaacccaaagcagcacgcagacagcggagcagcccagggcacaccgaaagcaccagaaaagcggccaaacggagacagcggcacagcaagcacagagccagggccagagggaggcaaacagcaaaaggccaccgccaaacaagggcccccc

SEQ ID NO: 15353 - DNA, 536 bp, Zea mays
  unsure at all n locations
  Clone ID: cC-zmpo148028f10a1
ctcnaccaccncaacnagcnnctgcttttacgtttacgacgcgccgccacagccacatggcggaggacgccgtcgccgccggagcggccgcncgctgcgcagggccggcctcgctgnctactaacaagaaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgctccttccgtcacaagagctgctgcaaccctgcaaggaggacggtaggttcaagctcctcatgcacccggaggcccccgcgcggccgtgcggtggcggcacactgcaggaacggcaagggaaagatagctaggctctaaatcatcagctgaacagatgatttgtcgcacgcacacgttgacttgtatgggctggttgttacatgca

SEQ ID NO: 15354 - DNA, 625 bp, Zea mays
  unsure at all n locations
  Clone ID: cC-zmpo148028f11a1
gggcaagcgtnggngaagcggaaggagcatagggatgttttgtcttcgagggcgacggcntctacgggggcatagggtaagcttcgcggcacggatgacatctccacctggaggcagctgtggccaacagacgtccctgaattagcaggagccgcattccttctcacaccgagattgatccatcgctcaaatgacacgcctttctttcatcatattgaccaaattcgtcgtctctgtcgcgctgttgtaaacgggttagcagaagaacacacagggtgacaacaaatccttgttcggttatttctaatacatatggattggatgagattggaaaaaattaagaataagtttaacttgtttgcgattcaaacacatccaatctcattcaattcacatggattgagagctaaccgaacaagcctgtagttggacaaggggtgtacacttatttgtcaggcgtaccgggcacagaccgtttcctattcgtccggggggatgtaactgtaagccttgtgaccccttaacagtctgcgtcttgtgcctgctgctgtatccgtagagcagagagagagatcaaatgttaattacattttttagctccaattcacgacaaaatggttgtcct

SEQ ID NO: 15355 - DNA, 586 bp, Zea mays
  Clone ID: cC-zmpo148028f12a1
actcggcctactggcagctaactattagatttttaacgactcccccttcgatgctgccggcgcattacttttatatggcggcgctcaccacccctcatttggtccaattagttggctaaagggaatctgacatctttccactccggacaagagggcgtggcatcagccttgcagtactaacaaatttcggctcgaacgctctggtgacatttgcgttttcacccttgaaggagctcctcgggccagccaatatatttttcctgttcagcgacatagcagtgctctccctcgtttttgtgaacctcgccgttccagagaccaaaggactgagcctggatgacatcgactcgaacatcctgaaataattaaaaaccgttcgtggcatcacataccccattcggagatatgtaagaagcgatgccattttcaaaacgggcgctcgctaactcttaagaaccgagccaaagccttcaaacatgggaatacaaattcaaatgcacgtcttgatgtaaagcttgcacatttttctctaattaaccgaatgaatatttccaacatacttcgaaattacatctgcatttgaatc

SEQ ID NO: 15356 - DNA, 324 bp, Zea mays
  Clone ID: cC-zmpo148028g01d1
tttcttttttttatataagcgaaagagacacacaacaggaaagtgttaatattaaacatccattcacacatacacacacataaagaaccctttctaccttaaggacctaataccaaaaacagcattatataacaatatatacctaactcccacaatggttcaacaccacgtctcaatgtctctacccatgaatgcattagcatcttaccatcccctcttaatttacctggtcgcccgcccatatcatacactattattcctcggaaacgcaaatttaaccccaccatcttaccactaaagaacaaacgagctagggggacaaaa

SEQ ID NO: 15357 - DNA, 284 bp, Zea mays
  Clone ID: cC-zmpo148028g03d1
cccccccatttttcttttttacacccccccacccaacccccggccccagtttcttttttaaaaaaaaacccccaaaaccccaagcgtctgtaaaaaaaaaaaaacatccggtgcgccttgtgatcatccaaaaaaaaaaaaaaatcccaccccccgtataaaatatcccggggaaacttaaaaacacccgaaaaaaaaaaaggttacaaaaaagcatattaaaaataaaatatcccagttaatcaaagggttcaaaaacaaagtaaactcctttttcaaaaccc

SEQ ID NO: 15358 - DNA, 446 bp, Zea mays
  Clone ID: cC-zmpo148028g08a1
gccacgcgtcccctgtcctctgtccctctacggtgtttcttttctccggcccaaaatcgcctcatcggccacgctccctttcaggctcccgtctccacggatcccctcttaaacaggattgggagggagagccctaatgcggtggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgccccgtgtgcaccgacgaaaccagcgacatcatcacataaactaacggcgtggtatcctcctgtctcaactgcttcctagctgggggtgctctctaccgtttcgagtaccccgtcaaccccgcgctttttct

SEQ ID NO: 15359 - DNA, 503 bp, Zea mays
  Clone ID: cC-zmpo148028g10a1
gtccgaaccgtgtgccttttggagacgcgatgtcgtcctgtttactttatcagcgtggccttgctgagcggggccctgttgggcctgctcctctgccacctcgccaccaccgcctccgcccaccagaaagacatccacgttcttggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaagcgactactgttcttgccataattatatatagatacgcaaagtgtggccaagcctacccacatgcatgctattgcatgcctccgaatatataatatccgactcgatcctgccaaaatgtttcgtcgacttcattatatatattccatccct

SEQ ID NO: 15360 - DNA, 448 bp, Zea mays
  unsure at all n locations
  Clone ID: cC-zmpo148028g11a1
acccaagaaagccagacaccgtacccagagcncgcgcaagcggcgccccccccaaacccacncaccccgacgacgccaaggacggagcacccaaaggccgaggcaaagnccgctgatgccccctacgccgacgcccccacccccgctgctgacgcacctgccgatggacctagcggaccggctggtgcacctggtccccatggcgtcgagggtctatcgttcaatgaggactacaatgatgactccaccaactaaggccaagcacatccgtccacttgcattgggaacaagacattgaataaaagtgataacaatgtcctataaaaccaaaagtccataataatgtgcggtcatgcgggataagatcttgctctccctcttttctttctgattgaattcaaagggttatcatgttcttaacctataaatgtatcaatccttgatatca

SEQ ID NO: 15361 - DNA, 452 bp, Zea mays
  Clone ID: cC-zmpo148028g12a1
cccgcggccacatggacggcaagctccgctacttcttcattgtcatctcccacagggaccccgagaccccgttgaatttcgctgaatacttcaacctcacccacggggtgttcagctacaaccagatgggccgaccttgccccccgccgtgaacggtcccctccatgtcatccccaatgtcatcaccgccgagttccgcaccttcatcgacatcgtcttcgagaaccccgagaagagcatagactccctccacgtcgatggctacgccttcttcggcgtcgggatgggccccgggaagtggtcgccggaggtgaggaagacgtacaacctgctggacactgtgagcctgcacacgatccatgtgtacccgcggtcatggacggcaatcatgctgacgttcgacaacgcgggcatgtggagcgtgcattccaacaatctgggagcggtactac

SEQ ID NO: 15362 - DNA, 209 bp, Zea mays
  Clone ID: cC-zmpo148028h03d1
cataaaacagcagagcattactagggagcagaagtcttattacaaaataaaacaacaaacctcaaacgaactaaggatcatctgctccaatgttaactgacaaactccacctatatcatatcgaactcctcgccttgtggctccttctgaaccacctgttcttttccttcaatgatctcctgctcaactacttatatctgctggtcacc

SEQ ID NO: 15363 - DNA, 519 bp, Zea mays
  unsure at all n locations
  Clone ID: cC-zmpo148028h10a1
cggtgacngcncacggccccaccgaccccaactttaagatcgtgctcggcatccagaactgccggctggtgcccgattagaagctgttcccggaccgcttcaagatcccctcgtacctgggccgtctcctttagtggtttctcgcgcctctgtatcatggagagcaccatcgccgacttcgtcaagccatatgggtacatgccctgtaacggctacttcgccctcaagacgctctactacgcctagtacaacaaccgctgtcccggcgccggcaccagcaagagggtcaactggcccggctttcacgtcatctgacggaaggaggccgagccgttcaccgccgggccgttcatttacggcgccatgtggctcaagtacaccggctcgccgcacatacttggtttcaagttctaaaggccccatggcatggcatacatcacatcatatattgtgaggtggcacacacgtcttgtgcgcgcgcgcacacatgttttgtgtgtatgtacaatgactgatact

SEQ ID NO: 15364 - DNA, 81 bp, Zea mays
  unsure at all n locations
  Clone ID: cC-zmpo148028h11a1
ggccacacggccnaaaaaaaaaaaaaaaaaaaaaattttaaatttttaaaaaaaaaaaaaaaaaaaaaagaaaaaagttaa

SEQ ID NO: 15365 - DNA, 438 bp, Zea mays
  unsure at all n locations
  Clone ID: cC-zmpo148028h12a1
gcgatcgattacagcaatggcggccaaggtgttccttttccttcgactcagcatggncgccgtcgtcgtggctgccatcgtcacagtagtgctcgcgcaggaagcccatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacttgagcgtggccgtcgcctacgagaaggcctctgtcgccgtcatctcggtgactccggacaacaagctccgcgctatggcgttcgcgttcgaccgtgcggtggcgcctgacccgggccggtgccc

SEQ ID NO: 15366 - DNA, 423 bp, Zea mays
  unsure at all n locations
  Clone ID: cC-zmpo148030a05a1
cacaaaaanacnaaanaacgggcaacagtcaaattcaaaactaaaaaccccaaaaaccacaaaacaaaactgtatgttcactttattccttcacagtctccatacgccaaatctctgtttctcattcaacaaaaaaacctctaatctcatgtctatgtcttgtctatagatactatcttactctctcttcgagaacttatgtctttaaaacggtctgagttcgactaccgtgttgcggcacggagtctcaatgacatctcataacttgaccccctgaaaattggaagtgatattatatcttcagcgaaactactcatcccactttaaggtcccaaagaaactgtcaatggcttcatcatccaccccttattgcttaaactattagaaagttagaaaaaaaaaacttcacctttactctttctc

SEQ ID NO: 15367 - DNA, 384 bp, Zea mays
  unsure at all n locations
  Clone ID: cC-zmpo148030a07a1
acaaaaatttatcattttttccccacaacaacncccataagggaagaaatgtgctattttaacaacattcatttgacccacaaacataatactagaagacacagacattatttgccaacctatccaacagtataataccattaccagaagaaaaaaaaaaatactacaatgtactattacacttactctgtcccattgcacaacgtctataaagaacccaaccacttctacttattataaacttcaatcaatcacccgcaccagatcctggacgtggatgaaagcaacatacctctcaatatcaacacttaaacaaatataactaatcacgcacactaatgcttttatttcacccgaaaccaaaaaacctacatcatagattat

SEQ ID NO: 15368 - DNA, 459 bp, Zea mays
  unsure at all n locations
  Clone ID: cC-zmpo148030a08a1
ttatctcttaaatctactttttaccttttaagacncanctcctttggggcactggtcaatataaaacttttagccacatctaaaccctcacaaattggtacacacagtataatctaaacagtgcaaaaactaagacaatgtttgagttcttactagcttaaagcctttaaagcaaccattctttagaaactaccatcctgtcaactaaagtctggagctttactgctcgaaaactgctacatttacgcataacaagctgcacactgcatcaaaacatgtcacacatacttacttgaatgatgagtaaccaccttggcttgtttgcgtcacctttttacaacaatctcctattggtcttacgaatttggtggccactcctaaaccaattaaccctcaaaatctccaaaatcaagacaaataaaccaaaatggattaatcaaaagttgagtacattcacac

SEQ ID NO: 15369 - DNA, 573 bp, Zea mays
  Clone ID: cC-zmpo148030a10a1
cacctttctgaatgatctacttgtaatgtaaatcttacctgcgtttgttactttgtgatctcctgtagtatatgggggaccgggctccgcaccctggaagagataagggtgattgcagcatttccgtaattgcattgctatgttcaacagacgtttgcgttctccaccaccattaaccacttcaagatccttctgcagtaaagccttgtagtactgtttttgcatttgagacatgccaactttgagtattgtctccttttttggaggtaagcctttctctacatctgattttaacctccgaagaagaaatggtcgcagaacctacaaagatgaggtaaatgattagcataagaacttagagaataaccttgataaaatatgagtacataccttgtgaagttgttgaacaacttcttgctggtcgttttcaccagaaatttgaaaccactcgtcaaaagtttctgctgaactaaaaacctcagggagaagaaaattgagaaaggcccacaattcatggagattattctgtagtagaaacatatgaaatgaatacaatattaactcaagcaaatc

SEQ ID NO: 15370 - DNA, 522 bp, Zea mays
  Clone ID: cC-zmpo148030a11a1
gcggactacccgctgagttaagcatatcaataagcggaggaaatttactaattggattcccttagtaacggcgggcgaacggggaagagcccagcttgaaaatcggacgtcttcggcgttcgaattgtagtctggagaagcgtcctcagcgacggaccgggcctaagttccctggaaaggggcgccagagagggtgagagccccgtcgtgcccggaccctgtcgcaccacgaggcgctgtctacgagtcgggttgtttgggaatgcagccccaatcgggcggtaaattccgtccaaggctaaatacgggcgagagaccgatagcgaacaagtaccgcgaggtaaagatgaaaaggactctgaaaagagagtcaaagagtgcttgaaattgtctggagggaagcggatgggggccggcgatgcgttctgatcggatgcggaacggagcaatccggtccgccgatcgattcggtgcgtggaccgacgcggattacagtggctgcctaagcccgggcttttgata

SEQ ID NO: 15371 - DNA, 334 bp, Zea mays
  Clone ID: cC-zmpo148030a12a1
aacccacaacgctcacacacaacatagaccaatcaatcgactaatttgatcattaacttgaccaatgaacaaaaaggctccacggtaggcttttctcacagaagaacaaaaatggatggactactacaaaatcccataaccgcattaaacatcgcagcattataaactctacagataccgatgcagctattgataactatgtacacacccaactgcatgcttcatgaatactgctagaaacgcacaatctatcaccgaccgaaagcgaaacaaccatttcagataaattaccattggaagtgaaaacatatgtcagccccgtgtaacccaaaac

SEQ ID NO: 15372 - DNA, 433 bp, Zea mays
  unsure at all n locations
  Clone ID: cC-zmpo148030b05a1
acacagaataccctttttttngtaaacaaacattgcattctatatttttcaanaaaagaaaaaagnactaggaccaagagaaatctannncaacgaccattacaatggcacttcacataatataaaataaactaaaaacttccaaacaaataatttaacccaaagtcacaaaatacttcataacatgaaatttgggacgaatgcataataatgaacagtcaaacatagaataaagcaataatcagacttgttcaattcaaaaaaagaaagaaagaaaaagagagaaaagatatgagaatagtttcctcactttgccatcataactttgacaaactcttcataattgatctgaccatctccatcaaacatcagcttctttgatcatctcatcaacttcttcatcagttaacttcttaccaagatttggcattac

SEQ ID NO: 15373 - DNA, 400 bp, Zea mays
  unsure at all n locations
  Clone ID: cC-zmpo148030b06a1
cagggaaaaaaagaaatcgangcaatcaagttgtagattttatcatagaggacaccaatacggcagggaggtgcgaggaagacgaagaaaaacaccaccaaacagccgagacggaaaanagatgcatgacaccgagagtctccccgattctaaggtttccagaggaaaaatgaactgtctgaatcatatcagagagagaggattcacccgaaacgcttgccgagttcatgactgttcacttacttgcttcgacgagccttttttctccaaaaaacaaaagatgtgatccactgcacatgaaataataagacgaatcacttaatgaggattgaaagtaattcaccagataatttactacataatgaaaaacatctattaaaaacaatgttccctctaacaa

SEQ ID NO: 15374 - DNA, 367 bp, Zea mays
  unsure at all n locations
  Clone ID: cC-zmpo148030b07a1
ggctatatnncccgaacttactatcatnggttttgccttttatatccnaanaccaaaacgagaggcnnccagctgtataacaacctgttcttcgactacccaccccatcccatctgagtcccggagaaatcgatcgtagctctctgtgcccttcacttaaaaaaatatcgcttctctctagaggggaaggaaagttcatttctttttgtccaattctttcaacttctacgttccaatcccctcaattttccatttaaccgaacgcacttcgaacccttaattgctttttgcgagtcaagtttcaattcgagcgttttacggtttctcatttgaatccggcgacaagataaactcctttgggggggtt

SEQ ID NO: 15375 - DNA, 593 bp, Zea mays
  Clone ID: cC-zmpo148030b10a1
ctcaccttcgtaccgaaagaaataataaaagaaaataaacattattttataaccatttaatgatttgcattgtctttcttgtttgctgttctgatcttttgagtaatttgaaacccgaaaatggataaggtctgaaaattagctatacagaaatgctaaatgtgaaaaagggcttagctacaactagtcctattacctacaaaataaacgccttggagctttgaagaagtgtcttattcagaagtttcatcagctttaaactccataagcttcctattcaagtgtggagagcaacgggttcttgagttagtagtcatcgaggacaaaacgatactcggcttcttcttcttcttatgtgtaagatcatctacataaaactctctaattcatgaatttcctgcagttgggggatttacatagacacggcaccttgaattcatcaggttcatctggatcaaacaagtaatcgtatctgcaaaaacacacacagccatgtcatattcagtgaatcaaagggtgatacttaaattatgttcaagagagtgatgtgtatacgttaacttctcgcaggaagctacagtgttcttggcaat

SEQ ID NO: 15376 - DNA, 345 bp, Zea mays
  Clone ID: cC-zmpo148030b11a1
tctagacatctaggacctgatctaccactgtctatttctttgtgctacatttatggtaccggttgagaaatttcaaaagtttaggcccttttgcaactttatatcttcttgctagggctgtttcctgggctcgttttcatttaagcatggtgggaccactacatgacctaagctcagggttgccaatagtgggccaaaatctaatggagatgggcgggcttcgagatcaaatacctcagctttttaatttgcgagcatcgaatactaggatacactttattgaccgattgcgcatgtcttgagcttatgcttttgtggtggttcatatacaaacactccaaatgc

SEQ ID NO: 15377 - DNA, 562 bp, Zea mays
  unsure at all n locations
  Clone ID: cC-zmpo148030b12a1
atccctcgatcgctacccaagtccgaaccgaaaaagggggttccccatttactgcctagactccctcaacacccacccggtatataggttaatagcccttttccctcttggcaccaacagacattgaaatgtctgaggagacaccggtgccaaaaaaaaagaaatacttggaatttgaaaattctttttggcatgcatcataaggatactaaatcctattttctggtaaattttcataattttttgacacctctagctaggtcatttgacctgatacaacatcggattttcatggtctagttggggctccgtgggcatatttgatgcaaacttgacatcctaaactctttattgatgtattttaagagattcgatcacaaaacattgcatcatatccaatgattttcgaaagttattcggcaacatttttttttctcggacatacggccgcgctggtcgacgaatcctcggacccggtcgatgaaatctcggacctggtcgacgatttaacccctggtcgaccattccttcaacccgatagattttcatcngccattcatcg

SEQ ID NO: 15378 - DNA, 219 bp, Zea mays
  Clone ID: cC-zmpo148030c07a1
agaacaaaaaatacttcattatgttcttataacccatatagaccattttcttcaacaaggacaaatattactacaattagttcgaacattcctaaacgataacactcctacatcctatttataaatcgctttgacttttacataaacccccgccaattcatcttatacattgacatatcatcagccaaagatcgcttagaaccaataccaaattattta

SEQ ID NO: 15379 - DNA, 351 bp, Zea mays
  Clone ID: cC-zmpo148030c09a1
catatatatatctatatacacataataaaaattatacttctatatactatggagcaaaacaacaacactagagagacttgtatatctttatatagaaaaaactcacctcccaccttataaaacacacaatataactaaacaaatcataacacttctttctatacaaaaccaattcaactctatttattaaatacacagactacctagacaatactccacactttatttatatctattcctactagatatcacataccttaacccgcctaacaaaaaacacaaccaaaacatataaacttacaaaattgctgatatacttaactaaaacaccataagcaaccacatttaaaa

SEQ ID NO: 15380 - DNA, 405 bp, Zea mays
  Clone ID: cC-zmpo148030c10a1
taactatacataaaaaacagtgcttttcttttctattattttagcattttctatactataaaactcgatggggatcggggcgcattaagtccattcttccgcgattaactgtcggcaccatgtctacattctgtctctgctgaccgagaagaatggctgctccgccggaagaggattgcaccatataagcacggaagcaaacctctttccaatatataaatcttggcgacctagttgggctttcatgttgatccgaatgaatcatcctttttgcggagtgaaatctttgactgctatgcacgacgatccgatagcacgttacacattctcttttcccaggacatgtctttctattactacgaaattcataaataaaccttttgagcgtgggagtaccattctctc

SEQ ID NO: 15381 - DNA, 282 bp, Zea mays
  Clone ID: cC-zmpo148030c12a1
aaaatgaccatcacctttccacgttttggaactaaacatatgaaccagaatctaggctatctctcacaacttaggccagcacgatacatcaatcgggatacttacaactgcatgaacctatgacaacttgccttacatggagaatacctagcctcataatacattaccacatgcttcaacgcgatataacttgcaccggacttaccctaataatatacaacgcgtactagcattaccaaaacaaatccaactccacaacctgaacataagaactttactggc

SEQ ID NO: 15382 - DNA, 451 bp, Zea mays
  unsure at all n locations
  Clone ID: cC-zmpo148030d04a1
ggggnatgaggatgacctgggacgngaacnnggctgtacccttttcttcancatccttggagntaaaggcaacttgttgctttcttaacacccttcacaccaacatccttgacattgaatccaacattgtcaccgggaagtgcctcaagaagagactcgcggtgcattttaacagacttaacctcagtggtcaaccctgtgggagcaaaggtaacaaccataccaggcttgatcataccagtctcaacacgttccactggcaccgttccaataccaccaatcttgtatacatcctgaagtggaagacaaaggggcttgtctgattgcctcttgggctcgttgatctggtcaagagcctcaagaagagttggtcccttgtaccagtcaaggttgcttgacctctcaatcatgttgtctccctcgaattcagacaatggcaccaatgggattt

SEQ ID NO: 15383 - DNA, 481 bp, Zea mays
  unsure at all n locations
  Clone ID: cC-zmpo148030d05a1
atctcgttagaaaaaancagatatataaatggcttacaacacaaccccacacacaacacagtcaaatttatatttaacttactcctacaacactacctgataaaccttaacattcatttatctttaaaaacttccaggttaaaaacatcattttcaagttcttttatttctaccccaaccaaagccatatcctccactcttcgtttagtctgagattaagatgatataatatattggaaatggactcacatatcgatattgatacttattttcaactatattcctcgttacactatatacaaagaaacatcgagaatcttccttggcattataattcattctctcgttgccttaacccaaaaccaaacttaaacactatttcacatatatttttgtaaataaaaacctttgatacacattatactgcttaacaaaacttgaccactaaaggataaattaccgcacattaaaatggtgtaat

SEQ ID NO: 15384 - DNA, 358 bp, Zea mays
  unsure at all n locations
  Clone ID: cC-zmpo148030d07a1
aaagagcaaccctttgtctctgcgtcnccacttctagaattctttgcacangaacagacgtcggaggggcgtattacttaccaaacggatcctcctacatccatatataaacgctggtttatcaagaatacccaagaaaagcacttcgaatagatgattcagcgccagagatggcttataaccaatagttcattatctaatggatttttccgttctaatactccatccgagagttattagtatttatcaaatcttgttatatctaacggaacgctattgcatcgaatgacaaagaccatttttaaaaaaagatggctctctctctgatgaaatgaaaataggatttcatgtatgtaac

SEQ ID NO: 15385 - DNA, 341 bp, Zea mays
  unsure at all n locations
  Clone ID: cC-zmpo148030d08a1
cgggtaccttcatgtcaatccaatgcaacaagagatttccacatttctatccatngacatgcttcaacgggaagttgtattttttatactctttcattatcatctatcctttattttaacttttgatatgataattcttttactaaatatcttttgattgttacagaatggccaagctccttctatgtttgactctcatgtccagaatctatatggcaatttatgagtttgattaacaaaccaatccacaacataacaatgttccctaattcaaattattcatcggtagatagagcaaaccagtaacctgttatttactaattccactacattattgactt

SEQ ID NO: 15386 - DNA, 491 bp, Zea mays
  unsure at all n locations
  Clone ID: cC-zmpo148030d09a1
atatatatatctatatacacattataattattatattttggatttttcnnggaaagctaaaacatntgaaagttgtatatatatatatagaaaaatatcacctccaaccttttaatacagtcaatttaactaaacaaatctgtacatatctttctatacattgcaaagacaactctatttttaaatttcttgactatattgagaatactcgacaatagatttatttctattactaatggatttcatatattttacagtcgtcttaaagaaaatacaaccaatatatttcaacttacaaaattggtctatacttttctatatattcatagtcaactacatttaaaagtgttgactaaatngagatttctcatgatatacttaaatagttaaatttgtcaactaatttagctacaacagatacataatgatctatctgtcatatgatttccaagatttttttgtcctctaaccacctgtaattaaacatacaa

SEQ ID NO: 15387 - DNA, 545 bp, Zea mays
  unsure at all n locations
  Clone ID: cC-zmpo148030d10a1
ataagtatacagaaaagacagttcttttcttttctattactttaggattttctattctattagattagttggcgatcgtgggcgcantgagtcctttcttccgtgattaactgttggcaccagtcctacattttgtctctgcggaccgagaagaaaggaggctccgcgggaagaggattgtaccatagaagcacggaggtaaacctctttccaatatataaattctggcaatgtagttgggctttcatgttgatccgaatgaatcatctttttcgcggagtgaaatctttgcctgctaggcaagatgataggatagcaagttacaaattctgtttcggtaggacatgtatttctattactatgaaattcaataaaaaaatagttaatcggggggttaccattctctcttttttttttttcgtatctcgccatgttggccttagaaaagggaatttgtcgatttttgggcgtctaaaggggcgtggaaacacataagaactcttggatggaaatgaaaaaagatgtaacttcagttcctttgaaat

SEQ ID NO: 15388 - DNA, 300 bp, Zea mays
  unsure at all n locations
  Clone ID: cC-zmpo148030d12a1
aaaagacagaacaaannaagaaaaaagacaaacgctttttcagcattttcgaaccaaacgnnaaaccaagancaattgaaaagattttccatatggaccaccacaataaatagtacagctacctaactactcctttgagcaaaatcgtcgtaccaagccaatatattgccccaaaaatatattcttcttacaacaaaatctgacactttttaacttccttataactaactatccaaacgtaaaagtaccttcaacactatcaaattcaatcacatttcacaaactaaagcataaaacttt

SEQ ID NO: 15389 - DNA, 380 bp, Zea mays
  unsure at all n locations
  Clone ID: cC-zmpo148030e04a1
atgccaattccttaccaatatccctcaattttatttttttngcancccaaanacacgcggcaggatgaacttattcatgcgggtatgcactcttccaataagaattcattttctgaaagattctggctttcgtgctttggcggatctccaacatcctttcgacgacctatgttgtgttgaagggatatctaaatgatccgatcaattgcgtaaagcccgcagtagcaacggaaccggggaaagtatacataagtatacagaaaagacaggtcttttcttttctattatattaggactttctattctattagattaattagtgatcttggcgcagtgagtcctttcttccatgattaactgttggcaccagtcctacattt

SEQ ID NO: 15390 - DNA, 421 bp, Zea mays
  unsure at all n locations
  Clone ID: cC-zmpo148030e07a1
aatttggtaacttcaactccgntaacaactatttatgaattctttnccgganaacacccattatgcgaagtgttggatctaacaaattcattgacacaaatcgctcatgggagaaaattcagttattttggccctggcggattaacagggcgaactgctaattttcggatacgagatatacatcctatgcactatgggcgtatttgtcccattgacacgtctgaaggaatcaatgctgtacttattgcatctttatcaactcatgccaaaatttgtgattgtgggtccgtagaaagttcattttatgaactctttgagaaatcaaaaaaagcacggatacggatgctttttttatcaccaagtcaccgatgaatattatatgatagcggcaggaaaccctttggctctcaatcggagcatt

SEQ ID NO: 15391 - DNA, 487 bp, Zea mays
  unsure at all n locations
  Clone ID: cC-zmpo148030e08a1
tcgggattcacacannggctcgntcatacgtatatttttttaagtttttggatagcatctttggcgatggtgacatgtgatgtacactaaatcatggggccagttctaccaaatataaagttacatttactgcatataaagagagtcgttttgttataagatctggcgccataaaaatctgggaggctagagatgatgggatatatctcacagatgaacatcaccatgcagtgaaaatgtatggttggtaaaatcttaactttcaagctatatgttgactttaattttgatatcaatagattgcaagatataaattttaagaaaataaaatttaatatattgaattttcaaaatcgcatgcaaaagcctaaaaaaattcgttggtaatctatgtgatctgacaaattccaattcacatacatcacataacaaacacaattatttgatacactgtgaattgcctattacatacatcttttagtctacc

SEQ ID NO: 15392 - DNA, 350 bp, Zea mays
  unsure at all n locations
  Clone ID: cC-zmpo148030e09a1
ccttncaaaaccacaaacaacacacgcatttcgacttgtcaaaaccggcaaaaccgggggaacctagacgaactataanctatagctgccccacacccccttacgttccataggccaaagccattctatgtgtcgaataatctgcccaccctgcaaacatgccacccagacaatatctgcatgtttattaaaaacaacaaactattcatgaagaacaaaacaaccaacaagaaccttgaacatccttaggaacgtaggccagtcactcacaagagtactcataaccgtttgaagaacggaaccggaacagactccaatccaaagaccaacacctgccaagaaaatccaca

SEQ ID NO: 15393 - DNA, 383 bp, Zea mays
  unsure at all n locations
  Clone ID: cC-zmpo148030e10a1
agaaatataaaagaaaacaaacatgcttttaaccctttttgatccgcattgncttacgggggaccgggtctgatctctctagaaaatagaaaccctaaaacagataaggtcttaaacttagctatacataacagctaaatgcgaaaaacggctcaactacaaccagtactattacctacaaaaaaaacctcttagaactgttaatacatttgagacataccaacttcaagtattgtaaacttcataagctgcctacctaactgtacatagcaactgaacctccaaataataaacatccacgacacaaccatacacgacgtaaatgattaccataagaacttagaaaataaccttgataaaatatgaatacataccctgcgaag

SEQ ID NO: 15394 - DNA, 460 bp, Zea mays
  Clone ID: cC-zmpo148030e11a1
ggcaagagattagatgttgaatcccatgaccttgtaagtttttttttttccgagtactgataaactcaccagcaccatggctttgaaaaactttaatcttcttactaaactgagtctcgacttgtttttgaaaaaccatatacacatcacaaaaatgtgactaggacttgagaggaaatatccatgaataacgagaaaaatcatccacactaactgcataatatccgaaaccttgtaccgatacaaccggagatggaccccatacatcacaatgtaaacgatctaatggttccttaacactacaaatcgaaaaagaaaacggaagcttatcgctctttcccattatggcaaggttcacaaacagaagattgtgctgctcttattaactagaattgcctagctgttttgtaaaactcgaagaatcttgaattttgcatgaccgatccaatgatgccaaacc

SEQ ID NO: 15395 - DNA, 493 bp, Zea mays
  Clone ID: cC-zmpo148030e12a1
ggtgacctgtgtcattacgttccattattgaacaaacattcgacttatttgaaacttaaaatggaggattctacgtgaggttcctaggtatgacattactacaaaaaagaagtgttttattcactacaatgagtctacataattttattcgtcaacacaatattaaagactatgagtttgacaatattgatatttcgaatgatgtacaagcacaacatgatagagcaaaataacaatgatgatttcacaatcgtagaatcactgtaagcacgaatatatatgcagatagttactgattagattgttgaacatatatcaatattgtgaaacccaaaacgcttgtaagtgcccaatgaaggcccaaaaagaagactttcctctataattcattcgtccattactatggtcgcaagctattcacggatactattctccgtatggattacgtaaccgcttagctatctatcttttctttacacttgcataaatctta

SEQ ID NO: 15396 - DNA, 421 bp, Zea mays
  unsure at all n locations
  Clone ID: cC-zmpo148030f06a1
ccggcaatggcaacggctcctttattttttcatatttttaaaaacaacaacctnnatatgcgctgagaccgaattatatcaccttttttttatatcctaaaaacttcgattccataagacccatttggtaaaatgttctataacacattaattcctacaaacataaataaaaaaaactcttatgcatgtgtaaacgtaaaaaaatatgccctcctttaaaaaatgcatcatcgtcattccgatgtctgaaatgccaaccaatctatatatttgcatgtatataactatatgagatcatattaaagaaagagatcttctttttttaaatataaacacttctacgaataactcctaacgtaaacgataacaccaacataaattatttttatctacctacttttgaaacacataaaaggaaagt

SEQ ID NO: 15397 - DNA, 456 bp, Zea mays
  unsure at all n locations
  Clone ID: cC-zmpo148030f07a1
tggagctaatattccagagtcgaacactttaatcttttgcatgngaaacttggtttgggttcatgcgtattaaaaaacttgctggatcgattcttacatcgcattttagttgttcagacatatgggtttgaatctgatttgactattgaataccgaagatgaggaaagactttaaagacctgtcttttattcatttcccatcaattctacctgtctagactttgtaacagccgaatgtgtaaatgatctgatacgaggtgccgcaattacttgcaaaaacgagctggagaagaatcacgacgaacatctggaggtcgtggcctgtcagttacgtcaagctatgctggagggaccatctccaagcaaggctattgacatggattgcagcacgagacctggaaactctgagaatttttgtgatgaggatgacataccggatcaaaagcctttgagttt

SEQ ID NO: 15398 - DNA, 338 bp, Zea mays
  unsure at all n locations
  Clone ID: cC-zmpo148030f08a1
aaggaaaccggacaaccagaaccagcactttncaggttaaggcgcaacaacccnngaaaacgagacatagaacaaacaatccccanccaagcgcccnccccccacccatacaggcctaacgacgcttacctgaccgaaaaattacatgccccacctacaggacacaacaatgcaaagtagcaaaacgggccaaaatgacccccccaacagaacgccaattaccaaacaaccgaaacagaggcgcaaaaagcaaaaacagcaacccttcaaggaacacacgcacaaacaatatagcgactgtagacagcacaacgaccacacaggcacaagtcaacaac

SEQ ID NO: 15399 - DNA, 496 bp, Zea mays
  Clone ID: cC-zmpo148030f10a1
tggattaatcgaaaagacccaaaagtccaacattgattccttcagacgtgtcaatggtttcaaatatttcccatagtgacctaggatggtgtgctcgtagtgcgaaaattagcacgttcgccctgttaatccgccagggcccaaattactcaattttcttccatgaacgatttgtgtcaatggatttgttcgatccaaaacttgatataatgggtgtaatcccaaaaaggattcataagtagttgttaacggagttgaagttaccaaattctgaggagttggtatcaatatatgcctaattgctgcagagatagctcccttaactacattttctaaacgagccagagccaacccgagctggtctcgtataagatccgcttcagagcgaatacgtttatttttcaaatgattcatatcatgaagtgtacccattccacatttcattccaatcaaaagatcggcaggtgctaacacatctcgcggttacaaaaatata

SEQ ID NO: 15400 - DNA, 357 bp, Zea mays
  Clone ID: cC-zmpo148030f11a1
aggacctgatactaccacttggatctggatttttcatttttatgctcacaattaacaaagtggcaccaggtgatgttaggaaaactttaacacaaaatttatggcccatttcggccaactctctatcatctttctttggctgagtggcatgtatttccatggtgctcgcttttccaattatgaagcatggctgagtgatcctactcacattggacctagtgctcacgtggtttggccaatagtgggccaagaaatcctgaatggagatgtgggcccaggcttacgaaaaatacaaataacctcaagcttttttaaaacttgtcgagcattcaacataacatagagaattacaccttt

SEQ ID NO: 15401 - DNA, 468 bp, Zea mays
  Clone ID: cC-zmpo148030g05a1
acgcgttgcaattcgtaattgggatgtccttttggatagttggactcaaacgtcagggggaagaagaagctttttgaagaggtccgccacttgcccaatagtggaaatatgtttactaaaaatgagtttatcttgaacagtgtcacgcacttgatgacaatccttctcaatgtgtttagtccgctcttggaagacgggattagtcgatatgtgaatggctgattgactatcgcaaaatagaggaatatgagcagggtgatcaactccaagtgtcgttataagacctttcaaccatgtaatctctttgaatgtataagccatggcacgatactcaacctcagcggaagaagaaaatacagttttctacttctttgttttccatgaatgttaagaatcccaaccataaataatataggtagagagaacactgtgttagccgtcacgccccataatcacagtcacagtacg

SEQ ID NO: 15402 - DNA, 467 bp, Zea mays
  Clone ID: cC-zmpo148030g06a1
aagaagacaatgtccacatccgatagaagaacactttatccaagtattaagaactctcttaagacgcggaacttgggatccggtaacagcgtgattacctccgctttttccaaccatgtccactgctttatctggatctcgcttgtataacacaacctccttcgattcgcataaactttccatggaatcatccaacgcgacaatgaggtacttttgaataccaactctctttacactagcaatctgcaactccaacattggtttcacatttgaatttgcaagaaccacaatgatctctttattgacagctactttctctaaaagcttatcttatctcgggttaacagactcatcaggaacaacagttggattagttctcacactcttgacagtaccaaaagggccctgcctttattttctgatcccaaaactaagacttcgttccttgcattatctgttttctgttc

SEQ ID NO: 15403 - DNA, 473 bp, Zea mays
  Clone ID: cC-zmpo148030g08a1
aatcaaatacgaatccaaatgataagctttattcagttttccttagctatatacatccctgcaaattgtcttcattcacatatttaataaacaattacacatactcaaaacccttttacgacgtatacatattacattcttgttgataaaagaaagaaagagaaagggaattgtataatttatatactataccaagattgaagtggctgaagcaggtgcaccaaaaacaagctccgtttgcggataaatggaacgggaagaggaagaagagagacaggcgatgagagggacgaatagaatgatatttatactacaaacaagaataatagctagtaatattgtaaaattaaataccctttgaaagaagataatgaaaacgaaaggtgaggtgcatatatagaaaagtgtctttcttttcttgtggtggaataaaaaacttctcttaaaacttttattctccatcattaatattt

SEQ ID NO: 15404 - DNA, 455 bp, Zea mays
  unsure at all n locations
  Clone ID: cC-zmpo148030g09a1
catatcaaaaatatgataggnaggtttaagcatgtattttttccttatcaaacaataggaatgctggtaacacttaaatggatagtgcccccctagccattttaacaccgtcgcaatggtcttaacatatcttaacattttttcctatattaaaacatcgcattatctgttttgctgatacaagaaacccggataggcgccccacttaacatatgtccatatgccccatacatcaaccaccatacctacttttttagcaagatcatatttattcataaaacccgcatgcttgcttaccacttctttcatgctccatcctgtttttcatagagaagaagtaaactctatcgagaaatgcccatatccgaaccctttttataccacttgcccttatgaatggtctactaattcaatgatattccccaaaacatttatgcccgaaattttttcacaat

SEQ ID NO: 15405 - DNA, 455 bp, Zea mays
  unsure at all n locations
  Clone ID: cC-zmpo148030g10a1
acatgcacgancattacgattggttgaaatgttttatgttttatttttctcttatatatgttaggatgtatgtgtctaatatatataatatatatccctttggcgctaatgatcgaatctatgaccatagtatatcaaatcgagaagatgtacacatcgtgaaattttatatctcataacaacacgaatcatgattatgacttttgtatgggtaaaaattcgatgttttggtatagtttgtgtatttatattataaaatataatatagaaaaataaaagaaaaaataggaaatccacaattttccggtttagtaaagcgcttgcacaaataaaaaccgggattggcatttcagtattcgtccaaaaaagtgtagagagtgtcatctttctcggttttgcgtcgactaagcaaagccttgagcaatcgtttgctcttgatcggatgttgctgctct

SEQ ID NO: 15406 - DNA, 331 bp, Zea mays
  Clone ID: cC-zmpo148030g11a1
accaaggactatctttcattagtaccaattttgttttgaaaaccctattttggtggttaagaaattgatattgatttggggttttttgggcaggaacatcgatagatcaggggatagcgtatgttctaatgatggtggctttggcgttgacttatttcattcattgacgtgatggatccgatctatttgctcttcctccataatagtttctgtattcgtagagacgttgcgatacaatgcttttcttctggggtttgtaacgagagattcgtagaaaatcatattaaagccttggtcctcatgctgtgctctgttttagttggttgcatta

SEQ ID NO: 15407 - DNA, 454 bp, Zea mays
  Clone ID: cC-zmpo148030h05a1
cttaaccctttgaatgtcttaacgtccattattttataacatttctattgaccaatcgcttattgtttataggtattttttaaatttagaatctgcgcatatcaatacataaaaccctattcgatctctttcttctccaatctaagttgcagaaccatggccaaaactctctactgcaattttttttgatcttttcttttactttttctcttcgtaatcgctggttcgagaaatggagaatcccgtgggtttaagattcccgccgaccgacaaggacatcgtcttctattacctccgaccaaaaaactccgatagggacacgagtcatgttgatcgagtcattagcacagtcactatccgtagcttcgatccttgggagttaccttgtaagtgtttttacgagttttcctcttcaaccatcggctactttttaagtttagggtttttctctttg

SEQ ID NO: 15408 - DNA, 565 bp, Zea mays
  Clone ID: cC-zmpo148030h07a1
ccatcatctaccatcttgcaacatatattctctttttattggcaaaatccattaagcggataacgaaatattataatgtcacacacactattgattcctcgtgaacccatccatattctttgcttgaccgctttcataaacaatccaccccgaagcttttacatcatgatgtctttgtaaatttaggaaaacacacacacagttggtcaatgataatcattacagattctaaaagaatttggtagccactagtcaaagaacttaaaaggcaagatttatcgggacattaggacaaggtagatgaatgcattattagaaaataaaaaaaccctttaacattttgtttaatagaaaagaagtagaggttgattagttattgttaaaagaaaatgtgttgggcttgtcttttccttaaatgtcgcgaagcttaatggtataagcgaaagagaaagcatagcatgatgggccatatataaataaaaactccagtatgctacaaaaacaaagttcaatgcacttatatctcgttaacattttttaatttattcttttatgtgtcccccat

SEQ ID NO: 15409 - DNA, 195 bp, Zea mays
  Clone ID: cC-zmpo148030h08a1
atctaattacataataatccctcactcccttttatcaaaatctttatgattcataacctaaacatgatacttttcaaaccctaaaagctcaaaatcttctctgccctcaaaatgtcgtcttttagaatactacatcgtctctgtaatattgacaataaatttatttgactacccaaatcacctcattttgaaatt

SEQ ID NO: 15410 - DNA, 352 bp, Zea mays
  Clone ID: cC-zmpo148030h10a1
agtttttgtccgataactgctgataaaactcgcaaaatttcaacttttccgatcgccgaaaaagtcgggggaaaaggggtccggtgaaaatcccggcggccggaccatccgtcattacttgtgtcgatatccgataccatacctcgatcgctacccaagcccgtaccgataaagggggaccccaccgactggccagactccctcaacacccaccccctctatatagctcaatagccacttttccctcttggcaccaacagacattgaaatgtgtgacgagacaccggtgccgaaaaaaaataaatactctggatttgacaattcttttttgccttgcattataagcatacta

SEQ ID NO: 15411 - DNA, 421 bp, Zea mays
  unsure at all n locations
  Clone ID: cC-zmpo148030h11a1
atacccctgaatatgaaaccaaggatactgatatcttggcagcatttcgagtatttcctcaacctggagttccaccggaagaagcgggggctgcggtagctgctgaatcttctactggtacatggacaactgtgtggaccgatgggcttaccagccttgatcgttacaaaggacgatgctaccacatcgagcccgttccaagagaagaaactcaatttattgcgtatgtagcttatcccttagacctttttgaagaaggttcggttactaacatgtttacctcgattgtgggtaatgtatttgggttcaaagccctggctgctctacgtctagaggatctgcgaatccctcctgcttatactaaaactttccaaggaccacctcatggtatccaagttgnaagagataaattgaacaagta

SEQ ID NO: 15412 - DNA, 354 bp, Zea mays
  Clone ID: cC-zmpo148030h12a1
attcgcacctgaatatcactttgtgatgttcttcaaccgcctgatgcttcatttctagttgtattctgctctacagagtcgaggaagggttttcttctggctgtaaccattgtgtacgtatactcctagatacacagtagatatgaagtcggtactgagaaaggtataactgaaatggtttaattatatgcagattcaagagaccgggtgcctaaaataagattactttaagttcaggtctttctggaccagtatagagatccacggtctcgctttttcttttgagcttggataaaggtacctaaattgggggaagatttaacacgccagagagtctttgatcaaaaaggaaac

SEQ ID NO: 15413 - DNA, 517 bp, Zea mays
  Clone ID: cC-zmpo148031a10d1
gcgctggctcaggacgatagccgaggaattcgaaggacctaactataagctcctgcgtggcgtcaacgtctacgctagggttccagctagccaccacacgcgtacccccttaaatgccggcggcggcggccatgacgactaggcgggtggtgctggaggtgctaccgtcggccttccgcgacgccttccaggtggccttctccttcgcggcgaggccgcccgtgtccaccatgctcaagccggccatcaccaagcccctctaccaccaccaccacgacaacgactaatctggcgcatatctacagcacggccgtctgcatgccttcacactttcacaaccccgtgggtgtgccgactaatatatttcgtcccaattgatgacgtactaacacatttcggtcctactactcttagtaggcaacgcaaaagaaaatgctttaagattgagcctgataacttgaattaccactggaaattgataccactgatcgacttttagagagcatgcttttgtacc

SEQ ID NO: 15414 - DNA, 476 bp, Zea mays
  unsure at all n locations
  Clone ID: cC-zmpo148031a11d1
ggccgccaagaagnacnngcaggactccaanaacacnacggacaagtttttttttttcgcccaccgagaacccaccgccgcaagccatggtttacttatacccgccgcaacaatatctcttccccgtacgcgtcgtacccgtggtagccttaccgttacccctttttctccaccgtacgggtacaatgctgttttcccacaaccggcgatgtacaactacgcatcacagccgttagctacaccggccatgcatggcggacgtatggggatggggctcggcctatggctcctacgcagtgccgtcggcgggatgatgctcggagaggccatcgatgactattaaaccgacgcctcttattattccgcgttcaaccatgcattggcattctatatctatgttgtcttgcactcatggagattatctgcctttgaaattcttaattaatacgaaactatgaaatacaatttgcattttg

SEQ ID NO: 15415 - DNA, 512 bp, Zea mays
  unsure at all n locations
  Clone ID: cC-zmpo148031a12d1
ggcaggaggagncctggctcgaggagtacagcagaaacgagaacagatttttctttctgcaaagggacgcacctcgtgctcaaggaaggggataaagcccgctcccttgtcggcaaactgccggcaatggcggaagctctggtggcgaaggttgttgcttgggagaaggagagaggcgccaggttcgagtacgacggtgaggtgctgctggacctgctggaggactacggcaacgcgaggaaggagaaggagcaggagcggaagcggcagcgggaccagcggcggcaggtgcagggcgcagcggcggcggaccgggacttgtcgtcgccggtggcccgcccaccacccaaggccatcaagaacgtcacgaggtctctgtccatagggcgcaacgccgccgtcgtcgtcgacaccgatggcggtggcagccccaggaaggcggtgccggcgtcttccaagcccggcacgcccaacttcctcaagtcgcccttgtcggcgccccggggcggggg

SEQ ID NO: 15416 - DNA, 607 bp, Zea mays
  unsure at all n locations
  Clone ID: cC-zmpo148031b11d1
gcgggcggnccaacaggcacttcaccgaccacgaccacgtgattttttttttcgccagcaacgacagcccgcaggaggcgagtattcatgtcacgttggcgttcaaccacttccgccgttggctggtgcaactgatgccgttcttcctcttacgtttctttcacttggtgaacaacgactacacgcactgcatcatgtacgccatctgcggcaacatgaaccccaccatcatcagccagggcaaccgcttcatcgcccccgacgaccccaacgccaaggaggtgaccaagcgggagtacacgccgtacaaggactacaaggagtgtgtgtggaagtcttatttcgacgtcatgatgaacggcgccttctttcaacgagttctgcggccataacgagcgcatgtactacaggttctactatatcccggccaagcacggttcgttacgttggtcagcttacgcgctttcccggaccacttaagtgcttnttctgtcaaccctgctaatatacagcggtccggtctggcacatactcctctttctattacattggatttggatgggcggcatattattacgtgtgtgtataatatattactacattttgt

SEQ ID NO: 15417 - DNA, 563 bp, Zea mays
  Clone ID: cC-zmpo148031b12d1
ggggcgacgatggcccggccgcccctcctcctcaccttttttcttttcgcggcggccgtgctgaccacggcgcgcgggggttcgctctccaagtcgaagctcgccaagaacagcgactacttcgtgaacgggccccttctgaccgagaaaatcccagcgaagaagacgctcatcgtggtgcctgacgatgagttcaagaccgtgcagtccgccatcgacgcggtgcccgccggtaacgccgagtgggtcatcgtccacctccgctctggcctgcacaggggcaaagttgtgataccggagaacaagcccttcatcttcgtgaggggcaacggcaaaggccggaccttcatctcccacgagtccgcctcttccgacaacgccgagtccgccgcgttcaccgtgaaactctgacaacgtcatcctcttcggcgtcagcttcaggaacagcgcccgcgtcggcctggtgaacgaaccggagatccgttccgtggcggcgattgtggtcggcgacaaggtggcctttctccactgctcgttctacagcccccaccacacccttgttt

SEQ ID NO: 15418 - DNA, 443 bp, Zea mays
  Clone ID: cC-zmpo148031c12d1
gaccacctttaccaccgaagagagaaacgcgagcaaccagcgatcgccttattttcgccatggctcgttccgtctccctcgtcgtggcgcccctgctcctcctctccctcctcgtctccgccgcggccagcgcgcggaccgtgggcgacacccggcaagaaccgtgcagcaagacccacttccccaagatctgcgtggacagcctcgccgccaagccggatagccagattgctactccgcgcaagctggcggagctgttcgtgaacatcgcggccgagaaggggtccgggatggccaccttcgtgcaccgcaagtacagcgacaaggaggacagcgacatgttcaggtgctacgacagctgctccgacgacgtggaggaggccgtcgcccacctcaacggcctcgtccgggagcccaccgacgccaagttcctcgagctcaag

SEQ ID NO: 15419 - DNA, 75 bp, Zea mays
  Clone ID: cC-zmpo148031d11d1
aaaaaaaaaaaaaaaaaaaaaaaaaaaaaaaaaaaaaaaaaaaatttttgtttttccccccaaaacgacccaaac

SEQ ID NO: 15420 - DNA, 555 bp, Zea mays
  unsure at all n locations
  Clone ID: cC-zmpo148031d12d1
acacaagaggcgttcatcacaatgtccattgttgtttcngcgggccgcctgctgtggcagaggggtgtccctgcggccgcggcggccggccgggcggtaggggcccgtcgtgccgcgggtccttgacataccccattgggcccagggcacggcaagtcgacagcaccccgatgatccttattctttttttaacgcgtgcgaggcgacgggggtacaaaacatcgtcatcccgccgggcaactacctgacgggcgggctggagctgaagggcccctgcaagtcctccatcatcatccgtctcgacggcaacctgctcggcaaccggcgacctcagcgcgtaccaaaggaactggatcgagatcgagaacgtcgagaacctgtccatcaacggtcacggcaccatcgacgggcagggagccctggtgtggagcaagaaccagtgccagcattcttacaattgcaagaacctcccgaatagccttgtgctggattttgtgacgaacgtccacatccgcggctttacgctgcttaacaacaagttcttccaacctaaca

SEQ ID NO: 15421 - DNA, 408 bp, Zea mays
  unsure at all n locations
  Clone ID: cC-zmpo148031e10d1
acagagcaactccaacccccccanatttcgttttttcatcaccgacgactgcccaaacgagaaacgtgtttcatgttttgatgcgctgcagccccccacacttgtcttttctccctccaccgaaacattttatttccaatagctattcacttttttggagctttccctttccacggtggctgtagctacttattcatatatgcaaacgccttcaacggcttgacatgaatcgtcctctgacattgcttaagaactgcctctacataggcaagaacttccatctcatgcaacacatcccccacgtgcgcatcataagcttctatttctatatatactctctcttataacaggaaccgacgcatctactatacttatgcacagtcataagaatgaattcatttcttaaaa

SEQ ID NO: 15422 - DNA, 540 bp, Zea mays
  unsure at all n locations
  Clone ID: cC-zmpo148031e11d1
gagaatggcnaggtcatggcaattctggacatanccagtttttttttatgctattgcacggatggaaaggggggggggaaatggataagcaattgccgctgccgtccacgcccttgaaaagcattggggagcagctgtgcctggtcctaacaattttattgagacgcttttaaaacggatgtttaggccatcgctgtctactattatctctgagaatccaaagtagagttgtcactgttgcaccatcagacatggtgttgacagcatcaaagaagatgctggaattaaaagtgagttcagcacttgtagcaattgaaaacaaacctggaggaattctgacatctatagatatattgatgcgcgttatcgcccaaaatcttcctcctgagtccaccacggtcgagaaggtcatgactcagaatcctgaatgtgccacagtggacaccccaattcttgatgctcttcacacaatgcatgatgggaaatttttacatttgcctgtcctggacagggatggaaatgttgtacctgttgtgatgt

SEQ ID NO: 15423 - DNA, 413 bp, Zea mays
  unsure at all n locations
  Clone ID: cC-zmpo148031e12d1
aaaaaannanaaaaaaaaaaaaaaaaaaaaaaaaaaaagaaaaaagaaaaaaaaaaaagaaaagaaagaaanaaagaaaaaaaaaaaaaaanaaagaaaaagaaaacaaaaaaaagaaanaaaaaaacaaaaaaaaaaaaaaaaaaaaaagaaaaaaaaaaaaaaaaaaagnaaaaaaaagaaaaaaagaaaaaaaaaaaaaaaaaaaaagaaaaaaaacaaaaaaaaaaacaacaacaaaaaaaaacaacaaaaaaaaaaancaaccaaaacacaaacaaaaaaagacaagaaaaaaaaaaaccaacaaaaaaaaaaaacaccccacaacacacagaacaaaaacacaaaaaaaacacaacaaacacaaacaaacaaaaccaaaacaaacacaccaacaaccacacaacaaa

SEQ ID NO: 15424 - DNA, 635 bp, Zea mays
  Clone ID: cC-zmpo148031f11d1
cggctcccttctggccgtggccatcgcgctgttcctgtccttttttttcggcgtgcgcgccgccggcgccggcggcgggggggacatcaaggtgtcgtgtgcagcgacccccgacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgctggaccacctggacgacaccgagggcggcctcgacgacggcaagctccacgacgtgaagctgttcctggacacggcggaggaggacacgtggtcctgcgacgtctgctgcaagcacgccccatccacgcccgtcaaaaccacgctgctcgccaagaacaaggacttcgaggcgctcatgcgcgttgcccacgcgctcattaagcggcccacccgtggcgccggtgacgcgccggtgccggggcccgccgccccgccaagattcattaattgattataattcgttgataatccggggagcgcatacatatctcgaccatattgat

SEQ ID NO: 15425 - DNA, 382 bp, Zea mays
  Clone ID: cC-zmpo148031f12d1
gaaggacgatgaggaggtggaatcgcccaagaaagaagcggttttgttgtcggcgccggcgccggaggccatcggggccggagctgctttggaagacgtggtggcggacaacttcgtgacggttgtgaaggatgccatcaagaagcatgatgccgttgatgaccagatggaggaggcattgcggaggttccagggcattcgcgtgatgacggcgttggaggcgcgagcggagtcggagcagccgcgtcgccgagaggtggcgcggagcaacgacgtgatcgatgaggcgcgcacgaagctgctggagaagcgtcttagcaaggtcattgcgctcgtcggcgccttcgagactgtcatcgacaccaagaatgacatctactac

SEQ ID NO: 15426 - DNA, 562 bp, Zea mays
  Clone ID: cC-zmpo148031g10d1
gacggaatcgttggagaagctgcagtgccagacgctgatttttgttgtttataactcacagttctatgctgacgctgtggacgtgaccacaaagctagaccggagatactacgccctagtcgaggttcaggcatgtggttcacttgtcacagaagagcaaccccatgcgaaggtgatcccgatggagtacttccttatgggatactttctttacaggccatcgcagcaggaaagcagcccccggagcacactgagcccgttctgcatctcgcccgagcttctgtcgccggagagcatgggagtgaagctgaagcccatcaagacgcgcatctcacgtaacgtttagtgtggggtggatctcggttggccatggcatattggcatggcaaccacaactcatcaaagtgaaggactcccttgggctgagctgtgcaaccacgaagttttgatgcctttcgggcatctagcgtgagaagatttacagggtgaaggcaatttttgtcgattcagggaggttgtagataatgagggggaatggttgcttgttcatatacatatatgt

SEQ ID NO: 15427 - DNA, 476 bp, Zea mays
  unsure at all n locations
  Clone ID: cC-zmpo148031g11d1
ggaacctnctcgcctcctccattgaccaacaattaagcctccttttcttttcatctattaggtgcagccatgggtgcgtgggcactaatcctaagacgcttgaggggaaagccccacctgaggccaccatctccacacccaaggttgcacctgataccactaccatccacattgaggttgcggcaaaacatgcagtagttgagaaggtggaggaggacatggaggaggcactaacagtggcggcgaaacaagagccagcagccaccattgagcctcagcagattgctagtgaggtgaccacttcggaagtggcggtcgtcgttgtctagcctgagaacaaataggaagatgaagttgtggagaagaccgtcatttaaaatgagaagccatcatcagtccatgcagaggaaaatattgccaccaacaaggtggcatccgagcccacgacagacttgaagaaagacaccgatgaggat

SEQ ID NO: 15428 - DNA, 480 bp, Zea mays
  Clone ID: cC-zmpo148031h10d1
ctcattctgcagctctccacgcttgactccattttatctcgcgtgccccctctctgctcacatgcgaaagccgacaatcactacacccgcaccgcgctcctccaccccccatatacctcctttctcgctaaccatcgtcaaccaattttcggaagaactgtgacggaatcctgtcgccagctctgatcgagcgccaccgtaagctgtacatctgcctggagaatttcctgcccaacacataattctccctaggacacgcctcatctaaaaagcaagtcaataccttcaatctcaagtgccacgagaacagcatgtgcttcttgaccaaccacaacgcgacgaacatgatctgatctaaggaccgccactcagatgacatttgtgccaacgatccttaggacaattcatatcaatcattttatcttgtaataagcctcacgctaccgaataaatactctgatcacttagaacatttatctc

SEQ ID NO: 15429 - DNA, 359 bp, Zea mays
  Clone ID: cC-zmpo148031h11d1
ccgcggacggatctggaaagagcagcacacaccagacggcgcatgttcttctaatctgtgcagctaattaagcaatcttgaacagacaccttgcctgtccttctttctctttctaattaatcgtggtggtggtgctcaaagggattatttattacctaattattaaggaggacgtaggatgctcgcgtaaatgaaactgcgtatattatatggatggcatggcatccctggccttaaatcatgtcacagcacagtactgtactgtacctacgggtggccggctgatcaaaagatctttgcttgctgacaaaaaaaaaaaatttataataaaatatattaaaatcaaattaattaaaata

SEQ ID NO: 15430 - DNA, 52 bp, Zea mays
  unsure at all n locations
  Clone ID: cC-zmpo148031h12d1
gaaaaggnnaaatatacatgccattcttggaggcattcccctcttttttttt

SEQ ID NO: 15431 - DNA, 258 bp, Zea mays
  Clone ID: cC-zmpo148032a10d1
tgaacatctgttttctttttcatatgttttgctgtgggagaaatactgtcgatgcaattctgcaaaagttctaggctaagaatttgtaaaatgctctgggtttttgtcaaatgcttagtttcttctgcctcattttacttttcgtggcgtgaatgcagatatcttcatagggttttgagctgtcttaattcttttctgcaggcattttctcaaatgcgcctgtctgaagcttcaccacatctggcttctttttggggt

SEQ ID NO: 15432 - DNA, 224 bp, Zea mays
  unsure at all n locations
  Clone ID: cC-zmpo148032b07d1
taattaacgtagattccaatgctaaaacattttcactcatatattacgaaccctcaaacccattttttcgcctcgactatttcaagtcctggtctcggaatcctccacnatttccgcaacaatcaccagttttcatattctatttacttggcatgcctttgttacattttacacttttctatcttcttttctcaacgttttctctctttttcaatttttttttt

SEQ ID NO: 15433 - DNA, 354 bp, Zea mays
  Clone ID: cC-zmpo148032b09d1
gggaaccactacatctgtttgtgtaactctgttctcactgctaacaggacatcagaatctttcttaccaatctgcctaccaagatacaacgctcaggcctttttgcatgcctatgtccacttctttgatgtgagtcaaatacttgtaaagagcttcttaaattcatccacagtgcacaatgtgaaatattaacttactcgatggtgtaggatgatacatatgtaatattgcttaccacacgttcagatgcgttccatcatctcaaagattgcaggtaataaaagctatatcatacttgaaggtactcgtgttttttacatgagaaaatgcttaaaataagcatgttattgattt

SEQ ID NO: 15434 - DNA, 189 bp, Zea mays
  unsure at all n locations
  Clone ID: cC-zmpo148032c07d1
tacgagttcttcgacggctggggcgaggacatctccggctgccgcagttatttttacctccccaagaacgcacacgtcggccgggctgactctataagagccggcccgtcccacccacngntaccttatctatttttttcaaacttccctacatgctctacatttttctctaattataactttttctaa

SEQ ID NO: 15435 - DNA, 193 bp, Zea mays
  Clone ID: cC-zmpo148032c08d1
tttatacactaataaatttaagtgcgaacatctaacggctcgactccctagcgttaggagacgtactacagcagggttctttaaaaaaaaactcagactctcctccacccatttatcttcatttcttacactaaactctatatattaaaacacataattcatcataacacattttccaatttattcattttta

SEQ ID NO: 15436 - DNA, 178 bp, Zea mays
  unsure at all n locations
  Clone ID: cC-zmpo148032c09d1
atgatcgagtctaggcaacactaaccaagtgacaggtccctatttttgatggatctgctatagaatgggtcgatgcgatacaaggggtgggataaacgcggctcaaaaccatgatggtgaaagtgtagagaagatggtcncacatgtgaacaagcctgtgtatgtttgcaagaactat

SEQ ID NO: 15437 - DNA, 227 bp, Zea mays
  Clone ID: cC-zmpo148032c10d1
cggaaccatcccactctcgatcgaagaaatcgcaacgttccatgaatgctaaagccttgtctctgtttatgcctgagacagagcaagagattggctccgatcaagctccgatctcgtgcaaccgcgtctaactccgaccaatccgtaataatcaacgtttccgatttctccattcgccatttttgctttcagtttcttcgatttcgtcgtcaggcacaataattttt

SEQ ID NO: 15438 - DNA, 226 bp, Zea mays
  Clone ID: cC-zmpo148032d07d1
acacattcctcggacccggtcatagtctcggacctgtcacatcatccttttcacaacctcaccgacgcagttatacatcacaaacccacactaattacataattaatacttatttcaaacatcaaattattaaaattattactaacatctatttgtctaagattttactttaaaattaactatcatacttttattctagtactatactctcattcaaacttattat

SEQ ID NO: 15439 - DNA, 418 bp, Zea mays
  Clone ID: cC-zmpo148032d08d1
aaaaagcccgaactaaaaaaaatatttaggtaaaaaaaattttcaaatatatatcaaattcatttatatatcaaatataaaaattcgatcgttagaatatgaaatagtattcaatcaaatttaattgaatgaacggaaaaaatcataacatacacaaagttttctttggtctttaataatttagaacattttttattgacgagccacagaaattgcacctatcaaagcaactaaaagaattattgaaatgagttcaaatggcagaaaaaaatcctgtgataaatgaattcctatttgttgactattacttatttaattttgttttagaatttggtttaatttctttttcctgatgggggggggggggagataacctttcttttcgtttttaatttacttaaaaaaatttttttgtaag

SEQ ID NO: 15440 - DNA, 266 bp, Zea mays
  unsure at all n locations
  Clone ID: cC-zmpo148032d09d1
aggtaacttttccgcaatggcnagaagtaaaacacggaaggcaaagtttctctgtatcnagtctagtggcactgttactctgagttgcataagctaaattattaaacaactaaaatttaagtacttttttatcattccttttgagcttattggattaatccttggctttaattgatgattttttatattcccattttttgctattaaatcctttattcttgttttatcatttttaaatcttatcatttctttcttttatatgtaat

SEQ ID NO: 15441 - DNA, 181 bp, Zea mays
  Clone ID: cC-zmpo148032d10d1
ctttgataatcatgagctgctacatatgttgtcctactttaagctacgaaggcactttgataattaattagaaaatgcttctggttacatttattgttggagaaactggatcagtctacctttgattggaacagttatcaagctaattatattgtacatacttactaaattttattcaata

SEQ ID NO: 15442 - DNA, 198 bp, Zea mays
  Clone ID: cC-zmpo148032d11d1
caaagtgagaaaaacagattaagctaacatcacagatacttgttcatgtgttctcatacttcatctctagcgtttcagactgcttttccataagaaagatctcttccccacgagactcgacgcgcttattggctgctttcaaaaccttctttatatcagccgtctcctcttctttcatgtccatcttctttctcactt

SEQ ID NO: 15443 - DNA, 285 bp, Zea mays
  unsure at all n locations
  Clone ID: cC-zmpo148032d12d1
tcctctgntcattcttaatgccgcttatgactcttggcacggtggcgttaactctttgttattgcattatttgtccaaagaacagatctttcagctggaatgaagtattttccataatctaacttcaaaaactcatcattagtttcacatttctttatcagataaagaacattttggctccgcgagcagctcatccttacggaaaatggcaaagttgtcaactagacatcaagaatttccatccaagtcagatcaaagttatgcaaggttagtatagaatcaaaa

SEQ ID NO: 15444 - DNA, 283 bp, Zea mays
  Clone ID: cC-zmpo148032e07d1
ttaaagtagattgcaatgctaaaacattttcactgatagagtgggacgtggaaacacataagagaattgtctgtacatcatctaggacacgatcagaatgttgcttaatcaccaattcatcatcagattcttggacaacaacttttgcaatattttttcctacatgttaaattttgaaaagggatttagattgtggaatccatgtaagataaattatgaacaacgtctaaatccaaaagcaccttatcctacaacgtttcttgttgctcaagttgatgttttc

SEQ ID NO: 15445 - DNA, 505 bp, Zea mays
  unsure at all n locations
  Clone ID: cC-zmpo148032e08d1
aaccggttcttaaactacacncacngtgacaagcaaaactttcatagtagnctactaagcgtcaaggcgacagttatcttaagccaaagcaactgaaccataccaaatcaatggctcattcttacaaagacacttttttaacaaactctcactaccataatagtggccttctcattccacacacaaatattcattcaaacaaaacaacttatcatacctaaagttctcatttctaaaaaaaaaaattgtctattttacaaataacaataaatcctctattaactcataaatcacattcttttttaaaattcttcattaacattatatacatagatatgtgggtattattcacttctattcctattatcaatttccaactttttctttaattaacaaaaaaatttttaaataaatcccttttctattctgaatcatattccaaaataatttattaaccaaatcaaacttttattcccttaattcatttttacacataatttttatt

SEQ ID NO: 15446 - DNA, 605 bp, Zea mays
  Clone ID: cC-zmpo148032e11d1
ctcatacgccgaacgttcaattaactcaaaatcatcaattgtttcaactaatctaccgaagtactcggctgagaggaaagaagacggacgaatccgagccaaagccgtacaagcgcgagataccttcgggacagcctaggcggatccatgctttccaacgaagcacgcccatccaacctaggcgagacaagggttcacatttcgttcatcacccttggccggctttcgaacagccggactcccatcaaaagatggttgccaagaacatcttcgttacggtttgctaattctcggaataacatcaacaaaactaggaaggtttaaaaaacccacggtggggggggggggtgctcttaattttttttacccgtctctgttttgttttttgctctttggtttcctttgctcattttgttcctcttctcttttttgtttctactgttgtatgttcttttgttatttttgtttttcaatgattttctgttttttcttttttgtcttattattgttttttttttttttttctctccttccttgattttcttttttctttccttttatttttgttttacttctttttttcttgttttttcttttttttcttt

SEQ ID NO: 15447 - DNA, 165 bp, Zea mays
  unsure at all n locations
  Clone ID: cC-zmpo148032f07d1
aaacgttacatcttacattaataatcctctttcgttcgatgacactttaattgaattttgtaaaaactgnntagacaatcctgaagaggggattgcttgcatgtcttcnnacgttcttacggcggcagtgcgccccccggagcccccgtttacagcgtttcaaat

SEQ ID NO: 15448 - DNA, 211 bp, Zea mays
  unsure at all n locations
  Clone ID: cC-zmpo148032f09d1
cgccaaaaagcttgatgcatgttttatttcgcctcacgcttttacctgtaagtccacacgactactgcaagtgcagantgtattgcagtagtattttagcgatcgaatccacaacgagagaagtacatcaaagaaatccttaagattagagttatgctaggaccacaataaaagagtggcgcttacttcatcgtttcttgatacctcattt

SEQ ID NO: 15449 - DNA, 232 bp, Zea mays
  Clone ID: cC-zmpo148032f10d1
ggcttgggcagaatagcggagcaagtattagtagcatagcattaattcgttcctcatcattaagtcattaaatgcatgtgtttgctcgcggtaattgtgaactctcgggagaatcgatgactgcatcaaagatgcacttgttagtacatctgaaaattctgaattggctagctgtaaatagccccaggactatagaataaaggattatcccgaacctacaccgaggtattga

SEQ ID NO: 15450 - DNA, 239 bp, Zea mays
  Clone ID: cC-zmpo148032f12d1
gcccggtcaggctgcgcgtatccatcatttgatgcgggagaccacattgtagctgcacacgtttaaacaactctcgactgggacaggtgaattcactcacctgaatcgtgctcaaccaactgactttcccaccagttagaaaagcagcttcttcatcatcgaacaatccagccatatccatgcagttctatctctcattgacagaatgaatcccatacagatcgtttatcttctcatat

SEQ ID NO: 15451 - DNA, 634 bp, Zea mays
  Clone ID: cC-zmpo148032g08d1
gttgctgtttccattattatagaattgaaagaccacaccggatttatgttaagatcatttatttacaacggaatggtatgcaaagttatcagatcgtaatgaatacaaaataagatttatggctacacaaactgttgaagatagttctagatctggtccaagaagcactactgtagggaagttatttgcaatcatttcttttcttattttttttaatttctttattttatttttttttttttctattttatactttttattatttctttttatttgtcatttttcttttttttttctatatttctttatactctttttttcatctattttttttttttttttctttatcatttttgggtgggggggtgtgcttattttatatttctttctttatctttcttttttttattatattatttttttaattttatttttctttttttttattttcattattatttttatttttttatttatttctttattctctatttccttattcttctatttatttatactaatttattcttattatattttatctttctcttttctttctttacttttatctttttttattttcttatatttcatttatttactattttattttccttttttatttttttatttt

SEQ ID NO: 15452 - DNA, 285 bp, Zea mays
  Clone ID: cC-zmpo148032g09d1
tgttagcaacattaataaattcaataattgaaggatatcataactttattgacaataacaaaagcactaattcaagaacgcaacaatatacactaatttaataactcaaccaatcaaatcatacactagccacacttctccagaaattccacgttagccagtattttacatgtacgtctggcattataaacgcatgaacattaatacagccttcttcaatcccactataaaacactatgttttccactaaatacttgttacttcattccagcatatattctcttt

SEQ ID NO: 15453 - DNA, 298 bp, Zea mays
  Clone ID: cC-zmpo148032g12d1
agctcgtatgcgagttggtctgactgccttaactatggcagaatatttccgagatgttaatgagcaagacgtacttctatttatcgagaaggtcttccgtttcgtacaagcaggatccgaggtatccgccttattgggtagaatgccttctgctgtgggttatcaacccacctttagtaccgaaatggctactttacaagaatgaatgacttctacgaaaaaggggtccataacctctatctaagtggacatttaacctccgattctttaaattttcctcttctatttttacttttat

SEQ ID NO: 15454 - DNA, 267 bp, Zea mays
  Clone ID: cC-zmpo148032h09d1
ggtcgagtgtcttcacctccatcatcagacaaccactcgacctccttactctacctagaggtcgagtatctcgatcagaccactcgactgcatactcgatgacaagcttcagagccttcttcattctgcactcaaccagacactcgagcacaaggaagaaaagaagactccagctattcactcgacctctcactcgaccacatgggtcgagtacagttcttaatccgttccaatacttcgtcgctttgagtattagggcctcttcta

SEQ ID NO: 15455 - DNA, 343 bp, Zea mays
  Clone ID: cC-zmpo148032h11d1
ctcacgaatgaaaaatgttgcttacatagaagctacaactaaaccaatttcttatagatactcaaagaaccaacgtggtatcgtaaaaccttaattctaaattacctgtaatctggatcagcatcgccagcactagcatttgaaatacagaaaaggcatgacagcaatagaaacagggctgtccagtagtggactgccatctgagcagaaagttgaagtgaaatcactgcgtgataataacaatgcaagcctcaaaaaacaaagaaagaaatcgcttaaaggagctgcaaatggaaactatgaatcagagactaaaaaaaaaaaacttcaaatgtgaaagatc

SEQ ID NO: 15456 - DNA, 517 bp, Zea mays
  Clone ID: cC-zmpo148033a01a1
ctcctctctttttttttaattttttaatttttgtttgtttttaataattttttaaatattttcccacccttatttttttttcaaaaaattcaaatctataaaaaattcttaaaaaaatgaccaaaaaaaaaaagaataacaaatttttataaaaaaaaaaatccaaaaacaataacaaccaaaaaataaaaaacaaaaacttgtaataaaaaaagaacgagataaataacaataaaaacaccaggcggaaaaaaaaaaaaacaaacttcaaaaactttaaataaaaactcaaccccttaataaaataattgaacaaccacatgcaaaataaaaaatgaaaccccaccagcaaaaacttattaccatatccactataaacaaaataaaaaaccgttatccaataaaaaaaaaacaattacaataaccttgaacaaaaaaagattcaccaaataaaaaaaaaatgcaatcttttgcccataagagtaacaaataacaaaaaattttattcttacctctt

SEQ ID NO: 15457 - DNA, 300 bp, Zea mays
  Clone ID: cC-zmpo148033a01d1
ccgcaattttaaaaaaaaaaaaaaaaaaaaaaaaaaaaaaaaaaataaataaataaaaaaaaaaaaaaaaaaaaaaaaaagaaaatttttttaaaaaaaaaaaaaaaaaccccccccaaaaaaaaataatttatccaacttttttaaaaaaaaacaacctcataatccatatttatttcttattttattcaaaataatttaccattttacttttttccctctcgtatattaactacctttttaacccccattatacaatttaactctcttccatttttacctactattttttaacttaaa

SEQ ID NO: 15458 - DNA, 274 bp, Zea mays
  Clone ID: cC-zmpo148033a02d1
aaaaaaaaaaaaaagaaaaaaaaaaaaaaaaaaaaaaaaaaaataattaaaaaaaaaaaaaaaaaaaaaaaaaaagaatttttaaaaaaaaaaaaaaaaggtccccccctccaaaaaatccaacttttacacccctttcaatgcaattacatatctctttaatagcttcaccaaaattaaaaaaaatttccatccttaaaaaacctctaaacttaaaaaacctttctcttacccaacataatttctttataacaaaacccactttccccaactt

SEQ ID NO: 15459 - DNA, 327 bp, Zea mays
  unsure at all n locations
  Clone ID: cC-zmpo148033a03d1
ctaccangaacgtcggcatcagcgacaacctgcgccctgncatacccgctcggctacctcaaggacgtacgactgtccatctgcgcctcgctgctcaaacacccggactcggacgacgacgaccatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtggctgtaccaaattctgagtgctggattcttgctattgtc

SEQ ID NO: 15460 - DNA, 471 bp, Zea mays
  Clone ID: cC-zmpo148033a04a1
aaaatcagcatcggtcaataactggttgggttatgttacatcctgcctacgtggcctaccttttacgaaaggaagattgaagagagcagacagacagctctgcaaatcctccctttgccatgtttcccgttaattagctccccctctacggtcatctatgcttcatgtcgtcgtctgccctgaccatttcggccctaggaggactgctatcattgtctgtcccgctatgcgtgctcttgtgttcagcttccgtgcctccgggagggtagtattgcgggtcggcgaggaaggagagcgccgcgactacttcgctgatccccggccggctggcagcgtcctcctgcaggcacatggacgcgacggcgagcgcctggtacagcgccttcactgggtacctgttgcccagcaacgggtcggccagcttcacgaacctcctcttgtctctcagcagaggcgaagcccagttaagta

SEQ ID NO: 15461 - DNA, 489 bp, Zea mays
  Clone ID: cC-zmpo148033a04d1
cgggggggtggacctcgggaacgatatttcggccaagtcagaggagtgcctaggggttagcaaccaaaacatgcccggcggggtgctgacgttcagtcagctgagcgccgcaacggacgggttcagttcgcagaacctgcttcggagaaggcggctttggacgggtgtacaaagggctcctcgaggacaccggagaggttatcgccgtgaagcagctgaacagggacgggctccagggcaacggcgagttcctcgtcgaggtgctgatgctcagcctcctgcaccacccgaacctcgtcaagctgctgggctacagcaccgactccaaccagcggatcctggtgtacgagtacatgcccaggggctcgctggaggaccatctactggacttgcccccgagctggaagcccctgccgtggcacacgcagatgcagatcgcggtgggcgcggcgaaaggcatccagtacctgcacgaggtggcaaacccgc

SEQ ID NO: 15462 - DNA, 281 bp, Zea mays
  Clone ID: cC-zmpo148033a05a1
ctccccaaccaaaggaaccttaacttcctaaaaaacaaaaagggtgcccacaaaaacttaaaacttaaacaaaccgcgtttatccctgccaacacaaaaaaattttctcccgcaccaaaatggggaaaagcacctttaacacaaaatcaaatttgcgtaaaaacaaaaccattaccatccccccccaaacgcatgaaaaaaaaaacaccccgaaaacccccccccataaccaaacccacttgaaggggtaaaaaaacctccgcaaaaaccccccccccccc

SEQ ID NO: 15463 - DNA, 538 bp, Zea mays
  Clone ID: cC-zmpo148033a05d1
gcgttcggccgaaggcctcgtgccttctcttcctcccagtcaaggaggaagtagctgtttcgcctatgatgatggttttcgtagtgctggacaacaatggcgccgacgcggtctcctgcactgccatccctaacgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagccccaagaagagagccatcgcggctgctgatgacgattgcaagcctgccgatgacgagtcaacgtcgtggaagcgcctcgtggacggtatgcgcccgttccgtctccgcgggcagctggagtactacccggc

SEQ ID NO: 15464 - DNA, 354 bp, Zea mays
  Clone ID: cC-zmpo148033a07a1
aattcattgggagtatgttaagattgtgttgtgggggggacttaaaaaacaggatcctatcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcaggtcacctggttgttgcagcagcaggagcaggaccaggagggaagttcacccactgcagctgcagctgtatctccccgctctcgacgttcctgagccggaggatcatgtcctgcgcgaact

SEQ ID NO: 15465 - DNA, 529 bp, Zea mays
  unsure at all n locations
  Clone ID: cC-zmpo148033a07d1
ggacaccttagcagagacaccccatgggaatgctacggggacgggcgccactgatggagccnggatcatgaacccgccggaggagagcctccgaacggcgccatcatcaggtccgagcggccgaacgccaggaactgcctcgccgacgagagccacgtgtgctggaggaacggcaagttcgcgcaggacatgatcctccggctcaggaacgtcgagagcggggagatacagctgcagctgccgtgggtgaacttccctcctggtcctgctcctgctgctgcaacaaccaggtgacctgatcgatggtagctgctgttcctgtcgccattgcctcctgctggcaggaacaggaactctctgaagcacggggtcagggtagttcatgttgctttgattccatcgtaggggagataatgcccgatggctttgtaaagtttgggaggacatgcattataattgaagtcaagtgataggatcctgtttttttagtacaccatacaacacaatccttacatactccctttgtttt

SEQ ID NO: 15466 - DNA, 425 bp, Zea mays
  Clone ID: cC-zmpo148033a08a1
aagatattctcggaacttttatttctatagatgacagaattatatacacaaatgactcttctggagactcactaccacattcacttgtgacaatggtaaacaagtgacagcagattgacacatacattaaatctacattagttgaactagattcttgagcttctaatgatgtaagtttattttaatggaaataaaaaaactgtgctcgatgtcgcacaacttcaaataagacactgggtcttagttcttgtgtggttgagacttgagaatcatatccatgattcaatggtggatttatacttgtagttgtagggatttaatccatttacttgcgcaagaatgtcagatgtgtccagcatgtcctcttctttcatatggtcagtttgttcataatgttcatgactctgggagcctgattgcgctgc

SEQ ID NO: 15467 - DNA, 482 bp, Zea mays
  unsure at all n locations
  Clone ID: cC-zmpo148033a08d1
tttttacccgagaagctgcgccgcgcgccaatctgataatcnccatgcgctgaagatcgttggtgcccacgatgctttctgatgattgctgccacatcctccctcaggaaatttcaagccccatagctgcacatatactcgacttctactacggcgacgacggcctgggcgatgacctctttgccgcggtgactgccacctctggcccattccctgccactgacgatgatgtttcttcgtctaccgctaccacccctcctatctgcggctacagcgaagacaccgcagctgctggtggagccacagcctacaccccgttgacatccttcgacaccactctgacagccctcctggaggaagagcagcaccatggccttgacgccgggttcctcccgcagatcgatggcctatcagaggtagcagcatactatccaactgccaccgatgaggccagcatagggcagttcgaccagatgggactt

SEQ ID NO: 15468 - DNA, 425 bp, Zea mays
  Clone ID: cC-zmpo148033a09a1
ggttagtggattgcatggatgctgggggatcctttacatctgtctatgtctaagtcatgtattctattggaatagtaaattttacttccagagcaaaggacaatgccagagggcttgctagttgacgaagtttgtcaagcatgcaactggtatatgtgatctccttcaacccttatttccaccacatccagtaatcctgcttttgcgttgtctttgatgctgtttagttgaggttgagggtgtggtacttcagtcagtaattgctgcttggaaactactttcttgtttcataaagtatctttgcacagtttttgactgaggctgctgaaattctctgttgagtaacgtctagaagcgttcctccagtccgatccacttttcatcatcaattcaaactctgggtaactgatgcgaccatccttatc

SEQ ID NO: 15469 - DNA, 444 bp, Zea mays
  unsure at all n locations
  Clone ID: cC-zmpo148033a09d1
cgggggcttctcgcggcggtaccggctcggcgcggagctcgggcgctgcntagttcggcgtcacgaggcggtgcgaagacgccttctcgggggaggccctggcgtgcaccacgatccggcggaagcggctgctcctgcgcctcggcgggcccgacgcgaccgacgtgcagcgcgaggtggagatcacgcggcgcatgtcggaggtgagcgggggcagggtcgcgtgcctgcgcgaggcgtgcgaggacgacgacggtgtgcacctcgtcatggagctctgcgagggcggcgagctcttcgaccgcatcttcgagcggaagcactactcctagcgcgccgtcgacgagctcgcccgcaccatcgtcgaggtcgtgcagctgtgccacgagaacggagtgatgcacagggacctgaagccggagaactttctgttcgtgaacaagt

SEQ ID NO: 15470 - DNA, 276 bp, Zea mays
  Clone ID: cC-zmpo148033a10a1
gaagcaaactcatttcccattgctaattgaatattcctacaacagcatatggatgcaacaagggaaaaatggttgacacacaaaatttgactggccaactaactgtcctgcacatgtcgtcttacaaaaagccctacccctaccaggggtccttgctttcttatcaaaacaaccgttcgccaacgcttgccattccctttatcaacccctctcgcacgtacaaagcgtgcgaacttttgctggcccaattttccaactgcgccctcatcgtcccct

SEQ ID NO: 15471 - DNA, 505 bp, Zea mays
  unsure at all n locations
  Clone ID: cC-zmpo148033a10d1
tccgagatgaagcggctcggcgcgatgcggcatgcctactagctgccgccgctggcctaccactaccacagaagcgagatgctcctggtctacgagtacatccccaagggcagcctgctgtacgtcctccacggggaccggngcatggactacgcggcgctggactggccgacgcggctcaaggtggccgtcggcgtcgcgcgcggcacggcgttcctccacacggcgctcgccggccacgaggcgccccacggcaacctcaagtcggccaacgtcctcctcgcgccggacttcgagccgctcctcgtcgacttctggttctccagcctcatcagccacatgcagtccccgaactccctgttcgcgtaccgcgccccggagtgcgccgacggccaccccgtgagcgcaatggccgacgtctactgcctcggcgtcgtgctactcgagctcctcaccggcaagttcccggcgcaatacctccagaacgccaagggcgggacggacc

SEQ ID NO: 15472 - DNA, 437 bp, Zea mays
  Clone ID: cC-zmpo148033a11a1
aataataggagacgtatttttatatatatatatcgacgttcatatacatgacataaagaacacttttggatgagggacttattagatagacatgcttcctctatatatataccatcaatgatcatgtacttcaactcctactcgaggtgttatgcatgcatgcatgatgaagtcttgagcccctttgttttttttgcttgggtattattcctcggaagcgaacgaaaaaaaagagagagagaataaacgagggggggacagacaaggctggctagagaaggaaacgcgagaaaaagtcccctctcgctctcctttagttgtgtacagcaccgtgcgcgatcgatcgacgctctatacggcgcggtaagaccgtggcatccgcaggccgacgacctttccgcagcggaggctggtctccggcatgttgtactcgtccc

SEQ ID NO: 15473 - DNA, 368 bp, Zea mays
  Clone ID: cC-zmpo148033a11d1
actcgtggcaggacaccatgccccccaccaagatcactacccagcccaacaccaacttcacgaagcagggttataccaaggaccacatcgacacccccatctactaccccaacaccgccatgcaacagtacgtgcacacctacgggcagatcaacgaccacagccgtgacctcatccacacgcccttcgacacgctggccgacgacatccccgagctcatcagcaagtggtacaccaaggaccacaccaatctggacaacaacctggacaccggccagggcgatcgggcaactgatcacgctgcagatcaacaaaaagaactagaaggacgcggggaacccatccatgttcaacatgaaatcccccat

SEQ ID NO: 15474 - DNA, 457 bp, Zea mays
  Clone ID: cC-zmpo148033a12a1
catgatatactattgaataaatagtgcaggtcaggaacatatacatagagttactcaatatatcctaactcataatttcaatgaattcttaattaaatgaaaaatgaatgcaagcattccctgcatgcgatggcacctcacgctggggttgcatgcgtggttcatatcatgtttgcaagagccatgcagttgctggccatctggttgagctccttgtcaaacttccccatggggttggggacgccggcctgggtgaaggggcggtcgcacgagtcgaagtcctggacggcgagctgcagcatgatcttggcggtgccggtgtccttgaacgtgatggcccgctgcgccgcgccgatggtgtcctgcgtgttcatgtacatggtgtcgcagaacgtgagcgcctgcgtttgctgcggcgggatggtgcgggccgaccttgcgacgtgcttgcgcgcct

SEQ ID NO: 15475 - DNA, 541 bp, Zea mays
  unsure at all n locations
  Clone ID: cC-zmpo148033a12d1
gggggggcaagcctagggctcgtcctcctcgccgcgggcgcatcnttccgccggcctcctcccgcaggcgctagataagttttggggaggcaggggacactgccgccccgtcaacccgcaggtcgtcggcatctgttttcgcaccccgttcccggaggtgtgcacgtccaccgccgggcggcacgcgtccaagtacccggtcatcgacaacctggccgtgctgaacatgcaggtggacacgttcgccaagcgcaccgcgcaagcgcgcaagcacgtctcgaggtcggcccgcaccatcccgtcgcagcagacgcaagcgctcactttctgcgacaccatgtacatgaacactcatgacaccatcggcgcggcgcagcgggccatcacgttcaaggacaccggcaccgacaagatcatgctgcagctcgccgtccaggactttgactcgtgcgaccgcccctttcacccaagccggtgtccccaaccccatgaggaaagtttgacaaggagctcaaccagatgggcagcaactgcatgggtt

SEQ ID NO: 15476 - DNA, 258 bp, Zea mays
  Clone ID: cC-zmpo148033b01a1
aaaaaacaaccctcccccccccaatataaacccaaatatttctttactcaacaaaaaatcccaaataaaaaaattattttcaaacacaaaaaaaaaaattttattacacaacttcctaaaacaaaaaattctaaaaacaagaaaaaaaaaacattccttaaattccaacaaaaatataaaaaacacctacaaccacaaaatacatgttaatacaaaacaacaccaccaataaaattatcccaaacccatcggagaggg

SEQ ID NO: 15477 - DNA, 347 bp, Zea mays
  Clone ID: cC-zmpo148033b02a1
gtcatattactatacggaaaaagaggggagtacatgcatattatgtattttctgctgggagtaaaaggtgttgtaaaaccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggcgtagacgggggcggggcttggagcaggtgactcggacacggtatccttggccac

SEQ ID NO: 15478 - DNA, 339 bp, Zea mays
  Clone ID: cC-zmpo148033b02d1
caaggataccgtgtccgagtcacctgctccaagccccgctcccttctccgccccttagttgcgtgttggacgccggtgttcgccggcccccggccaccatgcgtcgtgtctgcgcgcgcacgcacgcattgaacgggagatagaatatggtatcgttcaatgcagattgccatgctatagctccagagtttatctacctggtagcaccatgacacgatggcccgttcgtattttctggcttgctcgtacttttcagttccatggttttacaacaccttttactcccagcagaaaatacataatatgcatgtactcctctttttttccgtatagtaatat

SEQ ID NO: 15479 - DNA, 451 bp, Zea mays
  unsure at all n locations
  Clone ID: cC-zmpo148033b03a1
aggctaagtttgattgntcatgttaattaagctcagggagacaccggtttacgtccattgatatgtcccgtaccattgcatattttggaggtctacgtcccgagcatagtgctcgccttcagtgaaaaccacggaaaaatccgttaaccaggtcggccaccggatgtttccggaacggtcgacgcggccgtggatggggccggagccatggaagaagaacgggcgggcgctgcctctgcaggaaccatggaagctgtggctgatgcggctgttgctgctcctcctcctccaactccggtggctgctgctcctcctgctcctccggtggctgctgctgcttctgctccttctcctgcccgttcaccaggcggcactgcttccttacctggcccttgccctcgccgattagcacgtcaagcattccgaccttctgcatcgccggacgcgtggg

SEQ ID NO: 15480 - DNA, 448 bp, Zea mays
  unsure at all n locations
  Clone ID: cC-zmpo148033b03d1
cgcgtncggcgatgcaaaacgtcgggatgcttgacgtgcttanctgcgagggcaagggccaggtaaggaaagaaggttttctggtgaacggccgggagaacccaccacaagcagcagcagccaccggaggagcatgaggagcagcagccaccggagctggaggaggaggagcagcaacagccgcatcagccacagcttccatggttcctgcagaggcagcgcccgcccgttcttcttccatggctccggccccatccacggccgcgtcgaccgttccggaaacatccggtggccgacctggttaacggatttttccgtggctttcactgaaagcgagcactatgctcgggacgtaaacctccaaaatatgcaatggtacggtacatatcaatggacgtaaaccggtgtatccatgaacttaattaacatgaacaatcctgctttgcct

SEQ ID NO: 15481 - DNA, 386 bp, Zea mays
  Clone ID: cC-zmpo148033b04a1
ccccccccccaaaaaaaaattaaaatttatgaatgggattacaaaaataccctaccaaaaaaaaaaaattccaaaattgggaggcccccgtcaaaaaaaaaaaaaaacgcttggttttgggagccaccaaaaaaaaaaaaaaatccaacccccgggtttatatattggggggaaactaaaaaaacccgaaaaaaaaaaaaagcacccaaaaaagcatatattttaaaaatatcccggtcaggaaaatggttaaaaaacacgaaaaccctcttttcaaaccaaaaaaatttccaatggcgtttttaaaaaaaaacaatgtttttttacccgaaccaatatcatttatgtccacattgaaaaacctcaccccctggcattaaaatttt

SEQ ID NO: 15482 - DNA, 525 bp, Zea mays
  unsure at all n locations
  Clone ID: cC-zmpo148033b04d1
gcgtncggcaagttcctgtacgagggcatcaccatggactaagtctcctaccccatcatcatcgaccaaaaggtnctgtcccaacaacatctgcgtcaagtcccgcgccttcaaggtggccgtcaacgacgtcgtcttttaagaacatccacggcacctccaacacgccggaggccatcacgctcaactgcgccaacaacctgccatgccagggcgtgcagctcgtcaacgtcgacatcaagtacaatgcatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtcttcaccgaatatataatccgctggtttggattttctttcttctttggatcatcacaaaaccaaccgatgtaattattattagaccgacgccttacaatcttggaccttattcatta

SEQ ID NO: 15483 - DNA, 476 bp, Zea mays
  Clone ID: cC-zmpo148033b05a1
gacttggcttgaattggatggggttcccaactgtacattaatagggcaacacatgaactaccctgactgaccctgaccccattaattgctggcttaagctgttacaatccgacattcacaaagaggttgaaaatgcgattgcttcgataccttcacctgctggctgcagcaggaaggatgcttagccactgcagctgcaggtgaatatgcccgctctccacgtttctgaacccgaggatcatgtactgcgcgaacttgccgttcctccagcacacatggctctcgtgggcgaggcagttcttggcgctcagccgcacccacaggatgatggcgccgctcctaatgctcacctccgggctcccattcaccgacttcaccaacagtgccacgtttatcttcgcttcccccatcggatcgtccctgctgaacgtgtccttgtgcaacacctacaacttcaaagctaggctgggatctgt

SEQ ID NO: 15484 - DNA, 496 bp, Zea mays
  unsure at all n locations
  Clone ID: cC-zmpo148033b05d1
ggaagtcgcctaattctttcgatcgaattaggcgccttcttcgactatgctccgtctttatttgtaatctgaaacgacaggaacatttgagtggatcatggacggatcggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcatcanggacgacccgatgggggacgcggacatcgacgtggcgccgctggtggaggcggcgaacgcgagcccggaggcgagcctgaggaacggcgccatcatcctgtcggtgcggccgagcgccacgaactgcctccccgacgagagccacgtgtgctggaggaacggc

SEQ ID NO: 15485 - DNA, 429 bp, Zea mays
  Clone ID: cC-zmpo148033b06a1
ggcgcggccggcggtgctgtggctcttccgccagcgccgccgccgccggggcaggttcctctccgcggcgctcgtcgtctccttcctcgcctccttcctccactgagcgacgtaccgcgcggagtgcgggaaacctgggatggagcatcgtgtttggttcacccgattaataattaattaatcgttgctttatttatttatttattgcttgcggttgcctaattatgtgatcgtctgttgttccttccttcgttccttccttggtgatgtgtgggtcgccaagggggtttcgcttctgtaatcctgcctgatcgatgctaatactatgatcccaatttggtttttgcgatcctaccgttttgtttgaatcagaattcagaatgatgccaaaaaaaaaaaaaaagggcagccgctcgccggacgcgtggg

SEQ ID NO: 15486 - DNA, 427 bp, Zea mays
  unsure at all n locations
  Clone ID: cC-zmpo148033b06d1
gcgtncggcgagcggctgccctttctttttttttaggctacattcggaattctgattcaaacaaaactacgacgattttaaaaaccaaattgggatcaccccctaccatcgatcaggcaggattacagaaacgataacccccttggcgacccacacatcaccaaggaaggaacgaaggacggaacaacagacgatcacataattaggcaaccgcaagcactacataaattaataaaacaaccattaattaattattaatcgggtgaaccaaacacgaagctccatcccaggtttcccgcactccgcgcggtacgtcgctcattggaggaaggaggcgaggaaggagactactagcgccgcggcggcgggcactgcggcggcggcggcggctctggcggaagggccagccgcaccgccggccgcgccg

SEQ ID NO: 15487 - DNA, 374 bp, Zea mays
  unsure at all n locations
  Clone ID: cC-zmpo148033b07a1
atcctccanaacagccgcccttcttttttttttttctccctccctttttccttcttttttttttttttcttgcttttttttttttttttcccccgggaaccaaaccaaattgttgaaaggattcaaacaaatggcaagccaagaaacaagggttaaaccccctctcagggggaaaaacaacaacggcatccctaaattccttaaattaagggaaaaaagggaaccaaaaaaaaaaggaccaaaggggtttcaaaaaaaaaacatccccccccattggaaagcccccaaccatttaactctctttccccctttgttttttccctggcccccgggcaaacggccggggcccgcttacttaattttttacgccaaaa

SEQ ID NO: 15488 - DNA, 550 bp, Zea mays
  Clone ID: cC-zmpo148033b07d1
cgggagcacagagctagctagccagccagccagcagccagcttgcatgccgcgcccgtccttcttcctcgcctccatgccgtttcgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgactccttcttcgcctactacattcagtgagccggccgcggccggtcgcccggaggccgatgaagagacgaagcgggagagagagtgacatggctgcgcgcattccgatgcgtgggcatgtttttgattcaacacaccttttgtcctctctttctttgttgcctctatctccttaatttaacgaactgatgcatgccgctgacgttctttcccctgagagagggattaacacttgtatcatcgcttgccctttgtttgaatccattcaacaattcggtttat

SEQ ID NO: 15489 - DNA, 280 bp, Zea mays
  Clone ID: cC-zmpo148033b08a1
gggccccaaatttaaaacatgtttttattttgaatggaattatacacccacactcttaaaatgaataaaaaagttcccaaattgccaaaagcctaaaaaaaaacttgccaaagttaaaaaaaaaaaggtgaccaaaaatgagtgatggattcaaattggttcaaacccaagcgaactcctttgccatgccaaaggacttgcccatggcgttctttcaaaccgacattgtctttttttccgacccgttgtactttatttccacctttaagaacttcacccc

SEQ ID NO: 15490 - DNA, 566 bp, Zea mays
  Clone ID: cC-zmpo148033b08d1
gggggcacgctcgccggcaccaccaacggcctgcgcatcaagtcgtactaggactccaagtcgtcgctcaagggggggcggttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacatccacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacatccacgggaccttcaacacgccggaggccatcacgctcaactgcgccaacaacctgccctgccagggcgtgcagctcatcaacgtcgacatcaagtacaacaggttcgacaacaagaccatgtccgtctggaagaacgcccatcgcaagttcattggcat

SEQ ID NO: 15491 - DNA, 315 bp, Zea mays
  Clone ID: cC-zmpo148033b09a1
gcctccgaaaatggcatgtgtagttaacattttgcttgttttccactctttggaattcggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctagtagaattggacgttggaagtgtaaacggcatcgggtctccagttcggcgggatgacatctttggcga

SEQ ID NO: 15492 - DNA, 512 bp, Zea mays
  unsure at all n locations
  Clone ID: cC-zmpo148033b09d1
gttgagcgcgacgatgggatccctcgctaataacatcattgncgtgggtgtcgtccttgcagcgctcatcgcgggttgttcatgcgggcccccgaaggtgccgcccggtcccaacatcaccaccaactacaaccggcagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtggtcgggcaatccagtcacggtgtacatcactgacatgaactacgagcctatcgctccctaccacttcgacttgagcggcaaggccttcggctccctggcaaagcccgggctcaacgacaagatttgccactgcggcatcatggacgttgagtttcaaagggtgcgatgcaagtacc

SEQ ID NO: 15493 - DNA, 520 bp, Zea mays
  Clone ID: cC-zmpo148033b10a1
aagaatacacattgtatttttttttacggggagtttggtacatatgcccagagctcattgtctcctcttaggagaaccgcgctcttgagacttgagagccatgtcgaaaatacgtactagttgagaaattaagcagtagctacgctcattagcaaccctcgaatgtgtagcgcgtggatgaaataatccggcccttttcttcccctcatctagaatcttctagaacgtagaggcaaggacaagaaagaaatgtaagaggagagaacatgggtcacaactcacataggtcatttcgcgtgaaaatttcattgcggttttcaaaagtggcaaatcagcttttatctataaaccagtgaattctaagttttatctggatgtctccttccataaaattcttttcgcctctcttattataatacccgcgtcatgtcatcaaatatcgggatgtatcatcttgttaaaaaaaataaaattatgatgaaactctcactggcaatgacgttaatgggtaagtaggtgc

SEQ ID NO: 15494 - DNA, 561 bp, Zea mays
  unsure at all n locations
  Clone ID: cC-zmpo148033b10d1
ggggagttctgcccgcgcgccagaccgcgagaacggaacgactanggagatcatgtccacggcgcagcggcacgaccgtttcatgaacatccccgcgctacggaagctcgacgccatgctcatcggctacatggacaacttcgtggaccagaccgagttctggtacgagaagggtggggacaacaagcgcgacgacgacaagtggtggatgccgacggtgaaggtgccgtcggaggggctgtcggacgtgacccgcaagtggctgcagtaccagaaggagtgcgtcaaccaggtgctcaaggcggccatggccattaacgcgcaggtgctcgtggagatggagatcccggagatctacattgcgtcgctgccaaagaaagggaagacgagcctgggcgacgccatctaccggagcatcaccgaggaaacgttcgacccgctggagtttcttggccgggatggaccctttcgacggagcacaaggttgctggaccttaagaaccgcattgaggcctccaccgtgatctgggaagcgcaagatgcagaccaaggactccaagt

SEQ ID NO: 15495 - DNA, 471 bp, Zea mays
  Clone ID: cC-zmpo148033b11a1
aattaattacatcattgaagccatgattaaggccgcagaaatttacaagcaaccaatcacagggttggttggacgtgacccatgaatacattatatcaaagtttactcaacttcgatagatatatgcgcattaggaaggaggttaaaatacccctgtggccgtgattttcttcccgtagtcaaggttttttttccttgatttcttcgtgtactagtagaacaaaaattaacaagcgatttacagcatatggccgaagatccagcatgctctctcaaccaataggactgacatatccgtgtgtcaaaacaccaatgtatcacccagtagataggatcaacatgtttatctgtccccggccatggtgaagttggtcccaacaaaacgaagtttcaactgagttgcttacttcttggctcctggttttccatttggaagttttctttccttcagttccgctcttcttagttacc

SEQ ID NO: 15496 - DNA, 510 bp, Zea mays
  Clone ID: cC-zmpo148033b11d1
cgcgtccgttcgaggttgcaacgaattgctcgtcagatcatgtttgcgtgagaccatctagtgccccaaaagcttgtggtttaacaaacggagggggctcacctgcaagaaagtcccaactgaagggtgcaaaaagttcagacatcagaggagggaatcctgcaaaaaagtcatcgccgctacagaaaaagctgagtgctccctcacctacggtaactaagaagagcggaactgaaggaaagaaaactccacatggaaaaacaggagccaagaagtaagcaactcagttgaaacttcattttgttgggaccaacttcaccatggccggggacagataaacatgttcatcctatctactgggtgatacattggcgttttgacacacggatatgtcagtcctattggttgagagagcatgctggatcttctgccatatgctgtaaatcgcttgttaatttttggtctactagtacacgaagaaatcaaggaaaaaaaaccttgactacggga

SEQ ID NO: 15497 - DNA, 301 bp, Zea mays
  Clone ID: cC-zmpo148033c01a1
aaaaaaaccccaaaaatttttttttataaaaaccccttgggggaaaaacggaaaacataaaaggttttttttgttaaaaagggaaccaattttttccccttttttaacccttgaacggatttaaccccccaatttgggtttttttccaaaaaaacccaattttttaacggccccttttggtgcaaaagggtccggcccgaaagggtttttaaccctccaagggttccttttaaaaaaaaattggcccccgcccctctttaaaaacccctttcaaaactaaaattggggggggaaggccccc

SEQ ID NO: 15498 - DNA, 405 bp, Zea mays
  Clone ID: cC-zmpo148033c02a1
aactaacccattcaagggaaatggaaggataattttagtaccattacatcatgtctaacttatggaacaaaaattacaagcatactttcttttgacaaaaccccggaaaccccttctaaacaagttacataatagaagtgacttggtaagtcacacacacaaacacaccatataatgacacggcaagaaggagaaaaatgaaaccaccgtttcacttaatgcctctacaaaaacaaaagaactcactcgaatcaacccccctataaacctagggggatggggaccatacatgccgttccacttaaacaagacgcccctatgataaatccatggaaacttcggccttgattcttgatctaccggtgaataaatcacaaaatggagcgcgcccccatctgacctttt

SEQ ID NO: 15499 - DNA, 467 bp, Zea mays
  unsure at all n locations
  Clone ID: cC-zmpo148033c02d1
cggtcggcagccacatcagtatctacagggaccgcggaaaaccanctgctcctccagactcataaaatgcctaacaaagctgtactaccccgttcgcactacctacatactcatctactacacctgcaacacctttctcaccgactatgttcccacactgtttgataacttcagtgccaacgatttccatcatggtaatactctcaaccttgatctctgggacactccacgtcaaaagcattacaacacactgacaccacttagctatcctggacctgatctttttcttctggctttctcactgatcactaatgccatctatcataatgtttctaaaaattggatacccgaacttaagcattatccacctcttgtaccaattattcttccaaggacaaagcttgatcttctagaccacaagcagttcttttaggaccatcctgctgctgtccctataactactgctc

SEQ ID NO: 15500 - DNA, 376 bp, Zea mays
  Clone ID: cC-zmpo148033c04a1
atataaggacggggtcattacttcattttataggaaaactacccaaacgggaaaaaaattccacattccaaaggccattggagcgttgcatgtccatgcaattcacgctacagcaaaatggtcgagtcaacctcaaaagcaaagcgaactaattaaggcgagtcaccaattgctaaatatcttatggcgtggaggaaaaaagccaaagcaaataccccgggaggaaggcctttgctttgctgttactattattggaagtcgaaactccaaaccatcggcggcgacatgcattccagctggtacgtagtagttacatgccctgttcaagcaggtagtcccccaacctttccaccaccatgttgcactgcccaggcgt

SEQ ID NO: 15501 - DNA, 516 bp, Zea mays
  Clone ID: cC-zmpo148033c04d1
cgggaactgaaaacagcggagcgatctcctctccctctccctcacctaactcattctccagcgcagcgaagtaaacatgtcggatcgggcaaagatgtcgtggcaggcctacgtggacgagcacctgatgtgcgagatcgaaggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatgcgtggcaagaagggatcaggaggcattaccgtgaaaaagacagggcaggcactcgtggttggcatctacgacgagccgatgacgcctgggcagtgcaacatggtggtggaaaggctgggcgactacctgcttgaacagggcatgtaactactacgtaccagctggaatgcatg

SEQ ID NO: 15502 - DNA, 313 bp, Zea mays
  Clone ID: cC-zmpo148033c05a1
gtatacatattataaaatatatgggggagtgcttacacatgcatgcatatagtgaatgcttaatatatagggaaatccagcaaggatgcttaaaatagaagaagatagaagaatggctggcatagcaacaaggatgcatgcatatgaatgaataaataatatggttaggtaggttaatcgccaccttcagctgaaacctcttgtgcttccgctttggttattacggtagctgttgcctcctcctgcaagttggatccaacggccataggcccttcattcaactttgccttgaagggccccccacttgaaaata

SEQ ID NO: 15503 - DNA, 572 bp, Zea mays
  unsure at all n locations
  Clone ID: cC-zmpo148033c05d1
gggggcgcgtggcatcggaagaaaagaatagttaggtcccggtggtcgatcgaacgaagctgctgctgctaccgacgaacgggtcttgacgatgacacggacgatgtccctaggcctgctgcttctactactggcggtggcggcaacagcgacggcgcatttcacggtcggcgatgtggatgagtacgtgtgcaagcgcacgcaggagtcccgccacaggaacaacggtggcgcgggcatcgatgacctcatctacagagcggcgcgcttccacgccaacgtggatgcacgcgcctatggccgttgatccgacctgcaggaggaggcaacagctaccggagtacgaaagcggaagcacaagaggcttcagctgaaggtggcgattaacctacctaacgcatattatntattcattgatatgcatgcatccttgttgctatgccagccattcatctatcttcttctattttaagcatccttggtggatttccctatatattaagcattcactatatgcatgcatgtgtaagcaatcgaccatatattttataatatgtataccgcgtattatc

SEQ ID NO: 15504 - DNA, 343 bp, Zea mays
  Clone ID: cC-zmpo148033c06a1
ccacaaatcaacattaacattatgggatgggattacagatatacactagcataatgaataacttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtc

SEQ ID NO: 15505 - DNA, 574 bp, Zea mays
  unsure at all n locations
  Clone ID: cC-zmpo148033c06d1
cggccgcgcgtncgagggcatcaccatggacaatgtctcctacccctcatcatcgaccagaagtactgccccaacagcatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataatccgctggtttgtattttctttcttctttggatcatcacanaaccaaccgatgtaattattattagaccgacgcctcacaatcttggaacttattcattatgctagggtatatctgtaattccattccataatgttaatgttgatttgtggtcaccgttt

SEQ ID NO: 15506 - DNA, 434 bp, Zea mays
  Clone ID: cC-zmpo148033c07a1
tttttttttttttcctccttttttttttttttttttttttttttttgttgttttttttttttttttttttttttttcctttttttttttttttatttttttttttttttttttaaaaaaaaaaaaattttttaatagattaaaaaaaattgcaacaaaaaaaaaaaatttaaaaccctttttaaaggaaaaaaaaaaaaacgggataaaaaaaatcttaaaaaaaaaaaaaaaaagggaaaaaaaaaaaaaaagcaaaaaggtttttaaaaaaaaaaaaaaccccccccatttaaaatcccccaacaatttaaatttttttccccattttttttttttttgacccccgaaaaaaaacccccgtcccttttaattaattttttttccaaaaaaaaaagaaaagggccccccaaaagcctccccaacaagggtccc

SEQ ID NO: 15507 - DNA, 539 bp, Zea mays
  Clone ID: cC-zmpo148033c07d1
cagagctagctagccagccagccagcagccagcttgctcgcctcgcccgtccttcttcctcgcctccgttccagtccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgcccttggggccgccgtcgccttcttctttgcctactacattcagtgagccggccgcggccggtcgcccggaggccgaggaagagacgaagcgggagagagagtgacatggctgcgcgcattccgatgcgtgggcatgtttttgatttgacacaccttttgtcctctttttctttgttccctccttcctccttaatttaacgacattgatgcatgccgctgatgttctttcccctgagagagggattaacacttgtatcatcgcttgcccattggtttgaatccattcaacaattcg

SEQ ID NO: 15508 - DNA, 455 bp, Zea mays
  Clone ID: cC-zmpo148033c08a1
cactcttataatacgtacgttacatgacattttagggggagtcattacatgtactaaagctgtcacgatcgagggttgggtatctctgatagtatccgacagtcgacatcgaccccttggtataaatattgtacaccacacacgcatctcggacgaggaggtcagcgatgttgctgccgctgggtcgccgcgtccccggagtcggcgccgtactcgcttgtcccgctgtagtcgttgctgaactcgctgctctcgaaggccaccttcctgaacttgctgatgttggccgcgtagttggccccggagtcgtactccgatccggagctgaacatcatgctctgccctggcttcaccccctcgttcaggtcgtccagcgacgcgtccccttccagagcacggacgatctgtttcatcttgggccgccgcttggctgagtggcggacggccgccgcggc

SEQ ID NO: 15509 - DNA, 586 bp, Zea mays
  Clone ID: cC-zmpo148033c08d1
ccaagtcctccggctcgggctcgccgtcgccatcgccacccgctccgtcgttgtcgccgccaccaccggcgtcgcgcaggatagcacggcgccagcggccagaggctcgccggccgcgccgtcgagggactccccgtcaccaccggctccaaagcgcagcgacagtgactccgataatagtggcagcagcaagagcggaagcggaagcggaagcagaagcagaagcagcgggtcgacgcaggtggatgtcatcctggccggcgtggtgattggggtcctggcctttagcctgctgatgtgcatcgccgcgtgcgtgtgctgcgccaagaagaagaggaggaagaagcccccgcacatgaacatgccgtactacaccgacgagcacgggaacgtcttctacgcgaacagcatgcccaagtggcagagcagcgcgatggaccacggttggcacgcgccgtactcgcccgcaagcggtgacatgagcggctcgcacgggccggggccgggccagatgccgccctcgccggcatgccgtccctgggcttcttcaagagctcgtctcgtacgaaaagctggcggcggcgac

SEQ ID NO: 15510 - DNA, 426 bp, Zea mays
  unsure at all n locations
  Clone ID: cC-zmpo148033c09a1
gcgtccgacgacgcctcggtcttctgccaggacctccccgccgtccccaaggangccaaccgccggaagaacaagggcagctccgaggccaacggcggcgccgcgcccaaggacaccgccacggccgggccggaggagggggcggcggcgacgaccccacccgccgtggacgacgactagggatacgcgggtgatgatccaagaggctgcggcctcgtatacgaactttcggagatcaaactaacatgccgaaaagtaatctgacaattttccgcggtnagatcaagcngnggtcgacctanaaagggcacatgcatgcgggggggagtgtcacatacatacattagcactcacaggagcgggcgggctcacactaacgcctttcggtgctctgtccgtttttccaattctatgataccgagacgg

SEQ ID NO: 15511 - DNA, 389 bp, Zea mays
  unsure at all n locations
  Clone ID: cC-zmpo148033c09d1
ggccacgcgtccggtgggtgtgcacacacaaacgccattcgcnactcattttctttctctaatactattatactaagctcaattctcagaagancacgccganaccacccccaaaaatgcacatgcatacaaataaaaaatacacactccaacattaaacatacaaatcaatgaacgaaaacccacaaaccgaagaccacaataaaaaaaataaccataaaatcaaacaataagccaccaataaaggataagacaacaacatcattaaaaaccaatatactaaaccactacaacaaccctatctaatctttaaacaaaaaaaatttcacaaggacacaattcagagaggacgacccctattaattacccaaaaataaaccacaaaaaca

SEQ ID NO: 15512 - DNA, 319 bp, Zea mays
  Clone ID: cC-zmpo148033c10a1
aaaaaaaaaccagttcattacttttttttataggaaaattacagaaacgggaaaaaaattccacattccaaaggccattggagcgttgcatgtccatgcaattcaccctacagaaaaatgggcgagtcaacctcaaaagcaaagcgaactaattaaggggagtcaccaattggtaaatatcttatggcggggaggaaaaaaaccaaaacaaataccccgggaggaaggcccttgctttgggggaactattatgggaaggcgaaactcgaaaccattgtcgttgacatgcatttcaggtggtacctagaaattacatgcc

SEQ ID NO: 15513 - DNA, 572 bp, Zea mays
  unsure at all n locations
  Clone ID: cC-zmpo148033c10d1
ccacgcgtccgctgaaaacagccgagcgatctcctctccctcnctcnctccgatccattctccagcgcagcgaagtaaacatgtctgaccgggcaaagatgtcccggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgtgcagtgcaacatggtggtggaaaggctgggcgactacctgcttgaacagggcatgtaactactacgtaccagctggaatgcatgtcgacgacgatggttttcgagtttcgacttccaataatagtaacaacaaagc

SEQ ID NO: 15514 - DNA, 452 bp, Zea mays
  unsure at all n locations
  Clone ID: cC-zmpo148033c12a1
gtcgtcgctgtccttcttgtgtgttgatgacagtctcgaaggcgccgacgagggcgttgaccttgctccgacgcttctccagcagcttcgtgcgcgcctcctcgatcacgtcgttgctccgcgccacctctcggcgacgcggctgctccgactccgctcgcgcctccaacgccgtcctcacacggctgccctggaacctccgcattgcctcctccttctcgtcctcctccgcctcctgcttcttgatcgcctccttcacaaccgtcacgaacttgtccgccaccacgtcttccactgctgctacggcaacgatggcctccggcgccggcgccggcgacagagccgcttcttgcttgggcgattccaccacctcctcctcctcttngaggttgcggcggcggcggcggcgataggctccggcgccggcgacagagccgcttctttcttgggcg

SEQ ID NO: 15515 - DNA, 451 bp, Zea mays
  Clone ID: cC-zmpo148033c12d1
cggcgcgcgtccgccgcgacggcgccatgggcagcgtgcaggacgtgccgcggcagcagcgccacgatgactatcagccggagatcgtccccgagaagatcatacacgaggacgcgttgccggtcgttgctgcagagaaagagaccgtcgccgccgccgccgtctcgaaggaggaggaggtggagtcgcccaagaaaggagcggctctgtcgccggtgccggagactatcgtcatcgccaccgccgcaacctcgaaggaggaggaggaggaggaggtggagtcgcccaagaaagaagcggctctgtcgccggcgccggagcctatcgccgccgccgccgtcgcaacctcgaaggaggaggaggaggtggtggaatcgcccaagcaagaagcggctctgtcgccggcgccggcgccggaggccatcgttgccgtagcagcagtggaagacgt

SEQ ID NO: 15516 - DNA, 320 bp, Zea mays
  Clone ID: cC-zmpo148033d01a1
aatcgaattgttgaactggtccagagaaggggcaagcaatggtacaggtgtccatccctcactcgagggaaagaacaaataacagggcaccaaattaaactggtgcatcagcgataccaattcgttaaatgaaaatcaagtagaaagaggaaggaaaaaaaacaaacaaaaggaagacgaaggtgtgccactgccaccgccgtgcccaatcagagcacgcccacgcatcgggaatgcgcgggagcagcagagcagcgcagcgcagccaagtctctccccccaccttggtctcttccctccggctccgaccacgcgtccga

SEQ ID NO: 15517 - DNA, 329 bp, Zea mays
  Clone ID: cC-zmpo148033d01d1
cggggacgcgtggtcggagccggagggaagagaccaaggtggggggtgtgacttggctgcgctgcgctgctctgcggcgcccgcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaaccatc

SEQ ID NO: 15518 - DNA, 221 bp, Zea mays
  Clone ID: cC-zmpo148033d02a1
cataacgatacatacttatcataaggctacatgcatcacaaaattatgtttacacccacacccaatcctttatacaaggaccaaacaaattgaagaatgtttttttacaaattacataaggaactatacacccaaaaccttataaacacctccctaactcctggagcggtaagccaaaccccccctgtggacatccattacgatgcaacatataacctact

SEQ ID NO: 15519 - DNA, 522 bp, Zea mays
  unsure at all n locations
  Clone ID: cC-zmpo148033d02d1
actgctcatggaggtgagagggcatgggtccngtcaaagactgcagagccctggagatcattgtttacaaaaagcttggaaaacccattggacagcttattgtcatttgtggccggaacaaaacgctgagctcctcactgcaggcagttgaatggaaaataccagtaaaggttaggggatttgaaacccaaatggagaagtggatgggagcttgtgattgcattataacaaaggctgggccaggtaccattgctgaagccttgataaggggtcttcctataatccttaatgacttcatacctggacaggaagttggcaacggaccttatgttgtggacaatggtgcacgtgtgttctcgaaaagccccaaggaaactgctagtcttgttgcccgctggtttggtccagattcagaggaattgaaaaaaatgtcaaaaaaggcactgaaattggcccaaccagaagctgtctttgacattgtcaaagacatgcatgaactttaccaggaacaaggtgtcatat

SEQ ID NO: 15520 - DNA, 429 bp, Zea mays
  Clone ID: cC-zmpo148033d03a1
ccatatgtgaaagctaagtggggggacacggtgaatagaagaacgcgagaacaacaatgcggaagcccagtcatgtgtttgcttcacaaacagatgactcatttggtggttagatcctcttgggaggcctctggtgcccgtggcctgccctgggagccttgtcgagcagcagaagcagccccacgttgttgccgcactgcccaatagggaacttgacgcgggatgatttccttcgccaccacatgattgatgtaacccacttgaccactgcagcaaggagtgatggcttcttcttcaccactttcctttgcataagcaaagccgggtgccgtggtggtcgcacagtgatggtcatggccggctgtgtgttgccccctctgtaaaagctgtgctgagccactgctgccgctggaactggtggtgtcgtgt

SEQ ID NO: 15521 - DNA, 521 bp, Zea mays
  unsure at all n locations
  Clone ID: cC-zmpo148033d03d1
catgatgaggcacgcccttccgccgctacgccatgagtagatggcccacgacgccgccgagctcncagccacttatgaggctctctcgaagcgtgaggcccgcatgcgggcgctccagggccagacgccccgtcacgcctgcgccgtgccgtcggggggctccaccccacgacgcccctctgtggccacgccgcgccacccaccctcctcgctgtcccccgcggcgtcgtccggaggagggtactacccgcctctgcggtgcagcatcgaccacccgcccaccgcgtccgaagcagacgcgctcgagacaccgcgcgaccagctcaaccacctggcccaccgcgtccacctcctcgagcgcggcgcgaccccgatggccgccaccaacaccacgcccatcatccgtgtcgcgccggggtctgccttcccgcaccatgcgcgggtctactcggacgacagccttgacttgtacgatggtggcgactgctttccagatgacgattgcggcaccagcgaccggg

SEQ ID NO: 15522 - DNA, 502 bp, Zea mays
  unsure at all n locations
  Clone ID: cC-zmpo148033d04d1
ggcgacgcgtncgacgtgcctgtgcctcgctctcgccgcggccactcntgcgctggcccacggggcgcaaggaaaaggacgcatcttcatcggcggcggacctggacaacgtcacggccgagaccttcctcgacatcgagatcgacggcaagcctgcaggccggatcgtgctgggactgtttggggacaccgttcctaaaacagcagagaacttccgagcactttgcacaggggagaaaggaatggccaagtccggcaagcctctatggtacaaggggtcgacgttccacaggatcatcccggggttcatgatccagggaggcgacttcaccaacggcaacggcacggggggcgagtccatctacggcagcaccatcttctccgacgagaacttcaagcacacccacgctaaagccggtacgctgtccatggctaactacgggcccgacttcaatggctcccagttcttcatcaccacccgagacgaaaaccggttgcccaa

SEQ ID NO: 15523 - DNA, 334 bp, Zea mays
  Clone ID: cC-zmpo148033d05a1
cctcaatgttccgaccatgtattagaatgtgacggaaggcaaagattggggacaacggttgcaggatgcaaagcaagaactggagccctcgatctcaagaaactaagcagggagatctaccggttgcattgtagcagccagcccatacaagacgacgtgtgcgtggcggcagatcatctgatcagctgatcaattaagagcgctagctatcattcccttgccgttcctgcagtgtgccgcccccgcacggtcgcgcgcgggcctccgggtgcatgaggagcttgaacctgccgtcctccttgcagggctgcagcagctcctgctaccgcaggcg

SEQ ID NO: 15524 - DNA, 349 bp, Zea mays
  unsure at all n locations
  Clone ID: cC-zmpo148033d05d1
ggcgtgccgtcgcaggagctgctgcagccctgcaaggaggacggtagtttcaagctcctcatgcacccggaggccgacgcgcggtcgtgcgggggcggcacactgcacgaacggcaagggaatgatagctagcgctcttaattgatcagctgatcagatgatctgccgccacgcacacgtcgtcttgtatgggctggctgctacaatgcaaccggtagatctccctgcttagtttcttgagatcgagggctccagttcttgctttgcatcctgcaaccgttgtccacaatctttgccttccgtcaaattttaatacatggtcggaacattgaggcngaggggagagaat

SEQ ID NO: 15525 - DNA, 373 bp, Zea mays
  Clone ID: cC-zmpo148033d06a1
tatcctgtagagcgcctttctttttttttttttcatttctttttgatgggtggtgttcttattcttgagagggatcaccatgtggtgccaatcaccaataattccgctgaaacaatgggcgagaactgatctttctcatttggcgaaaagcaatgtcgtttgatgtggcacatcagaaacccataccataccatacaaaaaatttgccgagaatcatgggtaagtacatagtcaggactcagggaaagacctaattcctgcacggtgacatggccagcgaagttgtatcaccacttattagaaggcatacagcaatgcgcagatgagaagcagtaagctcgctgcattctttgagtttgtggagcttgaggct

SEQ ID NO: 15526 - DNA, 540 bp, Zea mays
  Clone ID: cC-zmpo148033d06d1
gcctatccaagttctcaacatcgcttcgtgcagcctgcttctgtcgacgagggctgcacgaacgatggcgtccgtcttcgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgcaaggtcaaggcgccgccgctcagccagtgcacaggcgtccctgcggcacctgcaccgacgccttccgacgagccagcagcggcagctgaggaagaagccgacgcagctgcagatgccccttcagcaaatggagcctcaagcttcacaaactcaaagaatgcagcgagcttact

SEQ ID NO: 15527 - DNA, 450 bp, Zea mays
  Clone ID: cC-zmpo148033d07a1
gtcgtcgctgtccttcttgtgtgtttatgacagtctcgaaggcgccgacgagggcgttgaccttgctccgacgcttctccagcagcttcgtgcgcgcctcctcgatcacgtcgttgctccgcgccacctctcggcgacgcggctgctccgactccgctcgcgcctccaacgccgtcctcacacggctgccctggaacctccgcattgcctcctccttctcgtcctcctccgcctcctgcttcttgatcgcctccttcacaaccgtcacgaacttgtccgccaccacgtcttccactgctgctacggcaacgatggcctccggcgccggcgccggcgacagagccgcttctttcttgggcgattccacctcctcctcgtccttcgaggttaaggcggcggcgatgacgataggctccggcgccggcgacagagccgcttctttcttgggcg

SEQ ID NO: 15528 - DNA, 528 bp, Zea mays
  unsure at all n locations
  Clone ID: cC-zmpo148033d07d1
ggcagcgtgcaggacgagccgcggcagcagcgccacgatgacnattaccaccccgagatcgtccccgagaagatcatacacgaggacgcgttgccggtcgttgctgcggagaaggagactgccgccgccgccgcaacctctaaggaggaggaggaggtggagtcgcccaagaaaggagcggctctgtcgccggtgccggaggctatcgtcatcgccacagccgcaacctcgaaggaggaggaggaggaggtggagtcgcccaagaaagaagcggctctgtcgccggcgccggagcctatcgtcatcgccgccgccttaacctcgaaggacgaggaggaggtggaatcgcccaagaaagaagcggctctgtcgccggcgccggcgccggaggccatcgttgccgtagcagcagtggaagacgtggtggcggacaagttcgtgacggttgtgaaagaggcgatcaagaaacangaggcggaggaggaccagaaagaggaggcaatgcggaggtttcagggcagccctgtg

SEQ ID NO: 15529 - DNA, 382 bp, Zea mays
  Clone ID: cC-zmpo148033d08a1
gcgggaagactttttttcaattgattattaatggaagcccgactacctggtagacttgtagcaattgtttcatgattactgttacaatttacaacagaccatgaccttcagcctgaattcacggaatttacaatctatccacattctcaacgatgcagcacctttcagcagccttgcaggtttttccacttgaggtacacaagccctgcgtggtagtgtgtgtaggctccggcaacaaccaaaacgtggaacaattggtggctgtgcccggggatgtcaaacttcccaggcattcagcgcttaggtacccgtgccgcatataccaatgctcccagcccgtagaagagccccatcagaatttcgtatccggtcgggtgcaatg

SEQ ID NO: 15530 - DNA, 532 bp, Zea mays
  Clone ID: cC-zmpo148033d08d1
cgcgtccggttcgttttaatcttaatccacatggattggatgggattgagtgagtttaaatccatagcaaagcaaaatttctcctaatccctcccaatcgtgggatgtgaacaaccgaacaaagccctactagtacaatgcccgtatattgtgacggcatacaaatcgtcctcatgctccccgatgcagagtcactgtgggtgatggtcgtggcgttgcctccatctctggacctcagcctggcgttgttcatgggcctaatggcggccgtgacaccgacgttgctgcagttcttgccgccaacgagcgagaagcggacctgctctggcatcttataggatttttcatctttctcgctctgaccatatacacagcaacacaagttccaaatgcagtagatatccggagcttgcagcatttgccagatgtactgagaaaggctgatattcataagattcaggcagagcttgtgtcatgtcttccgtcgttacctcacctttcagatctacaaaagctgaaagatgagctgaag

SEQ ID NO: 15531 - DNA, 228 bp, Zea mays
  unsure at all n locations
  Clone ID: cC-zmpo148033d09a1
ccccccctcccccccccaatttttcctttttctctttttgaaaaccaaaaaaacaaaacgcccccctcataaaaattcaaaaacatcctcaaaacccccccaaaaatttggccccccccaaaaaggcaaaaaaaaaaaaaaacttttttctttttcggggcaggangctttaattccttcactctgttcttccccatccctacacggctcatccctgcctacactacc

SEQ ID NO: 15532 - DNA, 421 bp, Zea mays
  unsure at all n locations
  Clone ID: cC-zmpo148033d09d1
cggaggatttcatccccgccccccccccccccaacacacacacacnttttnttaatctttccccttattatggggtcccgaattgattcggagatctcgagcgactctgcacatttcagatgagtggacatttcaattttcaagatgcagaacaaaaaaaaaaaaaaaaaaaaaaaaaaaaaaaaaaaaaacaaataaaaaaataaaactaaaaaaaaaaaaaacaaaaaaaaaaaaaaaaaaaaaaataaaaaagggggggccggttttaaaagatcaaacttaaccaccccgtgcttgagaactataaatctttttattgggggcccacaaagacatttatggggggggggataaaacagttaaaatgggaaaaaccctggcgtcaccaaaataaatgccttaggagaaaacccccttt

SEQ ID NO: 15533 - DNA, 443 bp, Zea mays
  Clone ID: cC-zmpo148033d10a1
aaaccacaatacgatgcaaatgactaggtggatttaattccataagatactcatgtgagggtccgagccgctcattaccgtgagcacagctgatataccagttttacactctgcagaggttgcacatctttacccacaagtcatgttacccatctgccaaggggtcatgaatcccatacacctctaccaaggaagcgaggcagggtaacactacgaggcctttacaaagttccactagcttcagaaaacccgctacagtttctagggagcgcaatgcaggaatcccccgtctgaccgccattgtagcaaaatcaacccaagaacctccctacacagaccactcccctactgtccttgccccttttagataaggtagtcatccagtagctttcctcattagtcagccaagggcgtcccatatcacccttgtgggagcactattt

SEQ ID NO: 15534 - DNA, 509 bp, Zea mays
  Clone ID: cC-zmpo148033d10d1
cggggacgcgtgggatgtgaccctagtttgactatctttatactccttttaccactgaacttttgggtagtacttaagattgctttatgtggttttgggtattaagatacacattattcatgatcatctttttattatcaatttgttatttactgattcatgacaagatcattatgttaattggaacatggagaaccacccgggaaaatagtgctcccacaagggtgatatgggacgcccttggctgactaatgaggaaagctactggatgactaccttatctaaaaggggcaaggacagtaggggagtggtctgtgtagggaggttcttgggttgattttgctacaatggcggtcagacgggggattcctgcattgcgctccctagaaactgtagcgggttttctgaagctagtggaactttgtaaaggcctcgtagtgttaccctgcctcgcttccttggtagaggtgtatgggaatcatgaccccttggcagatgggtaacatgac

SEQ ID NO: 15535 - DNA, 470 bp, Zea mays
  Clone ID: cC-zmpo148033d11a1
agattgcgttgtatcgtgtacttaaaggaggggatcctatcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcaggtcacctggttgttgcagcagcaggagcaggaccaggagggaagttcacccactgcagctgcagctgtatctccccgctctcgacgttcctgagccggaggatcatgtcctgcgcgaacttgccgttcctccagcacacgtggctctcgtcggcgaggcagttcctggcgctcggccgctcggacctgatgatggcgccgttcctcagactctcctccggcggttcatgctcaccgcctccatcagtggcgccacg

SEQ ID NO: 15536 - DNA, 406 bp, Zea mays
  Clone ID: cC-zmpo148033e01a1
gactgtcaagtcatctattttgagcacgggtgtgagattgttttaaatccctgaacagtcatatagaaacccaaatattgctaatcgaccatcattgctttgatagagcactgattttgatatggataataaatcatttcatttgccgattgcctagaacagtaagtcccggaaggtggggagcttgatctcgccctcggtggtgagcgggatagtgaaggcgccgatgacggggaggtcgatggtgagccctacctccagcaggtagtcgatgtcccagtcccctcccagatccttcatcagcgtcaggatgaagtcgtacggcaccttcaccggtagctccagcttggtgctgccgctcgccgcaatccacccggggtcgggcatcatgcccgacgctatcacc

SEQ ID NO: 15537 - DNA, 483 bp, Zea mays
  Clone ID: cC-zmpo148033e01d1
ccacgtcgacgttagcaacccctactcgcaccgcatttccttctgcgagatcacctacaccttcaagagcggcggcaatgtgatagcgtcgggcatgatgcccgaccccgggtggattgcggcgagcggcagcaccaagctggagctaccggtgaaggtgccgtacgacttcatcctgacgctgatgaaggatctgggaggggactgggacatcgactacctgctggaggtagggctcaccatcgacctccccgtcatcggcgccttcactatcccgctcaccaccgagggcgagatcaagctccccaccttccgggacttactgttctaggcaatcggcaaatgaaatgatttattatccatatcaaaatcagtgctctatcaaagcaatgatggtcgattagcaatatttgggtttctatataactgttcagggatttaaaacaatctcacaccggtgtgaaaatagatgacttgacagtc

SEQ ID NO: 15538 - DNA, 356 bp, Zea mays
  Clone ID: cC-zmpo148033e02a1
aaaaaggtaaaaaaaaaattttttttaccccccataaaaaaaattgtttttaaacccccattacagggattggaaggggccttcaaaaatcccctaaaaaaattttcccggccgttccaatttggttaacccccacccaacggcccttttcccttccaaaggctcccttcgcttttgttcttttaaaaaaattaattcccccccccaacaaaaaaatggattatttaaactggatcccaaaaacacaaagaaaaaacggccccttctttctttttaacccccgggggcttaaaatggggaaaagggaacccccacaacctttccaaaaaggagggcctttacggacatttttaacc

SEQ ID NO: 15539 - DNA, 557 bp, Zea mays
  unsure at all n locations
  Clone ID: cC-zmpo148033e02d1
gggcggccccccgccgttaacgggccactccatgtcatccccaatcgtancaccgccgagttccggaccttcatcaacgtcgtcttttagaaccccgagaagagcatacactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgcccttcgctgcggcaaggtcgtggggctgccgctgccgccatcctacgcccccgcgcgctaaagacgacgaaggcgccgctttcacctcgtgttctgaccattcagtctaactaatccattcctgtgctgctcggcgaataaaatcatcaaaaagaacaaaga

SEQ ID NO: 15540 - DNA, 508 bp, Zea mays
  Clone ID: cC-zmpo148033e03a1
cttctggaaaaaatgtttcacagtgctgaggcagttatgcttctattggtgaaaggaacaggagttccatgcccaacaacttctgctacaagaagaaaactggcaaaagatgatcacaaagagccctacagcctgatgctcagtcgagcaaggtcctagctctttgagaaaggggaaaagaaagagaggatggactgtaattgcatctccgaagagactgcacttaaataacaatcgactaagaggggtgagtaaactgtcggagacggtctaagaggatggctccaattgtgatggctgaaccactgaaggagccatgttctcctcagatcggctgctccagcagatgtcgctgagtgaaggtcttaggcccttgctgcagaacatctcatactccagcgtgtcgcctgccgacttcttcacctcgacgacgtgaaaggccggtgtcacctcgaagatctcggcgtcgatcgcgagctgccccttcctcccttgcttggacccctgc

SEQ ID NO: 15541 - DNA, 453 bp, Zea mays
  unsure at all n locations
  Clone ID: cC-zmpo148033e03d1
cgggcgcgtgtctaggtttcctctctcaccatagcgcccgcnncttctcccttcgttcacctctccttcctctccgcctgtcttccagggagaggggaagtcacacgcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatctacaaggagaaggtgatgcgcgtcggcatgatcgaccacatcaagcgcgacatctccgtcatgcgcctcgtccgccaccccaacgtcgtgcagctgcaccaggtgatggccagcaagagcaagatatac

SEQ ID NO: 15542 - DNA, 400 bp, Zea mays
  Clone ID: cC-zmpo148033e04a1
aaggacaacattgttaggaacaacatatagcagttttgcttacacagttacagtttttccgggagggtaacacaactccatgccaaaatcgccattgtcatgagcctcatcaaacgtaacgaaggcttttggtacacttacagccagctggacgacaaaccgagttcacggagagatagatgaaaggggggaataaccaagtcctagaaaaaaaaaaaaaaaaaatggcaaaccccaacttgagtgtgaaaatgggggagtgggtgtgtgtctctataatatatattgggggggggtcccttcctcctagttggcctttccttccccgttttggggtggcgccggttccggcggttgctcttcgggtgccatgtccggcaacgtattctgggacgggctt

SEQ ID NO: 15543 - DNA, 536 bp, Zea mays
  unsure at all n locations
  Clone ID: cC-zmpo148033e04d1
cgggcgagagtgcgtgcgtgcagccacaggcaggcgtcggcactcgtcttctttcaccggcacgcaggacaaatgacgcgtattgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacggnggctgcatcctcaccacctnctnctacgccgcgcttaacggcgtttctgtactgcaagaaccactttccgcagctgttcat

SEQ ID NO: 15544 - DNA, 311 bp, Zea mays
  Clone ID: cC-zmpo148033e06a1
aaaaaacatctcccacccaaaccaaaccatttaaaaaaacatttcttattcataatcacccccctaaaatgtaaaaaaaacccccggaggaaaaaaaaagtgcaaatttacataacctttcttttcatgtacactaaggcccacatttttttccaagaaaattcaaaaacatgacccctctgaaattaacccccacaaatttggggtttacccaaccaaccacaaccactcttttttggcataaaactgggggggggaaaaacactgataaaaacccattgctggggcaaatgcaaattggggccatcaca

SEQ ID NO: 15545 - DNA, 369 bp, Zea mays
  unsure at all n locations
  Clone ID: cC-zmpo148033e06d1
tgatggccgcagattgcaatcgccacagcaatcgtaccncttcactgcttctacctccgccagtctcatnccaagaacgagtggctgtggctggatcggtacacgccaaatatgtggcggctaatttcagaatgctcatgttcatgaatcatcatggaaatacatgtgagacctagtgtacatgagaagaaaggttatgtaaatttgcacatcttctctcctccgatgcataattatacatatgagggaggtgatgatgaataagaaatgtttattgaaatggtatggtttaggtgggagatgtatttaaaaaaaaaaaaataaataaaaggggggggggtgggaaaaaaataataaatttaaacttta

SEQ ID NO: 15546 - DNA, 306 bp, Zea mays
  Clone ID: cC-zmpo148033e07a1
aagcccagattgaaactttttgtttcatcagaagaactcccccgaggaaaataatgggagacatcgaaggttagtttgttacatggggtggccggtcgagagtgtctttcccgacctatgccaaactgtagagaattcaagtgtcgtctccttgcttgatcacagtatcacacactgaacatcaggcatcatcagccaattatattaattggcacgcatgcacggacagtccatcagctttgctgggccagcttttccttcccggccttctcggcgttcttcttcgcctccaccgtcgtcgtggtc

SEQ ID NO: 15547 - DNA, 495 bp, Zea mays
  Clone ID: cC-zmpo148033e07d1
gacatacttttcccccgccgggcaacaactcaaccgccgcatccttcacatcacccatgggcgcctgcgcagcaggcccatatacgcttgaggggcaggccccacctgaagccgccgtcttcacacccaaggttgcctcccgaggccactccaatctccgttgaggttgcggctgatgaacaggtacctgataaggtggtggtggatgagccggctgctgcggcccacgttgagcatcaaaaggctaatgaggtgctcgctccagaagctgccttctccgagcccgaccacaaggaggacagaagccgtgcacaagaccatcttccatgatgagaagccagcggcagcatcccatgcagaggaaaaggaactcaccgacgacgagaccacgacgacggcaggatgcgaagaataacgccgaggaggccgtgaaggagaaactggcgcaacaaatctgatcgactgtccctgcatgcgtgccaaataatataaatg

SEQ ID NO: 15548 - DNA, 406 bp, Zea mays
  Clone ID: cC-zmpo148033e08a1
atatattattttgtttagcaataaccgagaggagctctcatttttttgaaaaaaataatcatggtctggatccctaaaagctcagcaccgccgagtatctctgttcgatcactgtacgtaacgtacgccatatcaagaccgaccgaccggtcgcctctgcaggtacgtacgtgtcgcgtatatgtacgtacttggtttccatgccaacaaaaaaacaaaaacaaggtgcgtcacatgcttttaaatgattgaatgaatgaaagtcacacacctcgcccgaatccgatgtcgtgatcgccgaatcgccgtcgacatcagcccgcgcccggcggtgaaggtcaagaagagcattactactagtgagatcactgattccgtacagcagcactaccacctggaactagct

SEQ ID NO: 15549 - DNA, 453 bp, Zea mays
  Clone ID: cC-zmpo148033e08d1
ggcggccacgcgtccgcgctaggcagaagtactgcgtgctaagccatttccaggtggtagtgctgctgtacgggatgaaggatctcactagtagtaatgctcttcttgaccttcaccgccgggcgccggctgatgtcgacggcgattcggcgatcacgacatcggattcgggcgaggtgtgtgactttcattcattcaatcatttaaaagcatgtgacgcaccttgtttttgtttttttgatggcatggaaaccaagtacgtacatatacgcgacacgtacgtacctgcagaggcgaccggtcggtcggtcttgatatggcgtacgttacgtacagcgatcgaacagagatactcggcggtgctgagcttttagggatccagaccatgattatttttttcaaaaaaatgagagctctttctgggtattgctaaacaaaataatatatattgcc

SEQ ID NO: 15550 - DNA, 417 bp, Zea mays
  unsure at all n locations
  Clone ID: cC-zmpo148033e09a1
agcgntagaaagatttgacttccatggggggacatatgaagagagatgaatatgtgatcacaagcagagtaacaggctccgctctttaaaaaaatggctccaagaaagccatggcaatggtggactacaccttcatagcaatgaaacaggaatagttcttaggcaagttgctctcacatcatcatctctccctcggtccctccagtgtccaaggtcaacaaaaatgatcggcaaagattaactgataattccaatgcatataccctgctgcccaatagacccaacanagaaaagaatagagctacagtataaaaagaaggggcattttctgtgctcaaatggcttcaacggcagcagcagcaccacctccttcctgggctttggccgctccacagaaccatacaaaatgcaacgcga

SEQ ID NO: 15551 - DNA, 442 bp, Zea mays
  Clone ID: cC-zmpo148033e10a1
aatcaaatcgtttcagttatataacccgtaaccccataaagttacaagagcaaaccaagtgagcaaagcaaagcaacacttgcgttattggtccctcccgaccagacgagcaattaccgcacagccaactacgtgcccaccctcgacgacacggtccctggtgaactcagtagaagatcatggtagcgacagcagcggcgacaccagcgatggcagctccgcttccaagggtagcagcaccggaggcatcagcagccgccggtccctcagcaggcccatcatcggcaggggacgccacctcggcggtggatgcctacagggaagggctcaactcctcgtccgtggaagaagaccgtgtaaaggcggcggtggtcggcgcggcaactggaccagacttcctagacgacgacgacgatggggcagcggcaacggcgggggtgga

SEQ ID NO: 15552 - DNA, 467 bp, Zea mays
  Clone ID: cC-zmpo148033e10d1
acgcgtacaaacaatccttgcaccctcccctcgtcatctaccacatccggccagcccaacgaagatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccggtaaggcacctcaagccggctccacccccgccggtgccgctgccccatcgacgccgtcgtctaggaagtctggtccagcgggcgagccgaccaccgacgactctacaccgttttcttgcacggacgaggagatgagcccttccccgtcggcatccaccgccgaggtgggcgtcccctgccgctgatgggcctgctgagggaccggcggctgctgat

SEQ ID NO: 15553 - DNA, 337 bp, Zea mays
  Clone ID: cC-zmpo148033e11a1
aaaaaccaacgttgggactgatgaatccttcgttgtctaaaaatctcaggggctcaaaaacacaaaaacgataattttttaaatcttgataccatgagtcgataccgttaactaacaacatgataacccattgaaaatcaaaccaaaagaaaaagagggggagcaagggtgtttccatggatgaggggatgaccacacattatcatggttttaaagacattgctctcatttttcttccatgtcttggtccaaaattaaccgggcccacgtgtgtggcctcaattgggggagtcatcatcgtcatcctcattgcctgacaggccttacacaccctggg

SEQ ID NO: 15554 - DNA, 486 bp, Zea mays
  Clone ID: cC-zmpo148033e11d1
gcggagacaccaagcgttgaactcgcctaagcagctatcaactatccctagaaagctagacaccgtacccatgacgcaggctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacatggaagaaaaatgagagcaatgtctttaaaaccatgataatgtgtggtcatccactcatccatggatacatccttgctctccctctttttctttctgagagattttcaatgtgttatcatgttgttagttaactgtatcgactcatggtatcaagatctaaaaaattatc

SEQ ID NO: 15555 - DNA, 284 bp, Zea mays
  Clone ID: cC-zmpo148033e12a1
ataaaaaaaaccacttttttttttcctacccctaaaacccatcaaattaaattaatgaagccccctttaacaattaacaaaacccattaactagcaaggtttttttcaaaaacacttgcccatggccacctccccttttcactccccaccggaaaaatttttttttattcacaccttgggccattttttgcttttaaaacaaaaaccctctaactggaaacttcgagaaaaaaattgacttttttccttttccgggcttttttccccctttttttccggatcct

SEQ ID NO: 15556 - DNA, 505 bp, Zea mays
  unsure at all n locations
  Clone ID: cC-zmpo148033e12d1
gctgcgttgtcacccacccatcgaggttggggccgccagtagtttcagccgttcctgttcttgataaaaccnaggagggatggcagtgtttcagggagctgtcctattcttgtttctcctcctcgtcgcagcagtatggtgcatgcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgctcctaggtgtgcatgaaggaaagctttcccggtggcgagtgcaagcgggacgtggccatgcgcaagtgcttctgcaagaagccttgctagttcatcggtcttgctaattgttgatgggtgcttcattaatttgatttgatgggtctcatggctacgagaaacaaaactactttttgat

SEQ ID NO: 15557 - DNA, 386 bp, Zea mays
  Clone ID: cC-zmpo148033f01a1
ccctcccctttttttttttttttttttttttttttaaaaaaaaaaccccccccaaaaatttgggccccccccccccaaaccctttttttttcccttccctttccaaaaacaaattttaaaaccaaaaaaaaaaaatttttttttaaaccccccccaactttcaaaaaccgggggcggccttcaacaaccttcaaaaaaaaaaaaaacctcccgtgcaaaattccaaaacaaacccgggggggcggcccaaccccaacttttaaaaaacaaagccccaaatggcccccccccccccctaaaaaaacccaaccctttgggggggcccaaatttttcattatccccccttttcttggaaaaaaaaaccccggcccttcccttacccccc

SEQ ID NO: 15558 - DNA, 419 bp, Zea mays
  Clone ID: cC-zmpo148033f02a1
cttccccccctttttattttttttttttttttttttttaaaaaaaaaacccccccccaaaaaattgccaacccccccccaacccattttgcttccccttcctttttaaaaaaaacttttttaaaccaaaaaaaaaaaattttttcttaatcccccccccatttaaaaaaaacgtgggcgcccatacacaacacattaataacaaaatccccccggcaacgaatcccaaaacccaacccaggggcggggaccaaccccactttttaaacaaaaaacccccaaacggcaacctcccccccctaaaaaaccccaccccttttaaaagcccaccatttcctatataccccccattttttttaaaaaaaaaccccaataagccccttctccaccaaaacataaaaaaattctttgtgaaatttt

SEQ ID NO: 15559 - DNA, 511 bp, Zea mays
  unsure at all n locations
  Clone ID: cC-zmpo148033f02d1
gggcggtaccctcgtcgtcgtctcactcaccccgccttcacgccncctacatcaaataaggtcccgcccttttccnacgttgcagtgtgggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgttctgcttaccaggaacgtcggcatcagcgacaacc

SEQ ID NO: 15560 - DNA, 346 bp, Zea mays
  Clone ID: cC-zmpo148033f03a1
cttctctcttttttttttttttttttttttttggttgatttaaattgacttaccaaaaaaacccccccacctaaaaacatattaatccacaccatacaacgcatgtgcctaatttcaaatccataccatcaaaaattcccccaaataaaacaggaacccaatactttccaaaaacacaacccccccggtgattcgtccggatccattacaatttcacaatttgaaaaacatgaccaacctaacctttgaagaaacggccgattcgaatcttttggcccacaaacaaccatctcactgggcgcgatcccttctaaaatcaaataatgcatttcacattttggcaaat

SEQ ID NO: 15561 - DNA, 492 bp, Zea mays
  Clone ID: cC-zmpo148033f03d1
gggggcggaaccatgaacatcaacgcgaacggcggcatcctttcgtacgtgaacatggaggggtacgcccaagaatggtgtcacgggcgtggcgtgggccttctccccgtccctggagcgcttctcctgcatccacctgcacaccgccgaggacgacggcagcgacgaggaccccgacgaggccaaggaccgccccctcatcttctccggccccgacgccctccccgagtactactacagccgttccgcatcctccgtctccttcgccaagacgtgacatgcatgatctgatctgagacgggatcgcgcgcggtgccgtcgtcttctgtgcgccaaacgagccgatccggccgtctcctcataagttaggttggacatgtcttgcaaattgtgaaattgtattgtatccgcacgattccccggcgcgtttgtgttcttgccatgtcctggcctactgtctgatttgggcgtacttctcgatctgatggattt

SEQ ID NO: 15562 - DNA, 367 bp, Zea mays
  Clone ID: cC-zmpo148033f04a1
ggtcaggagcagcatcttcatgttccagctccttcttgtatatccgggggggggtctccttcttcttcttcacggtggcggcggcggcggcagcgtccttcctcgatgccgccgccaggtgctcctccttggcgacggcgtcgaggttcggcgcggagcccgtcctcgtcgcgtgaagcttcacgggctccttgggcggggccagcgcgatgaggtcgccctccgacgagcggcccgacttcttggtcaccacccactcgtacgcgctccccagctggaacagcccggagatcatcgcgttgaacttggtcacggacatggtgttctcgaacccacgcgtccgcccacgcgtccgcccacgcgtccg

SEQ ID NO: 15563 - DNA, 365 bp, Zea mays
  Clone ID: cC-zmpo148033f04d1
gggacgcgtgggcggacgcgtgggcggacgcgtgggttcgatacaccatgtccgtgaccaagttcaacgctagaatctcttggctgttccagctggggagcgcgtaccagtgggtggtgaccaagaagtcgggccgctcgtcggagggcgacctcatcgcgctggccccgcccaaggagcccgtgaagcttcacgcgacgaggacgggctccgcgccgaacctcgacgccgtcgccaaggaggagcacctggcggcggcatcgaggaaggacgctgccgccgccgtcgccaccgtgaagaagaagaaggagaagcacaaccggatatacaagaaggagctggcgctgtcgatgctgctcctgacc

SEQ ID NO: 15564 - DNA, 194 bp, Zea mays
  Clone ID: cC-zmpo148033f05a1
tttatttttttccctctttttttcactttttcctttaatttgattgttttttttatattacattaattagccccacaacaaccacccttaatgaccctgaccccattaattacacgaacaacctaccacaaacctacaacaacaaagacgtttaaaaaaccaaagctaacttaccctcaccaactgccttcatc

SEQ ID NO: 15565 - DNA, 550 bp, Zea mays
  unsure at all n locations
  Clone ID: cC-zmpo148033f05d1
cggggacgcgtgggaaaaaaaaaaaaaaaaaaaaaaaaaaaaaatanattaaaaaaaaaaaaaaaaaaaaaaaaaaaaaaaatttttttaaaaaaaatcccccctccccccccccntaaccaanctaaccttcctttctctttctttccttatacctttttctttttttttcccctaaattaaattcatttccttttcctttacatcttacctccttcaaaaacaatacctttccctacctctaattctttttcttctatatcccattttcttcttctcgcttatcattaaaaataccatcccccatccaatttcctatctttcatctttcttactttattaattaattcccccttcctttttacttttaactcattccccttcctttttttatttcctccctaacctttcccttttccttcccttacccctccccccttccttttctttccttcctttttttaccattcccagcttttctctttcaccttttttttaaattcttttcctttctttttttcctttaatcttttttttaactttaccttta

SEQ ID NO: 15566 - DNA, 392 bp, Zea mays
  Clone ID: cC-zmpo148033f06a1
aaagtaaaaatcattattacccccggcttttaccattttttttaaccccaaaaaaaacaccctcacaacacctgttgaaaagggaaaatcagtccatgatggccacaaacatgcaaaacctggaagtaaattccaagtaaaggcccaacgtccaagggaagctattttgagtccacaacggggccttttggaaccccggacaggtgcacaaaaggggcatgtgatttcagggaagcattggccccagggatctgggcctcctttgttctgttaaccaccttcctcacctcgtttgcaagctctatgaacaaatcatcttcggggctaatgctggctaatgccttctccattgaaaacaggtaatccctattatacccagtagggccattggc

SEQ ID NO: 15567 - DNA, 464 bp, Zea mays
  unsure at all n locations
  Clone ID: cC-zmpo148033f06d1
cacgcgtccgaggcaggcaggtcggcgaggagggcatgatgaccgaagaccgagccgtgcgggggctgnggacgggaacgggacaggacctcaaaatctcacatccttcctgcccgcccgcccgtgcccgtcgacgcgtcgttcttgccggccgcgccccacctgcgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctgnggaattgcatattgtgtcaagagtggtccagaaaaagagctaaaagcaatgcantacttggaga

SEQ ID NO: 15568 - DNA, 362 bp, Zea mays
  unsure at all n locations
  Clone ID: cC-zmpo148033f07a1
cggttataccacataaaaaggaaatcatatatattgcnttattataatggtagtaacagtttcaccactggacacattgcatttcaaacgaatgattttaaaaggaaatatcatatatattccatcacaagattacagaacgacttgacgcgaacacatgaattttaaatagtaatgtctacgtaataataataattaaataacacaacccgttaccatgcatgcatagatattcatagcagaccattagtactatatgggaacagcgttgcaagtgacgtcatccatgcatgcatagatgttcaacagtccatgcatgccaatgccatgcgcgcgtccgtccgtccgtccgcttattgcat

SEQ ID NO: 15569 - DNA, 332 bp, Zea mays
  Clone ID: cC-zmpo148033f07d1
aaaggatacgcatcatagctctacatatactcgactcttactacaccgtcgaggggcactgcaacgacctctttgccgccgggactgccacctctggcccattgcctgccactgacgaagacccctctgtggctaccgctaccagccctcgtatctgcggctacagggaacacaccgcaagtggtggtggagccacagtctacaccccgccgacatccttcgacagcgggcgagaggcctcctggaggaagagcagaaccatgggcttgacgccgggttcctcccgcaaatcgatggcctattacaggtagtagcatactatacaactgcca

SEQ ID NO: 15570 - DNA, 428 bp, Zea mays
  unsure at all n locations
  Clone ID: cC-zmpo148033f08a1
attatggaaacgcgtgtcagtacttagggaagaaaaaatgatcctcgtccagtacagtgtgccatgaatcaaaattcagcgttacaagatgtgtatacatgcatgcatgcatgcttgatcgatccagcagtcgatcgtcggatcagtagtagtacgccggcagccagtccttgccgttgatgaagtcgatggtgaggtacttggccgcgtcgtcgggagagaacctccgcgaccatggcacgcggttcgtcacgtcagcgcccggcccagtgcagttgaactccgcgagcgtcaccttgtcggtgctgccgctgtagcctatggttgtccagccggccgggtggatggtcttggagaggtaggtgtcggcgaagatgacgcgcgagtcccgcgcggtgacgcggnccaagtacaccttcccgacgccg

SEQ ID NO: 15571 - DNA, 524 bp, Zea mays
  Clone ID: cC-zmpo148033f08d1
ggaaaccccgggggcccaccaaccgtgtcaagcgccggccgccactactagagagctgcacatccagggcacatcggggtcatcttggagcggccaggccatcttccactgccccgagatcttcggaggcctgaccggcggacggacatccgcggctccatcaccgcgcacgtgcggcaggaggaggacagcagcggcttcgtcttcctcaagggcaaggtgtacggcgtcggggaggtgtacctgggccgcgtcaccgcgccggactcgcgcgtcatctgggccgacacctacctatccaagaccatccacccagccggctggacaaccattggctacagaggcagcaccgacaatgtgacgctcgcggagttcaactgcactgggccgggcgctgacgtgacgaaccgcgtgccatggtcgcgggggttttattccgacgacgcggacaagtacctcaccatcgactttatcaacggccaggactggctgccggcgtactactactgatccgacgatcgact

SEQ ID NO: 15572 - DNA, 450 bp, Zea mays
  unsure at all n locations
  Clone ID: cC-zmpo148033f09a1
aagcaaaaaatatggtatattagatgtggatttgatgcaaaaaaatcagatcagcaatacatcatactgtttggtgcaaagatttggcatctcatgtcggttcattttaacagttccacaatgcaaaatccatcacatgtacatctacataataagtgatacgaaatatacaggggcatcagtgaaaatcaatgctcgtatgggtgactgacaagaggtctcctctactatgtatttcatcatggcattgtttgttgtcccatgcaactatcaaccatcataatcataatttgtctcgatgcttgctttangagttagcactaacccagctgaaaggtcttcggatagctcgttggttcaatgtgaagcttaacccaaacatttccttgatggcttgccccttctcagatgttctaccaattntatgacaagagcggcactttccctcac

SEQ ID NO: 15573 - DNA, 587 bp, Zea mays
  Clone ID: cC-zmpo148033f09d1
ctagagggcaatcaggacaacgttactgcagaaatcactgacatgaaacatgcaaaaaatattgacagaagtatatttgtggccaatattgactccccttcacggtggcctattaattttgagaaaaaacagaaagaaatcattgagttatggcatgaatgcaatgtctctatagtacacagaacatatttcttcctcctcttcaaaggagtcaaagcagacaatatttatttggaagtggagcacagaagattgtccttcattcacagttctttcattgccggatgtgagcctaatgttactgttacatcaagcttgagaaatcttcggcatgaaagagacatgctctacaagcaaatgctgaggagactccatcttctagaaagagagagcctttatagcaaatggggaattgatctgaatgctaaacaacgaaggctgcaactatcttgccgcatctggacacagactgacatggaacatgtgagggaaagtgccgatcttgtcataaaattggtagaacatctggagaaggcgcaagccatcaaggacatgtttgggttaagcttcacattgaaccaacgagc

SEQ ID NO: 15574 - DNA, 385 bp, Zea mays
  Clone ID: cC-zmpo148033f10a1
gaccacaaatcaacattagcgtgatggaatgggattacagatatacactaccataatgaataagttccaagattgtgaggcgtcggtctaataataattacatcggttggttttgtgatgatccaaagaagaaagaaaatacaaaccagcggatttatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaggttgtt

SEQ ID NO: 15575 - DNA, 468 bp, Zea mays
  Clone ID: cC-zmpo148033f10d1
ccacgcgtccgaaggtggccgtcaacgacgtcgtcttttataacatccacggcacctccaacacgccggaagccattacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataaatccgctggtttgcatgttctttcttctttggatcatcacaaaaccaaccgatgtaattattattagaccgacgcctcacaatcttggaacttattcattatgctagtgtatatctgtaatcccattccataatgttaatgttga

SEQ ID NO: 15576 - DNA, 424 bp, Zea mays
  Clone ID: cC-zmpo148033f11a1
tcctctacagccgccctccttttttttttttttcaatagttataaatcaagcttcacttctgagcacgaatttttttatgaacattcttacaaaatcccacatacaggccataataatgcttgccttgaacaaacaatgaagaactcttatcctgtccgctataaaaaaaaccacaaatgttacatgcttctatgatcaaacctaaaaatgacacgtacaatttcctcacctaaaactgacatatttttgacacttttaaaatttacaccttaacttgcatgtccccttttaaatattcattcaattctaaattatactccggcacctgaactttgaagaggcttgaatcactcctcttaaacattctttacaaaaatgccaccccttaaattgacacaccattatatataacctttatccaaa

SEQ ID NO: 15577 - DNA, 389 bp, Zea mays
  Clone ID: cC-zmpo148033f11d1
actaccgcgtacaacaacaccacacgcaaataagtaatacacaaaccacctcaaacctcaaaagctatttttttaaaaaactccggccgcacacccaccctaaattccacacttaagtttcacacaaaatcagacataacaagaaataatcctgcaaaaaacccatcgcctttacataaaaagctcactgcaccctaaactacactaaccaataacaacctaactaaaacaaataaaaatcccaacttaaaaactctaccaaacaaatcatcaccacacttgaaacataaacctcagaaaaaaccaacaatcaccaaagtccctattacaagataaaacatgtgaaacacctatctacaaaccttgacacattttgccgtaatgacaca

SEQ ID NO: 15578 - DNA, 383 bp, Zea mays
  Clone ID: cC-zmpo148033f12a1
tttttttttttttctctttttcttttttttttttttttttttgtgggttttttttttttttttcccccttttcccccctttatttttttttttttttttttttccttttaaaaaaaaaaccaccccagggcccccctttttttttttttaaaaacaccccccattttaaaaaaccccccccccaaaaaatttaaaaaaaaccacccctcccaaaaaaaaaaaccccccccccccccttaaaagggtttttcaacaaaaaaaaacccaaaacaccccccccaatggggggaaacccaactttttccaaaaaaaaaagggccccaatgccccaaaaaaaacccaaagcccccccgccccaaaaataaacccctcttttttttccg

SEQ ID NO: 15579 - DNA, 543 bp, Zea mays
  Clone ID: cC-zmpo148033f12d1
gggagaaccaccccggcggcacgcgtccgcgaacatctatgggatggcggtgatggctcgtggtgtgtactgcgcgagcaggtatgcaggtgagattggcaaccgccgtgatgtggtgaaaatggaagtcgaggacctgacggccggactggccagcggcaggatatgtgctgtggagaacatcgcccagctggtggctccggaggcagaaggcccggccgatgccacggccacggccacgctggctgcttaacggaccattgtgccattgttgctgtgagagagatgtgcgtcagccaacatgtgtgctattgctttggcttatttgtgttcagaatccacttaaactcggtcgaagtgagctttccgttcggcaacgtctgtactcttacgaatctcgatcgtgtatgtctttaagtattgcgttgtgtttcaaagataaaaaaaaggtgacctttgtgtatgattttttaaaaaaaaaaagttaccttaaatttttatttttatcaaattaaattcttttcttttttaaaattttttcct

SEQ ID NO: 15580 - DNA, 445 bp, Zea mays
  Clone ID: cC-zmpo148033g01a1
gacgggggccgaaatcccaacccgtgcccggtgctgcgatgcagtaagcagtaggagtacttaactattttcagagaagaagaaaaagaacaacggttcttttttgcgaaacactttgcacaaacacacacaacccccttccttttcccgcaaccttattttacatgccatggatgatcttattttcggaccctttttaccaccaccggttccagacacctactacaagcatatataatactccgtacctgcttggctgctgcacaccagagctcgaacagaagcgcgttcctcataccttgggttcgggggcttctcttctgctactctcaaaactggcaagacgtgcccagccttggcattaagcgctggccgacgacaccggaagcgtgctttcgggcgctcagggcacctgggagcagctcctggaacttgtcgaggaatg

SEQ ID NO: 15581 - DNA, 644 bp, Zea mays
  unsure at all n locations
  Clone ID: cC-zmpo148033g01d1
gggcggctggtcaagataacacacaccatcttcaacgtgaacgattgttttggctgcaaaagtaaagtgttctgcagcgggtcataggctgtgagcaagattgcatcgctgcaggagttcattcctcatgatttcgacgccagtgaccatgggacctcaagcttccctgtatctgcagtgcataggattggcatccttgacattagaatcttcaacactgacaggcatgctggaaatcttctggtcaagaagcttggtcctggcgccgacaattttggagagcagacagaactcattcctattgaccatggtctctgtcttccagaatgcctagaagacccatacttcgagtggatccactggccgcaggcatctgtccccttctccgaggaggagcttgagtacattgcaagacttgatcctgtaaaagatgcagaaatgctacgcatggagctacccatgatacgagacgcatgtctcagggtgctggtgctatcaacagtatttctcaaggaagctgcagcgtctggcctctgcctctcggagattggagacatgatgagcangcagttcactgcgaaggaggaggaaccgagtcagcttgagctgctctgcatgggaggcaggcagtgcgttgaggaaag

SEQ ID NO: 15582 - DNA, 549 bp, Zea mays
  Clone ID: cC-zmpo148033g02a1
gtgttccagaactgcttcttgttcctccgccggcccatggacaaccagcgggacatcgccacggcgcagggccgcgcggacgggcgcgagagcacgggcttcgtcttccagtactgccgcttcaccgccgagacggggctcaaggacgcgtcccgcccgcccatccggagctacctcgcccgcccctggcgcgagttctcgcgcacgctcatcatggagtccgacatccccgcgttcatcgacaaggccgggtacctgccgtggaatggcgacttcgggctcaagacgctgtggtacgccgagtacgccaaccgggggcccggcgccgacaccgccggccgcgtcacatggcccggctacaagaaggtgatcagcaaggaggaggccgaaaagttcaccgtgcagaacttcttgcacgccgagccgtggctcaagcccaccgggacacctgtcaagtacggcttctgggcgtgagcacatattctcgtggagaccagaggatgtcgatgaagcagaggaagtcatctatgcctagttggcctatgcatg

SEQ ID NO: 15583 - DNA, 558 bp, Zea mays
  Clone ID: cC-zmpo148033g02d1
gagcgggcgtcttttttttttttttttactagcataatagtccttgatttccgattcacaaatacgacatgtctggcggcatccaaatcagtacaaacaagtgttcaggtgacacactgtacatggattatggtcatatcaactcagcaccttatctcgtccgtccgtggatgaacatgctcccaacaatggacgattagtgatttaccaccatgcataggcaaactaggcatagatgacttcctctgcttcatcgacatcctctggtctccacaagaatatgtgctcacgcccagaagccgtacttgacaggtgtcccggtgggcttgagccacggctcggcgtgcaagaagttctgcacggtgaacttttcggcctcctccttgctgatcaccttcttgtagccgggccatgtgacgcggccggcggtgtcggcgccgggcccccggttggcgtactcggcgtaccacagcgtcttgagcccgaagtcgccattccacggcaggtacccggccttgtcgatgaacgcggggatgtcggactccatgatgagcgtgc

SEQ ID NO: 15584 - DNA, 170 bp, Zea mays
  Clone ID: cC-zmpo148033g03d1
tcaccaagtacaccaacacgctcagctgtctcttcagcaggaagtgctagtgcccccgcagctctaggctgcagctttcatcattggcgatcgatcgtaacaatgcaaggttgtgttgtatataactcttgtgtttggaatgccgcccgtaattaatggtcaactctaac

SEQ ID NO: 15585 - DNA, 560 bp, Zea mays
  unsure at all n locations
  Clone ID: cC-zmpo148033g04a1
cgtgtacttaaaaaacaggatcctatcgggtggcttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcaggtcacctggttgttgcagcagcaggagcaggaccaggagggaagttcacccactgcagctgcagctgtatctccccgctctcgacgttcctgagccggaggatcatgtcctgcgcgaacttgccgttcctccagcacacgtggctctcgtcggcgaggcagttcctggcgctcggccgctcggacctgatgatggcgccgttcctcagactctcctcccgcgggttcatgctcaccgcctccatcagtggcgccacgtccacctncgcgtctnccatggngtcgtctctgctgaaggtgtccctgtcgaacacctcctgtagcatacagtctagaataatgaatcacaaacaggatcgtt

SEQ ID NO: 15586 - DNA, 431 bp, Zea mays
  Clone ID: cC-zmpo148033g05a1
attctcgaaaacaagaaatacatagggttggtatattacttcatgcaaggaaaacatgtggtgaaagacaaatcagaacaacgattcacagtcatttcatagtatgataacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggccgtccggcatgccgcgccccgcgcaagtgtcgtcccggcagttgtgcgtcttggtgcacatgacgcgggtgtcggcccaacagtcctcggattggacgggcaggacaaagcctgtg

SEQ ID NO: 15587 - DNA, 563 bp, Zea mays
  unsure at all n locations
  Clone ID: cC-zmpo148033g05d1
gcggggacgccgtgggcgcgtgcgtaccattaatctaagccgatcttcattctcagccttcnntgctctgctccctcgaagggggangcgacttagcaagggcgatgcgcttcagtgcctccctcgttctgcgtgcttctcatcaacacnaggctttgtnncctgcccgtcccattccgaggacctgctgggccgacactccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgctgtttaaggcataatatataaactgccaaattcacatgtattttgggatatttgttatcatactatgaaatgactgtgaatccgtgttctgatttggctttcaccacatgtttttccttgcatgaagtaatatacgaaatttat

SEQ ID NO: 15588 - DNA, 183 bp, Zea mays
  Clone ID: cC-zmpo148033g06a1
gggtgtggttttttttgaccaaaatggtaccccatcccccgtttatataccaacccaagcatacaatggaattcctgatgaactgggcaggaaccccatcatttgctacaaaaagcaaaggaaattccttttgaaattggcccccatcgaaaatacccaatggataataatcggccgaacact

SEQ ID NO: 15589 - DNA, 161 bp, Zea mays
  unsure at all n locations
  Clone ID: cC-zmpo148033g06d1
cgggcgattattaaccattggctatcttcgatcggggccaanttcagaaggaatttcctttactttctgtagcaagtnatcgggttcctgcacagttcatcaggaattccattgtatgctcgtgttggtatatatacgtacgatggggtaccattctggtc

SEQ ID NO: 15590 - DNA, 481 bp, Zea mays
  Clone ID: cC-zmpo148033g07a1
gaaccactgaatatggattggggggatctggttaatatatacagggattggactaaatgcctgtcctatccgaacagcgctactcgtttacacatcagagcagctcgtctacaggcaattctgcttcccaggttcattcattaataatgtggtgaatggctaccgaatcatgttctgatgatggcaacacaggcgcctctgtaggccagcagtggagggagtttaggccgaggtaccgccaagctgtgtggccatgcgaaccatttttatcatccagccacaagggcccgttgatccgaactaatgaagccactgcatgctggatgttgacatatatacaggtgacgtggacaccgctcggtgctttggtgatcatgacgcgcctaccgccatttctggtggtttctcttgtgcctcatccttgcccagcaatgctggtgtgactgaaacaacaccgatcaggaatagcagtactatcgac

SEQ ID NO: 15591 - DNA, 550 bp, Zea mays
  unsure at all n locations
  Clone ID: cC-zmpo148033g07d1
tgcggcggtttttgagaggggaaagaggaggcggaggagagggtangtgggagggacgagaggttcccggtgtgggaagccgcgctcggcgccggaatcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgcttgctggtgctctgtttgggcaactgcgtggccttgcgctggtggtctttgctgccactgcaggtgcttcttcgtgctatttcctgtcgaagatgattgggaagccactggtgttcacactgtggccagataagctcagcttctttcagagacaggtttgctaaaagaagagagaagttgtttgaataacatgcttttcctcagggtgaccccaacattgccaaatac

SEQ ID NO: 15592 - DNA, 502 bp, Zea mays
  unsure at all n locations
  Clone ID: cC-zmpo148033g08a1
tgaaaacgcattggtttttttatgcatgcaaccacatggtgagacgatgatgatcgtgtttgtgccgcgtgtacgcacgttcgtgttcgtcctattcgaaggtgaagtcccatgtcgcaccacggtggaggtcctgtcccggagggcagtgccccagcgaggagacgtcgccgtcgctcccggcgccatgggctggcagcatcctggacccatccggctcacggtaggagagcgcgggcatggaggagaccttgaccatactcgggttgggccgcagcaggtgttcgtcgccgatcagcatcgactgatccagcagcccgccgctgctggaggtgtcgaattggttcgaatgtagctccgcctgcgttctggcggttggcagtggcggcaggcgagaggagacgatgtcgccgaaagccgccgcgctgccgtcctggtggaacgacggctgctgactgccgcgangtggtggaacacctgcatctggttcagaagcgggtag

SEQ ID NO: 15593 - DNA, 575 bp, Zea mays
  unsure at all n locations
  Clone ID: cC-zmpo148033g08d1
gtgcggccacgcgtccgtgcggcaagagctgccgtctccggtgggctaaccacctccgccccaacctccgcaagtncgccttctcccccgaggaggagcgtcagatccttctcctccacggcctcatcggcaacaagtgggcgcgcatctccaagcacctctcagggaggacggacaacgagatcaagaactactggaacacgcgcttcaagcgccggcagcgcgcgggcctgccgccctacccgccggacgtcgagcggcagatcaagctgctgcgcgcgcagaacgtcaacccgttcgcagacgcagacgccgacgccgcccacgccaacgccaacgccaacgccaacgccagcgccggccttccggcgccgccgctcctctacgacgtcggaaacccgttcgcgttgctctccagcataccgtcactgtcgcagacggcctcgcactcgcactcgccactgatcaaccagaactacccgcttctgaaccagatgcaggtgttccaccacctcggcggcagtcagcagccgtccgtccaccaggacggcagcgcggcggcttttggcgacatc

SEQ ID NO: 15594 - DNA, 437 bp, Zea mays
  Clone ID: cC-zmpo148033g09a1
gatcctacaacacttgagtgacttggcggggatttcatgctgtccccaactgtacattaataggcaacacatgaactaccctgactgacccagaccccattaagtttacaatccgacattcacaagaggtgaaaatgcgattgcttcgtgtcgcctgttcttccttccttcacctgctggctgcagcaggagggatgctgacccactgcagctgcagctgaatctccccgctctccacgttcctgaggcggaggatcatgtcctgcgcgaacttgccgttcctccagcacacgtggctctcgtcggcgaggcagttcgtggcgctcggccgcaccgacaggatgatggcgccgttcctcaggctcgcctccgggctcgcgttcgccgcctccaccagcggcgccacgttcgatctccgcgtcccccattcgggtcgt

SEQ ID NO: 15595 - DNA, 567 bp, Zea mays
  unsure at all n locations
  Clone ID: cC-zmpo148033g09d1
cggaaagaagtcgcctaattctttcgatcgaattaggcgccnttttcgtcccacgctccgtctttatttgtaatcgtngagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggctagtttcgcgcaggacatgatcctccggcttaggaacgtggagagcggggagattcagctgca

SEQ ID NO: 15596 - DNA, 329 bp, Zea mays
  Clone ID: cC-zmpo148033g11a1
ataaagatgttttttaaaaaaaatctacacaaaaaccctctttccctttataaaaattattaccaaatggaggcattcaccaaataaaccttaaaactcatcccaaaccgacaaaatcaataattcattgtactttcacactctctcccctcttggcatttgcgaaaagaacaatacctaccattgatcatttcacctagtttttacaacaacaggaaccttataaccaaacatccataatcaatttgcctacattgcttaaattcccgatatcaacgatcctgaaacagatgatcatgttcttaaccaaccttccctttctacaaaca

SEQ ID NO: 15597 - DNA, 444 bp, Zea mays
  unsure at all n locations
  Clone ID: cC-zmpo148033g11d1
ggcggactattgtcgctccctgccattagaagacaggccaganaatacttcaatgaagaagctctttcgtgagatagttattctttaaggataccaatttgattacccctttgactggactgcactcaagtaccctcaaatgggcttcaacaacaagcttgttcaacaaccaagtgcaagaatggctggagttggaccatcagttgagagaacagacaaagcttccagtatgtctcctgtgggacaagagatccgggataggttcactggtgctgttgaggcattcgccagaagaaatccatgctctgggcgccctgcatatcattccagtcattccaggcggagaagctttgcacattcctttggaacgtccaacgaagcagttgccgactcaatatagaaaacgcgcattttgtcccggggagggagctcgttgaaaatgcc

SEQ ID NO: 15598 - DNA, 509 bp, Zea mays
  Clone ID: cC-zmpo148033g12a1
gattcaagcactctgatacattttttatttgccgtttcttccttttctttccgtagatactgctatccatgccatgcgttcgctctgtatcgttgtagttttgtgcagcatgtccgcgacgccgccgtggtatagtttactggtcgtcgtcgtcgtccgagtccagctgcttgagcagcgcggcgcagacggggagcggcacgtccttgaagtagcctagcgggttggcggggcgcaggctgtcggagatgccaacgttcctggtgagcaggacgccggcgcggtccctgagcgcctggacctcgtcgcagtccttgcgcgggctggccaccagcaccacctggcagatgtcctcctcgtggctgtccttgactcgatcgtgtaggtgccggtcgcgtcggtgaccccgtcgatggcgcgctcgagcttgccggtgccgaagtgcttgcactccagcctcaccttggcgcccgcgatgtactcggtgacgttggtcacgaacccggcgc

SEQ ID NO: 15599 - DNA, 499 bp, Zea mays
  unsure at all n locations
  Clone ID: cC-zmpo148033g12d1
gggcggtccctccctcacacaaataataaggaaaggtcccgccccnttcctccgacatccacaaggggggaggggagaagacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgttctgctcaccaggaacgt

SEQ ID NO: 15600 - DNA, 250 bp, Zea mays
  Clone ID: cC-zmpo148033h01a1
ctctcaagcatgccctttattcatcgaatgaaggggacaaaaaattaccgcaaatgcttatttgcgtgacgttacattaattgggctgctatatatgtgtatgaagcagtcgacgaaactatacatcgtcggtcatcaaattggtaggtatacccatgcatgcatgcatcaaatcgtcatcgcatcccatgcatgcatgtatatatgatgtatcagtgattcagtgtcacgcaagcaggcagaagacgac

SEQ ID NO: 15601 - DNA, 256 bp, Zea mays
  Clone ID: cC-zmpo148033h01d1
gggcggtcgtcttctgcctgcttgcgtgacactgaatcactgatacatcttatatacatgcatgcatgggatgcgggggcgatttgatgcatgcatgcatgggtatacctaccaatttgatgaccgacgatgtatagtttcgtcgactgcttcatacacatatatagcagcccaattaatgtaacgtcacgcaaataagcatttgcggtaattttttgtctcgttgattcgatgaataaagggcatgcttgagagt

SEQ ID NO: 15602 - DNA, 316 bp, Zea mays
  Clone ID: cC-zmpo148033h02a1
gttatcactgcaatctgatgggtggtggggtgggtcttgataatgatcaccatgtggtgccaatcaccaataattccgctgaaacaatgggcgagaactgatctttctcatttggcgaaaagcaatgttgtttgatgtggcacatcagaaacccataccataccatacaaaaaatttgccgagaatcatgggtaagtacatagtcaggactcagggaaagacctaattcctgcacggtgacatggccagcgaagttgtatcaccacttattagaaggcatacagcaatgcgcagatgagaagcagtaagctcgctg

SEQ ID NO: 15603 - DNA, 313 bp, Zea mays
  unsure at all n locations
  Clone ID: cC-zmpo148033h02d1
cgagcttactgcttctcatctgcgcattgctgnatgcactcnattaagtggtgatacaacttcgctgacgatntctccttgcaggaattaggtctttccctcagtcctgactatgtacttacccatgattctcggcaaattttttgtatggtatggtatgggtttctgatgtgccacatcaaacaacattgcttttcgccaaatgagaaagatcagttctcgcccattgtttcagcggaattattggtgattggcaccacatggtgatcattatcaagaataagaacaccacccatcagattgcagtgaactc

SEQ ID NO: 15604 - DNA, 465 bp, Zea mays
  unsure at all n locations
  Clone ID: cC-zmpo148033h03a1
aaattgccaaattttggttagtggattgcatgggggctggggcatcctttacatctgtctatgtctaagtcatgtattctattggaatagtaaattttacttccagagcaaaggacaatgccagagggcttgctagttgacgaagtttgtcaagcatgcaactggtatatgtgatctccttcaacccttatttccaccagatccagtaatcctgcttttgcgttgtctttgatgctgtttagttgaggttgagggtgtggtacttcagtcagtaattgctgcttggaaactactttcttgtttcataaagtatctttgcacagtttttgactgaggctgctgaaattctctgttgagtaacgtctagaggcgttcctccagtccgatccacttttcatcatcaattcaaactctgggtaactgatgcgaccatccttatcctngtcaacctcttgaataatgtcg

SEQ ID NO: 15605 - DNA, 555 bp, Zea mays
  unsure at all n locations
  Clone ID: cC-zmpo148033h03d1
tgcggcacgcgtccgagcggctgctcctgcgcctcgccgggcttgtcgcgaccgacgtgcagcgcgaggtggggatgacgctattcatgtctntcgtgaccggacgcccggatgcgtgccctccagaggcatacgacgactaccaccttgtgcacgccgtcatggagctctgcgagggcagggagctctttgaccgcatcttcgagcggaagcactactccgagcgcgccgccgccaagctcgcccgcaccatcgtcgaggtcgtgcagctgtgccacgagaacggagtgatgcacagggacctgaagccggagaacttcctgttcgtgaacaagtcggaggagtcacctctcaaggccatcgacttcggcctctccgtgttcttcaagcctggagatcggttcaccgaagtggttggcagcgggtgttacatggctccagaggttctcaagagaagctatgggccagagatagacgtgtggagcgcttgtgtcatcctgcacatccttcttgcgggttccctccgttttggggaggcttcgatgagaaaattgc

SEQ ID NO: 15606 - DNA, 55 bp, Zea mays
  Clone ID: cC-zmpo148033h04a1
accccccccttaacaaacccctggccacacccctgggccaacccctggcccaacc

SEQ ID NO: 15607 - DNA, 392 bp, Zea mays
  Clone ID: cC-zmpo148033h05a1
ggttggggtttttttttttttttttttttttttttaaccaaaacccaagtttcccttggaaaaaaaattaccaaggttccatgggcaaaaaatccattcatccttcccaacacaacaacaaaaaaatttaaaaaaaccaacgttgtccaaaaaaaacttcactccaaacccatgggccctggcacggcccccataaaaaatgggtgaacaggaacattaccaagccccgggaaaagtcccactgctcatttattggccccaaaaaaatgggttacccaaaacccaaacaaaactttttaaaaaccatgtttttgcccccatccacccccttaaaaggccttttcacccgaacctttgggaaacccatttcaaccaagttttggacctttttt

SEQ ID NO: 15608 - DNA, 572 bp, Zea mays
  Clone ID: cC-zmpo148033h05d1
cggccacgcgtccggctgcgaggagagccaggaggaagtgattgtggcgccgcgaggaaggagggatcgatcggagatggtggacgtctcgcgcgtgcagaaggagctcaccgagtgcaaccgcgaccgggaggtatcgggcgtctccatcgcgctccacgacggcgccaacatctcccacctcaccggcaccatcgccgggcccgccgacagcccctacgagggcggcacgttcgtcatcgatatccgcctgcccggtggatatccctttgagcctccgaagatgcagttcatcaccaaagcaccctaacatcagcagccaaaatggagcaatttgcttggacattctgaaagatcagtggagcccagcccttaccttgaagactgcgctcctttcccttcaagctctgctttcttctcctgcacctgatgatcctcaggatgctggttgttgcacaacagtacctgcgtgactatccaacatttgccgctacggctcgctactggacagaagccttcgcgaagagtgcatcaacgggcatggaagaagaagtgcagaagctggttgagat

SEQ ID NO: 15609 - DNA, 336 bp, Zea mays
  unsure at all n locations
  Clone ID: cC-zmpo148033h06a1
aaataaatngcctccgaaaatggcatgtatatttgagcattttgcttgttttccactctttggaattcggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctagtagaattggacgttggaagtgtagacggcatcaggtctccagttcggcgggatgacgtctttggcgatgaccttcttg

SEQ ID NO: 15610 - DNA, 607 bp, Zea mays
  Clone ID: cC-zmpo148033h06d1
cggggacgcgtggggcgacatttcgaataacacagttgagcttgtcgatgggatccctcgctaataacatcagtagcgggggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcggcatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaacggtgcgatgcaagtaccccgccgggcagaagatcgggttccacatcgagaaaggctgcaaccccaactacctggccgg

SEQ ID NO: 15611 - DNA, 378 bp, Zea mays
  Clone ID: cC-zmpo148033h07a1
aaacaaaattaactcaaattcttgtttacctttttaaaatttatgggcaaatggggggattctgcaataacaccttaaaacttgtgccaaatcgacagaatcaaaattgcattgtactttggagttgtcttcccttttggagtttggggagagcgttatactataccctggggtttggggaaagggtgcattttcatggcagccttgtaaccatccatccattatttatttgccgatttgctttaactgcagagagcaaggatcccgcaaaagttccttggcctaataaccgccttccactttaaaaattcgtgggggtggtccttggcagctcacttcctcctgctgggggtgatggggaggccctcgaggctgcgg

SEQ ID NO: 15612 - DNA, 644 bp, Zea mays
  unsure at all n locations
  Clone ID: cC-zmpo148033h07d1
tgtcgcttccgctgcgcatnnttgaagacccaggccacgattnattttcttcannatgaagaaaagctcctttcgtcgatgctagtttatatcgttggaaggggataccacattgtgcattaccgtcactttgactgggnnactgcactcacagtactcctttcataatgggcttcnncaacaacnnaagctctgttcaacaaaaccacagtgcaagaaatgtgctggcacgttggacccaaatcacgttgagaagaaacanngacaaagnnncttccagtactgtnnctcctggtgggaacaagacgaatccgggatacggttcaactggtgctctgttgaggcannttcgccagaagaaaatccagtgctctgggnncgccctgcacgatcaattcnncagtcattccgaggcagcaaagagctttgcagaattccctttggaaccgtccaaaacgaagcacgttgctcgacttcatcagaagaaaaacgcgcatnctctgtcccgggggagggggagctcgtcgaaaaatggcccgcagcttccgttccaacccggccccgacctctttcggggggacttggcagtgaccaagaaccgcccggttggggtctttcggcaagcaagtggcggcaagcggggc

SEQ ID NO: 15613 - DNA, 388 bp, Zea mays
  Clone ID: cC-zmpo148033h08a1
aacctgaaatttctttgtttcgttgatcctttttaagttctacttcatcttgtaaggcaaaaaatgaaatggcgaagtggcccaaacaaatgggaacaaaagggacaggggtccaaccccatcccgggggaaaaaacaaataagcgggccccaaatcaaacgggtggagcccgggctccaactcgtgaaaagaaaagctgacgacaagggggagggaaaaaacactaacaaaggggaggcaaaggggtccctctatcaccaccaatgccaaccaaatcacccccacgcctggggaaggcccgggaacaacaaaagagctcaggacagcaaacgtttccccccacctagggtttttgggacgcgcgggggtgcccgggaattgccgacc

SEQ ID NO: 15614 - DNA, 377 bp, Zea mays
  Clone ID: cC-zmpo148033h08d1
agagaccaggtggggggagagacttggctgcgctgcgcatcactgctgctcccgcgcattcccgatgcctgaacgtgctctgattgggcacggcggtggcaccgtcacaccttcgtcttcctttcgtttgtttctttttccttcctctttctacttgattttcatttaacgaattggtatcgctgatgcaccagtttactttggtgccctgttattcgttctttccctcgagtgagggatcgacacctgtaccattgcttgccatttgtctggaccacctcaacaattggatttaaccatcatgctcgacaagccggacaaagccaaagaggcctagggccggttatactaacttctctgagaggaaccacaaagac

SEQ ID NO: 15615 - DNA, 504 bp, Zea mays
  Clone ID: cC-zmpo148033h10a1
gttgaagagagatgtcccaggcgttcatacgggggtaggacaaccaatttgtcgtgaatttgagctaaaaaatgtaatttacatttgatctctctctctgctctaccgctacagcagcaggcacaagacgcagactgcttaggggtcacaaggcttacagttacatccccacgaacaaataggaagcggtctgtgcccggtacgcctgacaaataagtgttacacccttgtccaactacaggcttgttcggttagctctcaatccatgtgaattgaatgagattggatgtgtttgaatcgcaaacaagttaaacttcttcttaattttttccaatctcatccaatccatatgtattagaaataaccgaacaggatttgttgtcacctgtgtgttcttctgctaacccgtttacaacagcgcgacagagacgacgaatttggtcaatatgatgaaagaaggcgtgtcatttgagcgatggatcaatctcggtgtgagaagggatg

SEQ ID NO: 15616 - DNA, 561 bp, Zea mays
  Clone ID: cC-zmpo148033h10d1
cggcagcgctcagttacgatttccataccgacacattccgtgcatggtacccaccacacggtcgacgaaccggccggttggattatggcgtgcaatgggacagggtgagggcaccgcctgttgacacccttgcgcatgacctgcacacctctgactgcctgcatgagctccggcccggcgaccacatcgagattcagtggagaaggaacaaagaattcccatacggctggtggtatggagttgttgggcacttggagtcatgtgatggaagcgaacacttttgtcggtgccatcttagtgataccgtggtgctggagtttaatcagtacacgccgggctcaaggtggaggcaagcgttggtgaagcggaagggcatagggaggagggcaacgagggcgacgggttctacggcggcataaggaagctccgcggcaaggatgacatcttcaagtggaggcagctgtggccaacagacgtcctgcagtaagcaggagccgcatcccttctcacaccgagattgatccatcgctcaaatgacacgcctttcttttatcatattga

SEQ ID NO: 15617 - DNA, 423 bp, Zea mays
  Clone ID: cC-zmpo148033h11a1
aggtaactgtagaacagaagtttcatgggtgagccaggaaagagggccgtgtatttaaccgccaacactttacactccagtgtcgatatccatcaaacccaatgtttacaatttacagacaatcatgaccaggaaacagaaaagaattacacatattgagtcctggtgaaggacacccatattcagaggagaaccagtgcatatatatcggctcagcgataaaaagaagaagaaaaaaaacacgcaaaacaaaggaaaacacctgaatcaatcgtgaacagaacacaagctctcaatactcccggaacaaagtagggacagcgacaactgaaacgtgtggctgacccaaaacaaaccagtgtcgtgcaaggttttcagaaatggcttcattcttctgactgtgcattacgtttcgtagatgcg

SEQ ID NO: 15618 - DNA, 501 bp, Zea mays
  Clone ID: cC-zmpo148033h11d1
gcggttgaaaactgcatgtcatgtactaaactgccttcacttggcttcctgagtcaactccagtccctgcaaaggtgagtgcatactcagtcatcaccatcggttcagaattccttgggaccactgtactttcatcagccactccattccccaagcttgaggttttaaagctcagaaacatgaagaaacttgaagagtggtctttaactgtggaggagagccaggtagtattaccttgtttgaagtcactgcagatacagtggtgtcctaaactgaaagctctaccagaaggcctgaagcatgtagcgctgtgtgaacttcatgtggagggtgcacatagcctaactgaaatcaaggacctgccaaaactatctgacgagctccatctcaaagataataaggtgctacagaggatctccaacctgcccatgcttcgttccctcattatcgatgactgctcacagttgaagcatgtggcaggtcttgatgcgctgcagcacc

SEQ ID NO: 15619 - DNA, 398 bp, Zea mays
  Clone ID: cC-zmpo148033h12a1
gattataaataatgtggtaaaagtttgcaacagggtacctaatcaaatgacaatggcaggtacatataaacgtaccccacatcgatatatactataaacaaacaaatacaatatggatcgagatatgtatggcgctccgcggattaatcaacgaattaataatcaattaatgaatcttggcgcgggcggcgggcgccggcgccggcgcgtcaccggcgccaccggtggcccgcttgatgagcgcgtgggcgacgcgcatgagcgcctcgaagtccttgttcttggcgagcacgtggttttgacgggcgtggatggggcgtgcttgcagcagacgtcgcagaccacgtgtcctcctcgccgtgtccaggaacagcttcacgtcgtggacttgccgtcgt

SEQ ID NO: 15620 - DNA, 461 bp, Zea mays
  Clone ID: cC-zmpo148033h12d1
gcccggtcgcccggagtagcaagcgtctccgatccgatccttcgtgcgagcatatccacggcgatggaggggagagcggtcatgagctggtactgcggctcccttctggccgtggccatcgcgctgttcctgtccgtgtccctcggcgtgcgcgccgccggcgccggcgccggcgtcgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggaccgtgtgaaggacaacgacatgtggcagtgcctgaacgagttgcgccgggagatcgaagaggcgcctgaccacctggacgacaccgagggcggcctcgacgacggcaagctcacgacgtg

SEQ ID NO: 15621 - DNA, 513 bp, Zea mays
  Clone ID: cC-zmpo148037a07d2
cggctaccaacgtcccggtgaccatgcccgccaacacagcgtcagtgtctatccggtccctcccgctgccggggcgttggcggagaacacgggggggaggaacgccccggtgaccatgcccgccaacgccaacgccaacgcaacgacaggtgcaccggcgccggtccctcccgccgtcgggtcgttgccggagaacacccagacgaccaacgtcccggtgaccatacccaacacagcgacaggttcacccgcggcggtccctcccgccaccgggtcgttgccggaaaacaccccggcgaccaacgttccagtaaacatgcccgtcaacgccaaccagccgggcaacgtcgttccaccgcaagtagtggtgtccaagcttccgccggaggtgctggccaagctcccgcccgacgtgctggccagcatcccgccggagacgctggccaacatcgcggcgtcgcaggggccgctgcagacgagcgagatcctggccaccatcccggcggcgcaggc

SEQ ID NO: 15622 - DNA, 476 bp, Zea mays
  unsure at all n locations
  Clone ID: cC-zmpo148037a08d2
ccgcgctgtcgctacggcttcttccacgtggtgaacaactatttctttcactggatcatgtacgccatcgggggcaacattaaccccaccaggagggggagggcaaccgcttcatcgccccctacaaccccaacnccaangaggttaccaatcggtagtacacgccgtacaaggactacaaggagtgggtgtggaagtctcatggcgacttcatgattaacggcgccttcttcaacgagttcggcggtcataacgagcgcaagtacgacaggttcgacttcatcccggccaagcacggtcgctacgtctgtcagctcacgcacttttccggaccactcaagtgcatcgtcggccatccgtgctattttacagcggtccggttcggcacatactcctcttcctatatacatcggatttggatgggcggcatatatgtacctgtgtgtattatttattactacatcttgtactatatg

SEQ ID NO: 15623 - DNA, 403 bp, Zea mays
  unsure at all n locations
  Clone ID: cC-zmpo148037a09d2
aagctcctcctcctcccccgccggccaacatactcagtcttctctttctcgccacatcagccatgggcgcgggggcggtcaatcccattactcttgaggggcacgccccanctgaggccgccgggggcagagggaaggttgcgcccnaggccactccaatctccgttgaggttgcggctgatgaacaggtagctgagaaggtggtggtggaggagccggctgcggcggccgacgttgagcatcataaggctaatgaggtggtcgctccagaggcggccgtcgccgagcccgatcacaaggaggaggaagccgtggagaagaccctcttctaagaggagaagccagcggcagccgccaatgcagaggaaaaggtcgccaccgccgccgagaccacgacgacggt

SEQ ID NO: 15624 - DNA, 577 bp, Zea mays
  unsure at all n locations
  Clone ID: cC-zmpo148037a11d2
gactacctgacctggtgagcaagctgaagctttttatttcttctcagctcggctcaacggggtgggtcgacgtgacgtggcgtggttccgaacccgctggtgcacatacgatggcggcggcatactacttcgatcnacngggcggnngggggttgacgacctngcaacttccccaacacgggcttcatctacttcaaggcgacgccccggaacgcccgcgccatggcctactggcatgcggcgcggcggcggttcccggagaaccacgatcagttcgtgttcaacgagatcaagcgggagctcgcggacgggctgggggtccggatccggttcatcgactccgccaccgtcagcggcttctgccagctgggcagggacctcatccgcatcgccaccgtgcacatgacctgctgcgtcgggctggagacaagctgttcgaccttaagagggtgatcgtggactggaaacactacatggcgcgcccgctgtgggagcgcccgatggggaacaatggctggaccttcagggaggaacgtgatacactgactactgatttgcactgacccgggcctggatg

SEQ ID NO: 15625 - DNA, 541 bp, Zea mays
  unsure at all n locations
  Clone ID: cC-zmpo148037a12d2
ggattccacgaccttcacttcaaagaacaggatcgaattggtgtcttttctatgtatggtgtgccaaacatggggacgggcaagattggcgttgtccagcgccgcgttaatttaatggctgaagagggtgtcacatttgtggtgaatgccaatgttccccngggagggggttggctnggaggaacgtgtacnttctnaaaatgatgccgttattttggcttgtggagcaacaaaaccgagagatctcaccatccctggacgcgagctatctggagttcattttgcaatggaatttctccatgcaaatacgaaaagtttactctacagcaacctggaggatggtaaatatatctccgcccgtgggaaaaaggtggtggttattggtggaggtgatacaggcacagattgcattggcacatctattaggcatgggtgcaccagccttgtaaatcttggactcctgtcaaaaccaccaagcactagagctgctgacaacccatggcccccgtgggccaaaaattttccggtgtgactatgggca

SEQ ID NO: 15626 - DNA, 285 bp, Zea mays
  unsure at all n locations
  Clone ID: cC-zmpo148037b07d2
cacgcgttctctcgtctcaccctccctccctcacacaatatttaatttttaggtcccgcccttttcctccgacatccactttttttaggggagggggggtgcacccacccnccnacaataatatcctcatttccctctccttctacaactaccnccnccaaaatcctatgcctatgcttcgtcctctcctgtgccacggctgactaccccaacctccccgactacttcatccagttccacgtgtactgctacaccttccgcgcctggttcgtgaccaacgtcacc

SEQ ID NO: 15627 - DNA, 487 bp, Zea mays
  Clone ID: cC-zmpo148037b09d2
gtccgccagaacatccatccgagctaagtaattaggtcgaaaatgtttcgtttcgcagcagtagcagcagccggcgggtgacgctggtactgctcggtctccgcctgctgcttctggttggtgttgcgcaggcggtaatggaggtggtgcctgctgatgataatatctccgccgccgctgctggcacggcggtggacgatggcgagccgcctcagcagtgcgcgaccccggtgagcgtggaggaggcgtgccgcggcgcgttcgagacgcacgccggcgtggcctacgaccactgcatggcgtcgctgggcgccgacccgcgcatcaaggaggccggcaacaagaacatgcacgggctggcggtgctggccaccaggatggccatcgaccacgccgccagcaccgagtccaagatcgacgacctcgcggagctggaggcggcgtcgttcgatccgcaggcgcgcgcccgcttaaccactgtctggag

SEQ ID NO: 15628 - DNA, 525 bp, Zea mays
  unsure at all n locations
  Clone ID: cC-zmpo148037b10d2
cgcgatccatcaattgcaagaggagcaagataccaccaccgtagtattctttctcaggtacgaagaaggcgacggggatggggaggctggccttggtagcggcggcgcttctgtgccttctattagcgacagggccgcagggggccgtcagcgcctagggtatgggggggggggcaagggatcagctgcaacgtactgggcaactgcgataagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcangtaccaggccttagcgtgtggtgccgcgtgtgtgtatatattacacacatgcattatacattggtcgtcgatcgttactgtatgcatggcaactgatgtttcttgcttcgcatatctgaggtgtatactgatgtatgtggctcaacttttgatgattaatgtttaagtatga

SEQ ID NO: 15629 - DNA, 443 bp, Zea mays
  unsure at all n locations
  Clone ID: cC-zmpo148037b11d2
aaaaagcgtcataaaaagaagagagatctgggggatggattcgcatgttggcaaaaaaatcgactcggggggctgggtctatctctgtagcgacgtcctgccctgccccgatcccgacatcatttcacatttttatagttatatttctaanncnggggttatgaaganggttgggtattnccnnnanaannctatcctnnacacttgtgcactctacacagcctgaagacgtcaaccggtgcatcggaatgcttgaagcttcattggacaggtctagcagcccataggaaacaagggagaagctctactagttagctgttggtcaatacagaactggggaggatacaagaatccgacatcttttggaaagatgcttaaagatccaaacatgactggagacaagccataacttcgcaaaggctcgttgaagaaaaaaccaaaat

SEQ ID NO: 15630 - DNA, 396 bp, Zea mays
  unsure at all n locations
  Clone ID: cC-zmpo148037b12d2
ccgggcgaaccatgcctgcgagaaggaggcgggccccaacatctttttcttttgctacgacgtgatcgaggagagggggagggatctggtgaaggagtgccccaacctggcgtcgtgcgcggacatcatcttggtgagcgcccgcgactcggtgaagctgtctntaggggccgagttcgctgttctccgggggcggcgcgactcgctcgtgtccaacctcnaggacgccgacaacctgccgggcccggacatcgcggtgcccaagctcatcgacgagttcgacaagcagggcttcaacacggaggagatgatcgcgatgctgggcggcggccacagcatcggcgtctgcaggtgcttttttatcgataccgacgccgcgcccatcgacgaggcgtt

SEQ ID NO: 15631 - DNA, 498 bp, Zea mays
  Clone ID: cC-zmpo148037c09d2
gtccggcctctacaacttccgcaaccagggcgggaagccggagcagttcgacttcagcatgaacccgtcctacgccagggggctgcaggacgtgtgcagggactacctcaaggaccccaccatcgccgcgttcaacgacatcatgacgcccggcaagttcgacaacatgtacttcgtcaacctcgagcgcggcctcggcctgctcagcaccgacgaggagctgtggacggacccacgcaccaagcccctggtgcagctctatgcatccaacgccacagccttcttcgacgacttcggccgcgccatggagaagctcagcttgttcggcgtcaagaccggcgccgacggcgaggtcaggcggcgctgcgacgcctacaacagcggccccgccgtcgccgccaccatacccaagatgtgacgacgctgcgcgtggtacgacgacgggcgcgcacgtgcttgtctgcatgcggatcgatcgacggccgagctgtctggcac

SEQ ID NO: 15632 - DNA, 613 bp, Zea mays
  unsure at all n locations
  Clone ID: cC-zmpo148037c10d2
acccgtccgcgcgtgcgtacattaatctaagcgatcttcatccagccttcgtctcttctccctcgaaatggaggcgacgagcggggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattttgggatatttgttatcatactatgaaatgactgtgaatcgctgntctgatttgtctttcaccacatgttttccttgcatgaagtaagatacgatatttatgtatttcttgctttcgagataatagtcacagtatcttgggaattgaccggtaaaaaaaaaaaaaaaaaaaagggcgg

SEQ ID NO: 15633 - DNA, 429 bp, Zea mays
  Clone ID: cC-zmpo148037c11d2
acccgtccgctccgtgatggggtccagcgatatctggatcgaccacctgtctatgttctagctgcgcggacgggctggtggaggcgggggacggctccaccgccatcaccgtctccaacggccacttcacgaggcacgaccacgttatgctgttcggggccagcgacgccgcgtccaaggacagggagatgcaggtcaccgtcgccttcaaccacttgggcaagggggtggtgcagcggatgccggtctgccgtgactgcttcttgcacgtggtgaacaacgactacacgcactggctcatgtacgccatcggcggcagccggaaccccaccatcatcagccagggcaaccgcttccgcgccgtctacgacagcaggttcaaggaggtgaccaagcgggagtacacgcagtacagcgagtacaagaact

SEQ ID NO: 15634 - DNA, 553 bp, Zea mays
  Clone ID: cC-zmpo148037d07d2
gcccacgcgtccgtcaccctctgttgtccctggaggtgacctgtctattttccagcgtgccgtgtgcatgatcaggaacgacaccgtcgttgccgaggtgttctcacgcatcgaccacaagtttgaccttatgtacgccaagcgcgcattcgttcactggtatgtcggtgagggtatggaagagggtgagttctcagaagcccgtgaggacttggctgctcttgagaaggactatgaggaagtcggtgcagagggtgccgatgacgagggtgacgagggagacgactattgagtagctggctaataagtagttctctggtggttaatggttgggttattttgagtatatactctatggttccactccattggatactgctgctgtgtgtgtttccattttgtactatgtagtaaattgttcgtagccccctattggccatgaatgttcatatcatccttctttggtttgcaacgctattcgttcaatttcggtgtatatgctataatgctattatcgtgcaagtgtgctgtgctcaaccattgggttttattt

SEQ ID NO: 15635 - DNA, 521 bp, Zea mays
  Clone ID: cC-zmpo148037d08d2
ctgacataaccatcggcaccaaggatgaggcgaagggtttgtcttgttcgtaaagccaagatcgagatggggctgggctaatcatataacttcaacagcatcatgtcgagcaagaagttcgagcgcccgaagccgtccgccgaggaagagatcaaggtgtgatctatccgaccaacgaacttctgcatcggccagcgcagcatgcatgcagagggccttcttccctagctagctagctagctaagctcccctgttccattttcagaggctggcagctcaccacacagctcagctcggattattgataatggggcatcgcggcagtctgattgaaggctagtaaatcattcatgtcatgcatggcacattaattaccttattattagtccttgctgagatggatcacattctggtgagttaagttaaagcatgcaagatatgtcgacagacactacatgagatgacacggttctacaactctaccggagtctctagtttgttctgcttttgcatgcctttgg

SEQ ID NO: 15636 - DNA, 260 bp, Zea mays
  unsure at all n locations
  Clone ID: cC-zmpo148037d09d2
aaaaaaaaaaaaaacaaaattttgattttaaaaaaaaaaaaaaaaaagggaaanggaaaataaaaaaaaaaaaaaaaccccaccccaagaaaaaataaaaaaaacacacaccaatacataaaaacaccaaaaaaaaaaaaaacaaaaaaaaaaaacaatcaaaaaaaaaaaacaaaaaaacaaacaaaaaaaaaaaaaaaaaaaataaaacataaaacaaaaacaaaaaacaaaaaaaaaaaaacgaaaaaaaaacaaaa

SEQ ID NO: 15637 - DNA, 561 bp, Zea mays
  Clone ID: cC-zmpo148037d10d2
gagcgaccaccgcgtccccaccatggccgctcgccggagcacctgcctctcccggcacggcgtcctccccgcggggctgggcatcctatgctcgtccctcccttccctcgccgccgcataccgtccaggcgacatcgtcccgatgctccgctcgggccagtaccacggctcgaggtcggtgtggttcgacgtggtggggcgccattgcccggccttcgcggtcaaccgggaggtgcggatgccgagcccaaagcctacggggttcactggtgctgatccgtacaagataacatttcaaattggacatgaaaagttccatgttccttggctttatgggataaagcgcaaaacctctgaagttccactgatcgatttccatttgaagtactctggaaatgatatacttggggtgacagctaaagttgtgggacatgcctcaccactacgtgggaagtcatcctgacataaagaaaaaattctggggtccacagaagtggccaaaaaccttctgggtagatatacatggaggagcaatcagagattgatgttactggaggattt

SEQ ID NO: 15638 - DNA, 538 bp, Zea mays
  Clone ID: cC-zmpo148037d11d2
aacctgctcgtctcctccattgaccaacaattaagcctccctgaccttcacatctattaggtgcagccatgggggggggtgcatctaagcctaagacgcttgacgggaaagccccagctgaggccaccatcttcacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaataccgtcatcgagaaggagaagccatcatccgtccatgcagaggaaaatattgccaccaacaaggtggcagccgagcccaccacagacttgaagaaagacaccgaggaggatatatagatggaggaagagaagccatcgcttagctaattgactgcatgtcaattggctggagc

SEQ ID NO: 15639 - DNA, 233 bp, Zea mays
  Clone ID: cC-zmpo148037d12d2
accaggggttaccccggccgcgccatataccgctgcgccgcgctaatgaggcacacgccaccgggaagtgggccactacatggaaacatgacgggtaactgtatccaggaaaagatatagaaaaatctttttaaaaaaaaaaaaagggcggcgttaagatcaagctactccggctgcgagctacttttatggtacaataatatggcgcgttaacgcggaggaaactgcgtccc

SEQ ID NO: 15640 - DNA, 412 bp, Zea mays
  unsure at all n locations
  Clone ID: cC-zmpo148037e07d2
ggaaagaagtcgcctaattctttcgancgaattaggttttcttttttgtcccacgctccgnctntatngggaatgggaatcttacaggaggcggggaggggatcacccacccattgnaatgcctcttgaaagtccccctggtgaagggcatcaaccttgcctaccgcgacgcaagaggcaaccatccgtatgtcgtcctacgacttggcaagaagaaacttaagactagcgtgaagaagacatctgtgaaccccatctggcacgaggagctaactctgaccgtcacacatcccagcctatctttgaagctggaggtgttcgacaaggacaccttcagcagggacgaccccatgggggactcttacatcgacttggcgcccctggtggaggcggctaacgccagccctgaagc

SEQ ID NO: 15641 - DNA, 545 bp, Zea mays
  unsure at all n locations
  Clone ID: cC-zmpo148037e08d2
cccgtgcgattgccacaagcatggcgtcatgcaccgggacctctttctttttaacttcctgtatgctaacacatgggagaggttccctctcaagggcagggaggtgggcctctctgggtgcttcaaaccaggtgacaggntcaatgacatcctttcatccccctactacatggctcctgaagtcctcaagaggaactatggtaaagaaatagatatatggagtgcaggagtcatactctacatcttgctatgtggcgtcccaccattctgggcagagactgatgagggcatagcgcaggctataatccggtccaacatctacttccatatagagccatggccaaaggtgtcggaaaatgccaaagatcttgtgaggaagatgcttgacccgagcccctactctcggctgactgcccaacaggttctagaacatccttggatacagaacgccagtgcagctcccaacattccactcggagaagcagtgaggtccaggctgaaacaattcactgtcatgaacaagttcaagaaaaagccctgcttgt

SEQ ID NO: 15642 - DNA, 536 bp, Zea mays
  unsure at all n locations
  Clone ID: cC-zmpo148037e09d2
ggacagacagcacgaaggctgtgcaggaggcatgggcttctgtgtgcggcggcactgggaagcagacggtccgggtacccaagggtgacttccttgtcccacaactcaacttcacaggcgggggcaagggcgacgngaccatccacgtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggngacagccccaacacggatggcatccacatgggcgactcatccgggatcacgatcaccaacaccgtcattggcgtc

SEQ ID NO: 15643 - DNA, 482 bp, Zea mays
  Clone ID: cC-zmpo148037e10d2
gctttccttcctcccagccgcgcgtgcggagggaagtttaagtatacattagaagggcgcggaaaggggaaggggcattcattatctaataactaggaaaaaaaacaaatttatcggggggggggcatacggtggcggcgcgcggtgggatctatcttccacgcgcgggtctccctgccttcatctgctccatcacttcaagaacacgccagagaattcaagtgtcgcattgcacttgcactccgtcgagcggtcgagccccgatccatgcctgcgcctgcccctgccatcgccgtcgtcgtgccgccgccgccgtcgccatcgcttacaggttgcgacggctgctactgactgatcgctctggatgtagctataggtacctctcgattggcgtgctgttctgataacttctaacgagcctcgaacacaaaacaaagccgctctgccaccggctgccactggcgctggaagcaacgaccgct

SEQ ID NO: 15644 - DNA, 541 bp, Zea mays
  unsure at all n locations
  Clone ID: cC-zmpo148037e11d2
gtgcgctccctcgtcgtggcgcccctgctcctcctctcccttctcgttttcgccgcggccagcgcgcggacggggggggacaccgtgcaggacgcgtgcagcacgacccacttccccaagatctgcgtggacagcctcgccgccaancctgatatttagagggctagggggggcaagcngncnnanctnttcntgaacatcgcggccgagaaggggtccgggatggccaccttcgtgcaccgcaagtacagcgacaaggaggacagcgacatgttcaggtgctacgacagctgctccgacgacgtggaggaggccgtcgcccacctcaacggcctcgtccgggagcccaccgacgccaagttcctcgagctcaagtcgtggctctcctccacgctcggcggcaccttcacctgcgaggacgcctgctaggacctgcccaagaccagcgacaaggacgacgtcgtcaacttcagcctcgacttcgagaagctgcagcgcgtcacgctccacctattaccgaggcgtccgcaccatgttccga

SEQ ID NO: 15645 - DNA, 482 bp, Zea mays
  unsure at all n locations
  Clone ID: cC-zmpo148037e12d2
cccgtgcggccccacccgacgcgacgattcctctcctccgcccgttcctttctatctcacgctctctctctcttggggcggggcgtctggtcggcgtcgccatcgccggccatgggttgcggtggctccaaggaggccgtggccaccggcaacaccatctccngcaggggggggctccggaggaagccggcctccgtctccaccggcgcaagccacacatccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatccaccatggccgacgaggcgcttgctgtggaggaggggcccaaggttgaccaaccactcaa

SEQ ID NO: 15646 - DNA, 113 bp, Zea mays
  unsure at all n locations
  Clone ID: cC-zmpo148037f07d2
ccgtgcggtcgtacaatgccggggcctccgacgctcccatctgtgtcttttctgcccgagcccacaaacacagcggcagggtcaacattagggggggggggggggccnacccc

SEQ ID NO: 15647 - DNA, 482 bp, Zea mays
  unsure at all n locations
  Clone ID: cC-zmpo148037f08d2
gacctctctatgtccgctcaccggggcgggctcactttcctttctaagaagtaacacttctccggggggccggatcccctctcctttcttagccaacccctccccacgggcccctatgggggaggggnaccaccnanccccaaccaattaataatatatatatatagctaggatcgatcgacagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcacctctaaccaggagtactgggcggagctctcaaaggcggtgcacgcgtacaaccgcgcggcgtaccataccgaccccgtggccgacgtgcagcgctttaacgacggcgtgcacagggcgacggcgacaccgtcgcggtccctggcgcacagggcgcggggc

SEQ ID NO: 15648 - DNA, 478 bp, Zea mays
  Clone ID: cC-zmpo148037f09d2
gtgcgcccacgcgtccgcgatctccaaggccttccttccatttccatttccatcggcatcaattgttccccggggtgggcttgtggctctctccggtcgcctgaacaagccacacggagggggtcacactcccctgagcggcgtcgggcggtcggcttcatttgatgcgcagtgggcccggcgggcatggcgttccacgaagtggagacgtcgcgtcggtgctaagacgtcggggcatggtcggcgcgcagtgacggcggtcggcggctgggtccgatccgtgcatgcatgccctgcgctcttaccctcatcgagtcgtcgctcgaccggtggtgccccctcccccgcgcctgctcggcgcccacaaggtcgcagccacggggaggcgcacagggaaaaggaagatgagctgctttccgtgcttcggtggcggaaagggcaatgacgacgacgacgacgcggagagcccaggtgatgc

SEQ ID NO: 15649 - DNA, 504 bp, Zea mays
  Clone ID: cC-zmpo148037f10d2
cgtgcggcagcagggaacatcgtccatccgagctaagtaatctggtctaataatgacccgtgccagcagcagtgggaggggtcggcgtgtgacgctggtactgctcggtctccgcctgctgcttctggttggtggtgcgcaggcggtattgtagttgattccggcggaggaggggagggccgccgccgcttctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgcctacccgcgcagcaaggaggccggcaacaagaacatgcacgggctggcggtgctggccaccaggatggtcatcgaccacgccgccagcaccgaattcaagatcgacgacctcgcggagctggaggcggcgtcgtctgatccgaatgcgcgcgcacgcttaaaccactgcctggagcaata

SEQ ID NO: 15650 - DNA, 540 bp, Zea mays
  unsure at all n locations
  Clone ID: cC-zmpo148037f11d2
cccgtgcgctcctcttcccccgccgggcaacaacctcatgccgccgttttctttcacatcagccatgggcgcctgcggggccgggcccaatacgcttgaggggcaggccccagctgaggccgccgtctccacacccaaggttgcgcccgaggccactccaatctngggggggggtggggctggtgaacannnancttaaaacgtgntgttgtatgagccgtctgcggcggccgacgttgagcatcagaaggctaatgaggtgctcgctccagaggcggtcgtcgccgagcccgaccacaaggaggaggaagccgtggagaagaccgtcttctaagaggagaagccagcggcagcagcccatgcataggaaaaggtcgccaccgccgccgagaccacgacgacggtggaggcgaagaagaacgccgaggaggccgggaaggagaagctggcgcagcaaagctgatcgactgttcgtgcatgcgtgccaattaatataattggctgatgatgcctgatgttcagtgtgtgatactgggatca

SEQ ID NO: 15651 - DNA, 565 bp, Zea mays
  Clone ID: cC-zmpo148037f12d2
gtgcgggaacatccatcgatctccccccagcggcgaggagattcggtgtccacaggaaggagaaatggcttgggcacggaacgctctccgggtgtttttcatcctagccgtggtatgtgccgtatgcacagcgaaaaggacaggagccaagaaggaagaatcggcggcagcccctggtggtgctgggggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaagggcagcagcatcgccatccagctggatggcaacctgctgggatcaaacgacctgaacaagtacacggcgagctggatcgaattgtcttacgttaacaacatcgggatcaccggctcgggcacgctggacggccaggggaccgccgtttatagcatgagcaagaccgacaacgtgaaggcgatgcccaacacactg

SEQ ID NO: 15652 - DNA, 457 bp, Zea mays
  Clone ID: cC-zmpo148037g07d2
cccggcgggacggcatcgccaagcagagctaccagctgcgcattttgcttttttgccgtgatcgcgaacatggaggggtggggggactggttccccgatgacgagttcaaggccaaggtgaaggagtcgttcaacgatgggaaggagctcactagcaacgccctggcgctcatcgagaaggggtcatcgctcctctctgtgctaaagggcggctcgaaacgacggttgctcgaggaggagggagaaccggcgcaagccgggcctgcactcgacaaggacggcatcccggagtgggtgcccgacggtgagcggagggtgctcaaaggctgcggcttcaagagcacactcacgccaaatgtggtggtggcgaaggacggcagcggcaagttcaagaccatcaacgaggcgctcgccgccatgccaaatacctaccgacggaagatacgtgatccaagtg

SEQ ID NO: 15653 - DNA, 343 bp, Zea mays
  unsure at all n locations
  Clone ID: cC-zmpo148037g08d2
gggcgatcatcttgtccgatccatcaacaatcgccgagagctttcgatagataaataaagangaagaaagcggggtnggggttatttcattctcttcgtgctacccctgaccctagtttgtgccccgctgataacataggcaaagaagaagaaagtctccgccgccgtcgcctaggagaagaatgtgcaggacaacttctgctcgacgctgtgcgagggcaggaaggggatggacctggtggtgagcaaggagttctgcgacctctcacaacgctccaacactgttgctgaacagccggaaccaatgcaagggcaattgcaccgaacaaaagggggtgggggg

SEQ ID NO: 15654 - DNA, 506 bp, Zea mays
  Clone ID: cC-zmpo148037g09d2
cccgggcgagcagccaatggcttctcgttcgcccaccattgcctttttctttttccttgcctgcttctcctcgccggggggggccttctacatcaccaggctactccgacaactctccgacttcacaacctttaacaacctcctgtctcagacgaagctcgcggaggatatcaaccgccggcagaccatcaccgtgctcgccgtggacaacggcgccgccggtggcatctcctccctcccatcagacgtccagcggaaggtgctctccatgcacgttgtcctcgactactacgacaccgccaagctggaggccatcaagaaccactccgccctgctgacgactatgttccagtcctccggccaggccaccgaccgcatgggcttcctcaacttcaccaagcgctccgacggtgtcatggtgttcggctccgctcagcccggagcgcagatgaccttccatatggtcaagtccgtcacttcccgcccgtacaacatctcagtgctgc

SEQ ID NO: 15655 - DNA, 527 bp, Zea mays
  Clone ID: cC-zmpo148037g10d2
cccgggcggtggagcgctggtgtcatcctgcacatccttctctgtgtgtttcttccgttttggggaggctccgaggagagggtgcactgtcgatactccgtggggtaattaacttacagaaggatccatggcccaaggtctcccagagcgcaaaggatcttgtcacgaggatgcttgacccacatccttgtacacggttgacggcaaagcaagtccttgagcacccttggctcaagaatgctgataaggcttcaaatgtgtcactcggagaggttgttcggtcgaggctgaagcagttgtcgtctatgaacaagcttaagaagaaggcacttggagtcgtggccatgaatttaccgatggaagagattggcaaattcaaagagatgttccatacaatggacaaaaacaaggacggtagcttggcacttgaagagctgaaggagggtttccggataaacgatcatcctgttccagaggaagagataaagatgttgttccaagcgggcgatttccatgaactgacacat

SEQ ID NO: 15656 - DNA, 390 bp, Zea mays
  Clone ID: cC-zmpo148037g11d2
ccccggcgggaacgttgtacgagaacctttctccctcctccacttttctctctttcttgccacggcaaaacaccggggcgggggagatcatggcgatggcgtaccgcgtcccggaggtcaccctggtgtcggcaaatgacctcaagaaagtgtcgctcttctcccggactcgcatctacgccgtggcttccatctccggattcgacctccggatcccttcggagaggaccgaatcagagcacagcgtgggctgcaaccgctgctgtaactccgtggtacacttgcccattccggctgccggtgacacccgcggtctcgcactccacttgaggctccgcgcccagcgtttatacctgttccatctcgacatcggcgaggtgtgtgtgccca

SEQ ID NO: 15657 - DNA, 531 bp, Zea mays
  unsure at all n locations
  Clone ID: cC-zmpo148037g12d2
cacccgggcgaggcgctcgagttttcaggtaaaccatagtttagtgtctctttgctcgtactaagcaaactgctcggaggtgggctggagggaaggctcctaggaagcaactcgccaccaaggctgcccgtaagtctgcacccacaactgggggagtaaagaagcctcatcgttaccgccctggaactgttgctcttcgtgaaatccgcaagtatcagaagagcactgacctgctcataaggaagcttccgttccaaaggcttgtcagggagattgcccaggatttcaagactgatcttcgtttccagagccatgcggtgcttgcgctgcangaggctgcggaggcgtacctggtgggtctattcgaggacactaatctgtgcgccatccatgccaagcgcgtgaccatcatgcccaaggacattcagctggctaggaggatccggggtgaaagggcctacattctctgtttactggtactgggagtggctccgtagtatggtttgcatctgttcgatgcttgcttttgtg

SEQ ID NO: 15658 - DNA, 579 bp, Zea mays
  Clone ID: cC-zmpo148037h07d2
cccgggcggtgcccgcccaaggacaagtggtgcaagccgccgctttttcatctcgacctcagcatgcccgcgttggggcagggggcgcttgagaaggccggcatcgcgcccatctcctatcgcagggtggcgtgcgcgaagcagggcggcatccggtacaccatcaccgggaacaagtacttcaacatggtgacgatcaccaacgtgggcggcgccggcgacatcgcggcggtgtcggtgaaggggagcaagcgcgtcaagtggacggagatgaagcgcaactgggggcaagtgtggcagaccggggaggacctcacctgcgagtcgctgacgttccgggtgatgactagcgaccaccgcaaggccacctcatggcacgttctccccgctgactggaagttcggcgtcacgtaccaggccgtccaataacttctaagtagccactttccctcctcttcttcaacctgcatgcccgcaagcagccatgcagattataacatgcattatgcatgcatattcattctttcgctcatgcacctcgatatggtgccagagttaaaaaatgttaatcaatatgca

SEQ ID NO: 15659 - DNA, 501 bp, Zea mays
  Clone ID: cC-zmpo148037h08d2
cccgggcgagggaacatcgtccatccgagctaagtaattaggtttataattttccgtgccagcagcagtagcaggggccggggtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggtgcgttcgagacgcacgccggcgtggcctacgaccactgcatggcgtcgctgggcgccgacccgcgcagcatggaggccggcaacaagaacatgcacgggctggcggtgctggccaccaggatggccatcgaccacgccgccagcaccgagtccaagatcgacgacctcgcggagctggaggcggcgtcttctgatccgtaagcgcgcgcccgcttcaaccactgtctggagcagtac

SEQ ID NO: 15660 - DNA, 434 bp, Zea mays
  Clone ID: cC-zmpo148037h11d2
cacccgtccggccatgactggacagcttagcacgaagagtgatgttttcagttttggagttgtgctgctggagcttggaacgggtcgcatgccagttgaccacacactgccccgtggccagcagagccttgtgacatgggctacaccgaggcttagtgaagacaaggtgaggcaatgcgtccatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctacggcctcgtcggcctcccacgctgccgaagcagcagagcaatccggactgtgattccccatcgttgcgacacctttgggttcacgaaaaagga

SEQ ID NO: 15661 - DNA, 527 bp, Zea mays
  Clone ID: cC-zmpo148037h12d2
cacccgtgcggtgccggtgaggtcacctccatcgtcagtgaaatctttcgtttcttcaccactgttaagttcgccggggccacgagcgcccgtgaggtcacctccaccgctaacgaaattatcacctcctccaccaccgataaggtcgccacccccaccacaagcaaactcacctcctccatcagctccaataagctcacctcctcctccgatgcaatcccctccaccgcctgctccagtcagctcaccaccaccacctataaaatcaccaccaccggctccagtaagctcaccacctcctctggcgcaatcccctccaccacctgctccagtcagctcactaccaccacctgtaaaatcacctcctccaccggctccagttagctcaccaccgccttctgtgaaatactcttcaccacctactccagtcaactcaccgccaccacctgtaaaattacctccctcactaggctcaatggtttcaccatccgtctcccatgaaaatccctccaaccacggcaccccgt

SEQ ID NO: 15662 - DNA, 288 bp, Zea mays
  unsure at all n locations
  Clone ID: cC-zmpo148038a01a1
atagtnggtttggagggtatattaacatggattgggtatacgggtgggctaatgttacagacggggtgttacatcacagtcacacctggcggttttcttcccatttgacgacgctcccgcacgcacgcgggaccgtcacctatggctatatttacaaagggcatcttgcctgctgcagccggccaccaggaggaagaggactactggcatgctcggttcactttatggcttcgccggttcgcacagggcaagaggatcgaaagacaccaccctgtctacccatgatat

SEQ ID NO: 15663 - DNA, 451 bp, Zea mays
  Clone ID: cC-zmpo148038a01d1
cgtccgctcggcgactgccagattggcaagaccagcttcatggttaatgtatttgggagatgacggggaggagcagagcggcttggagatgacgggcctgaatctcatggacaagacgatgcccgtcaggggagcaaggattgcctacagcatctgggatgtggcaggagaccaccagtccgtcgaccacatcccaatcgcgtgcaaggacgccgtggcgatcctgtacatgttcgatctcacgagccgctgcacgcttaataacattgtagattggatcgggaggtcgaggaaatggaataagacggctattccaatcctaatcgggacaaagttgggggacgggggtgagcttccttttgagatgcaatgggccatcgttaaccaggccagagcatacacaagagcgatgatggcgacccttttttctttagcgcgacgcacaacatct

SEQ ID NO: 15664 - DNA, 447 bp, Zea mays
  Clone ID: cC-zmpo148038a02a1
atataaccttttatgttgatgagaaaatgtaggtacacgtacattatttaggccaaagagagcacaacatgctaatcttccaaaaactataccaccaacaagagaaattggagttctgaacatccaagcctacaaataaaacttacttccctatatcaagaacccaaccagaggtgtgtaacttcaacaacttttgccatgccgggaataaaaaaaggtttagccagagtatacatagaagccgttggatgtatatacagtacttggccgatccaagaagaacgccttaaaattcccttcccacagcaggtaatctaataatagccttttgcgcctctggattgatacagctccaatctgatctttgcttctggcaacaagttgtctattactgggtcttgcaccatgtaagcttgcttggaagcccatttcagcaccgtgaggatt

SEQ ID NO: 15665 - DNA, 601 bp, Zea mays
  Clone ID: cC-zmpo148038a02d1
atcatccactagtaacgctggtgtcgcggcaacgaagttgcacatcgcgtcactgtcaggaacgagtacagggggcagggagttcgaggaccctgagacgaaggcatacatgaaagctaacgcagccaaggcgctgtggcagcttgccaagggaaacgccgctatctgtaagaacatcacggagtcaagggctctgctctgcttcgccgttctcctcgagaaaggtgaaggtgacgtgcagtataattccgcaatggctctcatggagatctgctgcgtggccgagcagaattccgacctccgacgatcggcgttcaaaccaacttctccggctgcccgggctgttgttgaccacttcctacgtgtcgttgagaaggccgagtacgacgatctcctgattccctgcattatctcgctgggttgcttgtccagaaccttccgtgctacagagacccggatcatcgggccactggtgaagcttcttgatgagagggaagcagatgtctctcgggaggcagacgatgccctgaccaagcttgcgtgcacggataattacctgcacgttgaccacactaaagcgatcatcagtgcaggcggagcg

SEQ ID NO: 15666 - DNA, 81 bp, Zea mays
  Clone ID: cC-zmpo148038a03a1
cccacaggagaactgagaaagatcatgtgtgggtactgtacgcgtccatgcctctttaatggccacaggcggacgcgtggg

SEQ ID NO: 15667 - DNA, 85 bp, Zea mays
  Clone ID: cC-zmpo148038a03d1
cgtccgcccacgcgtccgcctgtggccattaaagatccatggacttgtacagtaccaatacatgattcttcacagttcggctagg

SEQ ID NO: 15668 - DNA, 444 bp, Zea mays
  Clone ID: cC-zmpo148038a04a1
cacccgaatttggttggtatttagggaagaaggtgtataccctcaaattcagggcgctacaccgtcgaacataatatagctgtcggatgtctgtcgttttactgttgtgcgttaccaatggatagcatgtaatgggcaatgcaaggacgagagaaaaattataactagagagatgggtcagtcgacggagggtctagaagcatgcaagctccttgaggcaacccttggtgctgcccttggcgttcgtgcatatagccatggtcttgttgttggtgccgctatactcgacgttgacgtcatccatggtgacccccgtgcatgggaccttggcagtgcagagcaggctaacggccttcggggtggaggaggtgcccgtgatgttcttgaaggtgacgtccttgaccgtgaccttggaggcgcccttggcagtacacaacttgttgg

SEQ ID NO: 15669 - DNA, 292 bp, Zea mays
  Clone ID: cC-zmpo148038a04d1
gagcgggaactcctgcaccaagaagtacgactgcaagatccttcccaactcgctggtgatggacttcgtgaacaacggggaggtggccggggtcacgctgctcaactccaagttcttgcacatgaacatgtaccggtgcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctcc

SEQ ID NO: 15670 - DNA, 443 bp, Zea mays
  Clone ID: cC-zmpo148038a05a1
atgtacaattctgttcaatcacattatatattgtgggaggttgggaaattttaagacaaccaaacttgctttggggtcaaatcacaaaattatttgccaaaacgatacaataaaattatataaacaaggggggaaaaaatgccgaacgaaggatgggtggtgttcaacggagcggccacgcacaatcccagggcatggagactactaattaattaatgttggcgttggtgtcgttgtttggatgcattcacaggccttgctctacgaggtagtcaccgagcctctcaaccaccatgttgcactgtccaggggtcatgggctcgttataaatgcccatcaccagcgcctgtccggtcttcttcacagttatgcctacagatccctttcttccgaggatgacaacgccgggctcgccttggatgaccatgtacctggtggggcca

SEQ ID NO: 15671 - DNA, 565 bp, Zea mays
  unsure at all n locations
  Clone ID: cC-zmpo148038a05d1
ttgcgccactgctcgttatcctcctcttgcattgcattgttggtcgtttttgagcagcagcaaccactgcacagggtgtcgtgggggacgtacgtcgatgagcacctcatgtgcgagatcgagggccaccacctgagctctgccgccatagtcggccacgacggcgccgttttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaggctcggtgactacctcgtagagcaaggcctgtgaatgcattcaaacaacgacaccaacgccaacattaattaattagtagtctccatgccctgggattgtgcgtggncgttccgttgacaccaccca

SEQ ID NO: 15672 - DNA, 489 bp, Zea mays
  Clone ID: cC-zmpo148038a06a1
gcaatattccacttaaatgagcaataatataggctttagggaatgcctgttgaagcacttgcttcttcacaagcctgtagcaatacgactgatatatttatatttcaacaggtaatgttccctgaataatcgtcagtgtgaatttaccccttaagcatacaacactgatgtgtggtggcattgtatttgcacaagcgcacaaaaaaggtaggcttggtgacaaatcttcacaaggatacagtttgaactcggatgacctatcgagattcctctgaacggcttttttctggacctcaaagctttgggctttggcctatcttatccttcggcgatgaagccgcctcttcggtgtcgacctcagtctcagatagtgatagatgaggatttcctttttcaattggcagtgtcctcctggaaccctcaaaggctacgcccagaacaatgttatcctcaaaaactggtctagattctttctttggattaactacc

SEQ ID NO: 15673 - DNA, 558 bp, Zea mays
  unsure at all n locations
  Clone ID: cC-zmpo148038a06d1
ggaacgttttggcaaaaaatccgcatatagaacaacaaaagctgtttcaggagagtattctttgagaaaattgatccaaaaggggaagcacggatgattttcatatcctgctttgtaaagacatcacattttgaggagtatctcaatgtccaggaagctgttatgttggaccttcttagaatagttgggcatcacaaagcaaggcttgctacccaaattcgaacagttcagaaatcatatggcaatgcagacttcgataacattccttttggagaggacatgtatagtcgagtccgtggccggccacttctgattgatacatctgcaaggatcagtgatgacaaacccaggcctcgacctgtatcatcacgtgaggagcagaaagtcaagacaaatggctcggtagatattaagtccagttcccctgaaaatgctagttcaagcaactctgaaaagcaggagccgaaaaaaatggtgcctgaagatactcgggtgaagaacattaanggtgataatgtgatgccagtaacaccatctttagatcctgttccgtcaact

SEQ ID NO: 15674 - DNA, 383 bp, Zea mays
  Clone ID: cC-zmpo148038a07a1
gaaggtgaagtcccttttcgcaccacggtggaggtcctgtcccggaggggggtgcccgcagcgaggagacgtcgccgtcgctcccggcgccatgggctggcagcatcctggacccatccggctcacggtaggagagcgcgggcatggaggagaccttgaccatactcgggttgggccgcagcaggtgttcgtcgccgatcagcatcgactgatccagcagcccgccgctgctggaggtgtcgaattggttcgaatgtagctccgcctgcgttctggcggttggcagtggcggcaggcgagaggagacgatgtcgccgaaagccgccgcgctgcccttctggtggaacgacggctgctgactgccgccgaggtggtggaacacc

SEQ ID NO: 15675 - DNA, 541 bp, Zea mays
  Clone ID: cC-zmpo148038a07d1
gggccgccgtgcccgttcttcccagctgcagtttccggcctttgcgcgcggttgcgttgcatttgcatgggtgcgcgcggcgctctgggagcttgcactagcgggtcggcggcctaggcgcggggcatctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaggtgactaagctggcggacggaacgacgacgatggcgaggagcggcggcgggatggaaggcagcggcgggctgaagaaggggccgtggacgcaggcggaggacaagctgctgagggaccacgtgcggcggcaccgcgagggcaactggaacgccgtgccgccggagacgaggctgcaacgctgcggtaagagctgccggtttcggtgggtcaccaccttc

SEQ ID NO: 15676 - DNA, 100 bp, Zea mays
  Clone ID: cC-zmpo148038a08d1
ccacgcgtgcgaaaaaagaaaaaaaaaaaaaaaaaaaaaaattttaaaaaattttaaaaaaaaaaaaaaaaaaaaaaaagggggggggggggcgttttaa

SEQ ID NO: 15677 - DNA, 311 bp, Zea mays
  unsure at all n locations
  Clone ID: cC-zmpo148038a09d1
atgaaaatacgcgcaagactaacgaaaaggaacaatntgcatggcttttttcgccgtcaaaccgctgcttgtcggggagtctcttgggagccttattcccagaggtttgcacggtcacatcacgttcgccatgcaatcaagaacccggtcatcgacacatttggacatgctgaacatgcatgtggccgcgtccgacaaactcacaaagcacgcgcgtaagcacgtcacggtggcggcccttactattacaccgccaaaggcacaggcctctagaacctgcgacacgatgttcatgaacactcatgacacca

SEQ ID NO: 15678 - DNA, 77 bp, Zea mays
  Clone ID: cC-zmpo148038a10d1
gaaccaagtgcgttaattctttctatcgaattacgcgcctttatcttcccattttccgactctatttgcaaactgaa

SEQ ID NO: 15679 - DNA, 453 bp, Zea mays
  Clone ID: cC-zmpo148038a11a1
gtactgtaccaaaagcaaggttccatagcgcgagaaaggtacatacgtcaacagcgacggaatgggccacgagggtgggtacgctagcagtagaaagatggctacaacacgaaagggaacaccgaactcatcgaggtccgcttgccctagggaccacaaggcttcacacgataacagccctcccctcacatgtcatcggcctgcacctcctcctcgtcctcgtactcctactcgtcggcagtcgcgtcctggtactgctggtactccgacacgagggtgttcatgttgctctcgggctgggtgaacttcatctcgtacatgccctcgcccgtgtaccaatgcaagaaagcctttctcctgaacatggcagtgaactgctcgctcacccttcggaacattttctggatggaggtcgagttgccgatgaaggtggacgccatggacaggcccctt

SEQ ID NO: 15680 - DNA, 495 bp, Zea mays
  Clone ID: cC-zmpo148038a11d1
gcgtgcggtacgctgttgatctcaaagatcagggaatttttccctgttcgcatgatgcttacattctcagttttggggtcaccgagggtatctgataccgtggttgagccatacaatgccactctttctgtccaccagttggtcgagaatgctgatgagtgcatggttctcgataacgaagccctctatgacatctgcttcaggactcttaagctgaccacccctagctttggtgatctgaaccatttgatctctgcaaccatgagtggagtcacctgctgcctaaggttccctggtcagctgaactccgacctcaggaagctggcagagaacctgatcccctttccccgtctccacttcttcatggtcggcttcgcgccgctgacgtcccgtggctaccagcagtaccgggccctcacagtccccgagctcacgcagcagatgtgggatgccaagaacatgatgtgtgccggtgccctttgcatgggcgttacc

SEQ ID NO: 15681 - DNA, 476 bp, Zea mays
  unsure at all n locations
  Clone ID: cC-zmpo148038a12a1
ctgctgtactcgatcgtgtgtatatggagtagaggtagatacaatctgcttgactgattgggctcaaaattggaagaacaaaattaaaaaacaaaaaagaagaagagggaggaggatcctctcgtacgtagcagacgtcgtcttcttcatcatcatcatctccaacctcggaatcaggcaattgcttcagtagtaattaattaacaatccaatcatcactcagtaaataagtcagcgctactacgtacgtacgtagataggaaccaacagatgggtggatggagtcagttattgtttggtgttttgttcttgttcttgtccaggtccgttgcatagtagttgcaagtgatgaagacgccgcccttgaagcactcggctcgtgcgcagacgaccttggtgctcctcttgccgaccaatagcgcgaagtggccgcactccttgaagacccntgcgtacttgcacttttccttttcctt

SEQ ID NO: 15682 - DNA, 530 bp, Zea mays
  Clone ID: cC-zmpo148038a12d1
gcgtccggccggccgcccgcggtcaccctcgcgctcttttgtcacgctggatcggacggaccccggccccctccgggccaactgcaacgttggcaagagaggagggcgttcctaaccaccataacctgcagcatggcccgcctgcccaccagcagcggcatggcagcactgctcctcctcgtcgccttcgtcgtcctcccctccgccgccctgtcctcctcgtcctcgcttctgcactcacctcctgagagtgatgagacaagcggcggcagcgagcagcaagccccgccggaagacgagaacaaggagaaagagcggcagctggccaaggagaaggcgtacgcggcggagaaggtcgtccagcaggagatgctcaagtacgccaaggagaagggtctggtgtccccgaccaacggcacggggtggtacaggggcatcgcccgggagttcgtggacgcccacaacgagctccgcgcgcgctacggcgtgccgcccatgaagtgggacaaccagctggcgcggcaagcgcg

SEQ ID NO: 15683 - DNA, 413 bp, Zea mays
  Clone ID: cC-zmpo148038b01a1
atagagcaccccccctttttttacccctatattcctatctttctacttctttatattttatttggtcattgggaaaatttaaaaaagcgcataccccccaaaacccaacacaataccaaaacaatcccccaaaaatccctaccaaaccccaaaaaaacaccaccatcacccaaaagcaaaacaccttaccacaaataaacaaaaaaaaaacacctcacaccataaaaaaaaaaccaaccccctaaaaacaacaaaaaccacaaccaaaaacaaaaaaaaacaaacccctaacaaaaaaataaaaacccccacccacaaaaaattaacccccccaacaaagccggtgaaaaacaaaaccccccaccaaaaaaaaaacaaaaaatccccccacccaaaaaaaaaaccccaacccc

SEQ ID NO: 15684 - DNA, 467 bp, Zea mays
  Clone ID: cC-zmpo148038b01d1
cgtcgccccgcgtccgcccacgcgtccgaaaaaaaaaaatatatatttttaaaaaaaaaaaaaaaaaaaaaaagaaaggggaaaattaaaggggggtctttcaaaaatcccggttttctttcgcggtcctactctctcttcccttttcttcgagtccctcccttttattgggtgccccctgttttttcctttgcctctgctttccccctgcgtttccccaattccccggcttttccccattttccttttttgcagtgggcgttccttttccctagttcccgccttttcgcattgtcctcccctttttgcccttatcacactaatggggccgcgcggcggggggggggcctttctcctttgtggttttttcattccccctcgtctggccggtttcccccgcctggcgcccttactcccttcccttttccttttttcccttccttttcgcccccttccctcctttttcc

SEQ ID NO: 15685 - DNA, 464 bp, Zea mays
  unsure at all n locations
  Clone ID: cC-zmpo148038b02a1
atacgcagtttaaacatgtactggtgtcaataaatgaggtcggggggcaatgcttcccctgttgcaccantacagcccagttcacaactaccatgcacagagtgccacgctggcaagagaaccagcagcagcaggtttggattaaaacactccgctgtactcgtcttcaccgttcatctggaggaaccacaggattgccacgccaaagaccacaaaggatgacagctccatcgtcagggctccccatccaatgacgcccgcatgcttcaggatcgacggaatggcgatgctccctactattgatgcgcccgtcaagaatttcgtgaagttcacccagccgtctcccccattggacatcatggaggaagtatcagaacccaggaaaaatatgaggggcattggtaggataaggtacatgagaactgttagcattggccaccacttgttatagagagcacaagcca

SEQ ID NO: 15686 - DNA, 623 bp, Zea mays
  Clone ID: cC-zmpo148038b02d1
cccggtacacccccgcgtccgctcctgcgctcctcctgccgcacacagccagaaaatttttgctgttgtttgtttgaggataggcgacagctgggcgagtccttcgtgttgaaggagaaattgtagctgaagtgaaaaaacagcagggaacgatggcactatcacgaagtatgagagcatgtttgcacagtggaagacttgcacttcttgccatattggtctctggtggaattgtattgcaaatcttggcttgtgctctctataacaactggtggccaatgctaacagttctcatgtaccttatcctaccaatgcccctcatatttttcctgggttctgatacttcctccatgatgtccaatgggggagacggctgggtgaacttcacgaaattcttgacgggcgcatcaatagtagggagcatcgccattccgtcgatcctgaagcatgcgggcgtcattggatggggagccctgacgatggagctgtcatcctttgtggtctttggcgtggcaatcctgtggttcctccagatgaacggtgaagacgagtacagcggagtgttctaatccaaacctgctgctgctggttctcttgccagcgtggcactctgtgcatggtag

SEQ ID NO: 15687 - DNA, 382 bp, Zea mays
  Clone ID: cC-zmpo148038b03a1
ataacggatttaaaatccatgaacagtatcatcgagagttgaggggggaataatcatgtattggccctgtacgcgtccatggatctttaatggccacaggtgccatgaaaataataccgcacaggattagagggggtttcaatgagtgatcgacatgccgacggacacatcgatcatcggccgcaaccgttcatccttcatcggccggcgaggcagccaggacgccatgcgacgcaactgttcgcgcctattggcagtccgccaacaggcactggcaatacggcctccacgaccatgcccagttgcagcggccgtccgcgtggccgtgatcctggcaggtcgccacgcagtcttcgggaaagcagatagggtggtggtcgtc

SEQ ID NO: 15688 - DNA, 401 bp, Zea mays
  Clone ID: cC-zmpo148038b03d1
cccggtaaacccccgcgtccggacgaccaccaccctatctgctttcccgaagactgcgtttcgacttgccaggatcacggccacgcggacgggcgctggaactgggcatggtcgtggaggccgtattgccagtgcctgttggcggactgccaataggcgcgaacagctgcgtcgcatggcgtcctggctgcctcgccggccgatgaaggatgaacggttgcggccgatgatcgatgtgtccgtcggcatgtcgatcactcattgaaaccccctctaatcctgtgcggtattattttcatggcacctgtggccattaaagatccatggacacgtacagtaccaatacatgattcttcacagttcaactatcgatgatactgttcatggattttcattccgat

SEQ ID NO: 15689 - DNA, 468 bp, Zea mays
  unsure at all n locations
  Clone ID: cC-zmpo148038b04a1
caaagctggatccttaagcgccgcctttttttttttttatctgttttttgcagagtcgctcgagatctcgggatcaatgggggaccccataataggggggaaagattaaaaaaaacgggggaacgaaatcatcagcaactcacgggacacacggggagtcacagatctcatcaactgttacaatgggcatacgcagcaccatatatatttttgttgttgttcatcttcttggctagagactcaacgaatcaagcaagagcacataatagatcaagaaacggatcgtatcaccacgcatttcttgggcggagggaggcgcggttcggtcaggtcacatcttggcgacggaggcggaagagccggaccggtcgtagtattactcagggatcgggcgggagaaggagcggcgggcctcctcgaggtcctcctcctcctcgtcgccgtcgtcctccgnggtgtggaggtgga

SEQ ID NO: 15690 - DNA, 378 bp, Zea mays
  Clone ID: cC-zmpo148038b04d1
aaccaaccgaccgattaacccaccaccgcctcgcctcgtctcttctctctttttcggacaaagccggggccgttcggcggggggcaggggacgcacgggcaggcagccatgaacggcatcaaccccaacggcgggttcctgtcgtacgggaacatggagagctatgcgatgtgggtggcgaccggcgtggcgtcggccttcttcgcgtccctcgagcgctgctcctgcatccacctccacaccgcggaggacgacggcgacgaggaggaggaggacctcgaggaggcccgccgctccttctcccgcccgatccctgagtactactacgaccggtccggctcctccgcctccgtcgccaagatgtgacctgaccgaacc

SEQ ID NO: 15691 - DNA, 436 bp, Zea mays
  Clone ID: cC-zmpo148038b05a1
acaagggccttttgtaaattaacacaaatcaatggcccacatatatgacagatcaccgtggtcaaacaaattttgtcgagaatttaaatacgggtatatatatagagagaagctacccacaacgacagcaatggcagtagtttttttcttttctttttggggggtgtatgtgaaattgtgtatatatatactggcgaagcgccaccgtcttttccaccgttcaacggtacgttcggccgcaaccacaacgtcaatgtatggtgtgccatcgggggagccaggctgtgtgacctggcatgcatgcataccaaaccaaaccaaaccgaccggtttggtaacaacggcgccccccggaacaactagcgctgggctcaattcatgttgcgggccctactcttgatggcggaccacccccggcggtaggggttggcggcct

SEQ ID NO: 15692 - DNA, 500 bp, Zea mays
  Clone ID: cC-zmpo148038b05d1
gcacactgcgaggcgcagaaggccgccaacccctaccgccgttgttgctccgttcatcacgcgctgcgcccgcaacatgaacggagcccagggctagctgctgccggggcgcgccgtcgtcgccgagccggtcggtctggtctggtctggtctgcctgcctgccaggtcacgcagcctggctccaccgatcgcacaccatacattgacgtcgtcgtcgcggccgtacgtgccgttggacggtggaggaggcggtggcgctacgacagtatatatatacacaattacacatacacaccccaaaaagaaaagaaaaaaactactgccattgctgtcgttgtgcgtagcttctctctatatatatacccgtatttaaattctcgacaaaatttgtttgaccacggtgatctgtcatatatgtcgtccattgatttgtgttaatttgacaaaagacgttgtatagaaaaacatataatttaaatcatactctaaatttttttgg

SEQ ID NO: 15693 - DNA, 411 bp, Zea mays
  Clone ID: cC-zmpo148038b06a1
ctttttcttttttcttttttctttttctctttttttttttttttgggccccttgtttcttttctcccctcttgggcgaaaaacaaaaatggaaaatggcctcccctcccattccaaatgccggtcttttccctcccggaaaaccagggccccaaaaccccaaacccttccccaccccccaaccagggttccccccccccccggctttccagaacccctctccccccctcaaagtgcacttgcccccgcccgggcctttttaaagggccccccactttacaatgtcccttcccctttccctcgggtccgttgcttttagctcccccctaatgccccccccccccccttttaacccgtccttggagcttccgcacaaaaccttgatttttacccctctattttcccggcgccc

SEQ ID NO: 15694 - DNA, 544 bp, Zea mays
  Clone ID: cC-zmpo148038b06d1
gagtcccaggagctcaaggcaaagaggagcttccgcttcatcgttttcaagattatcgagaacgtgcagcaggtggtggtgggcaggctgggggagccaggcgagagctacgacgccttcacggcctgcttccccgccaacgagtgccgctacgccgtgttcgattttgacttcgtcactgacgagaactgccagaagagcaagatcttctttatctcttgggccccggatacatcgagggtgagaagcaagatgctgtacgcgagctccaaggaccggttcaagagggagctggatggcattcaggtggagctacaagcaaccgacccgagcgaaatgagcatggacatcgtcaagtcgcgagccctctgaaacagccccggtcgctgcacctgcacgctgcaggggcgcatcggctcctgcatgcccgtgggtcgtcgaatccttgcttgtgtgttgggaacggtcttgggtttcgtgtccttgttttctggaagcaaagccctgcattctggatgagactgtatgccattttccatctttt

SEQ ID NO: 15695 - DNA, 451 bp, Zea mays
  Clone ID: cC-zmpo148038b07a1
agaccttgataccatgaggggatagggttaactaacaacatgataacacattgaaaatcaaacagaaagaaaaagagggagagcaaggatgtatccatggatgaccacacattattatggattcatggttttaaagacattgctctcatttttcttccatgtcttgttccaaatttaaccgggccgacatgtgtggcctcagttggtggagtcatcatcgtcatcctcattgcctgacaggccttcgacaccctgggggccaggtgcaacaaccggcccgctaggtccatcggccggctcttcatccacaggggcatcggtagactttgcctcggccatcggtgctacgaccatggcgacgaagaggagagcagcaatgacaaagacgacgctagcgcgagccatgggtacggtgtttagctttttagggttggttggtagctgtttaggc

SEQ ID NO: 15696 - DNA, 487 bp, Zea mays
  Clone ID: cC-zmpo148038b07d1
ggagacaccaagcgttgaactcgcctaagcagctaccaaccaattttagaaagttagacaccgtacccatggctcgcgctggggtcgtctgggacattgctgctctcctcttcgtcgccatggtcgtagcaccgatggccgaggcaaagtctgccgatgcccctgtggctgacgcgccggccgatggacctagcgggccggctgctgcacctggcccccagggtgtcgaaggcctgtcaggcaatgaggatgacgatgatgactccaccaactgaggccacacatgtcggcccggttaaatttggaacaagacatggaagaaaaatgagagcaatgtctttaaaaccatgaatccataataatgtgtggtcatccatggatacatccttgctctccctctttttctttctgtttgattttcaatgtgttatcatgttgttagttaactgtatcgactcatggtatcaaggtctaaaaaattatcgtc

SEQ ID NO: 15697 - DNA, 477 bp, Zea mays
  Clone ID: cC-zmpo148038b08a1
aaaacacgggaatggggttggtttttagagaaaaaattttataccctcaaattcagggggttacacccgtcaacataatatagctggcggatgtctgtcattttactggggggcgttaccaatggatagcatgtaatgggcaatgcaagggcgagagaaaaattttaacttgagagatgggtcagccgacggagggtctaaaagcatgcaagctccttgaggcaacccttggggctgcccttggcgttcgtgcatataaccatgggcttggtggtggggccgctatactcgacgttgacctcatccatggggacccccgggcatgggaccttggcagtgcaaaacaagctaacggccttcggggtggaagaggtgcccgtgatgttcttgaaggtgacgttctttacggtgactcttggaggcccccttgcaaaacacaacttgttggggcaatactttatgttcatgaaaaggggg

SEQ ID NO: 15698 - DNA, 595 bp, Zea mays
  unsure at all n locations
  Clone ID: cC-zmpo148038b08d1
gatggcatgcacaaacaatgcgatgagagccttgtttttcctggtcctcttctgcatcgtgcatggtgagaagggggagtcagggggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggtgaggtgtccggngtcacgctgctcaactccaagttctttcacatgaacatgtaccggtgcaaggacatgctgatcaag

SEQ ID NO: 15699 - DNA, 390 bp, Zea mays
  Clone ID: cC-zmpo148038b10a1
catcaatcacattgttaaatatatcgcatacggtttttattattacattgcatgtacgtgacattgttgtagaatagaagagaagtatttccccttccaaacaaacaaaaaagaagggaaaacgaagttcgtaatcgtagtatcgaacacacaatcatgtttccctttcctcgatcctcttttcttcccgcggaaaacgaaggaagcccacgcatcgtcggaggagcttgtggatagctcgctcgcgggcctgtcccgatcacctgtcgtcgttgtcgaccaggtgcgacgggctgctgcaaaagccggtgccgtaaaacctcgcccacaccttcttctacagctcccccttttcctccagctgcaaggcgggcttcacgggcagcgcca

SEQ ID NO: 15700 - DNA, 640 bp, Zea mays
  unsure at all n locations
  Clone ID: cC-zmpo148038b10d1
ggagcaccgctcctgcagcgaggtggccggcggcacctgttgcgggcttcgccgctgtgtgctgctgcttcccctgggtcatgggggaggtcgcggtgctcgccacggtgcgcgcgcccgcggcgctgtgccgcaaggccgtccgcgtgcgcaagggccgcaggcgctctgcctccgcgggccaggccacggagatatacgagctcctcgtggacgacaccggcgttgtcgaggtggatgccggcgccgccaatgcggtggcgctgcccgtgaagcccgccttgcagctggaggaaaagggggagctggagaaggaggtgtgggcgaggttctacggcaccggcttttggaggagcccgttgcaggtggacgacaacgacgacaggtgatcgggacaggcccgcgagcgagctatccacaagctcctgcggcgatgcgtgggcttactttcctttccgcgggaagaagagaggatcgaggaaagggaaacatgatngtgtgttcgatactacgaatacgaacttccgttttccttcttttctgatggttggaaggggaaatcctttcttttatttacaacatgttacgtcatgcatgtataataaaaaaggttggatttattacaatgggatgttgatgt

SEQ ID NO: 15701 - DNA, 523 bp, Zea mays
  unsure at all n locations
  Clone ID: cC-zmpo148038b12a1
gaatagncgcttgcattatccatcggggtcggtatggacagtcggcaagaacatcaatgtccatgctagaattatcatgcagttgtacaacacatgcacgagacccgtgcgtgcaacaaaggaagaaaagggagcatccatccaccacccaacaaggctgaataaataactatgaacaataaatcgatggtaccaacaacggctttgtgaacaagctgcagacttgatcttcagtccagtccagttcagatcagctcaccaatctaggctaatgttcctcgagaggaaaagggtgtcgatgtactctatgataggactagaagcatcaatgtatctcctcatctccttctgcacggagaaatcagtttcattcagccgcactatcaactgctccctaattggaagagtgtacatgccagcaccaacagtctttctgatcgcccagctatgaaacggcgcgcaaacctgcccgtaagctatcgtagcagcattatacaatgttccctcggtatcgaggaattgg

SEQ ID NO: 15702 - DNA, 518 bp, Zea mays
  Clone ID: cC-zmpo148038b12d1
gcgtgcggagccgcgcgcggaggcgaggcgttcgcactttctcgcctctttccaccaccaccgctccgttgcgcccgggagccgtggggcgtgacgtttcccggggggccgggggagagagaggcagaaggaggaggcacggagaggacgagacaggatgctcgggttcaggcagatgccgtggtcgtcggcgcaggagcaggagcaggcgccgtcggagcagctgtgcgagggggtgtcggccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttcagcagcctcgggatggccttcaggttcgccgagatcgagtacgtcaccaaggtgaacgatctcatcggtgccggcaagttgtaccgcacgttgagcgacattcttgacaaggacatccagaatgact

SEQ ID NO: 15703 - DNA, 301 bp, Zea mays
  Clone ID: cC-zmpo148038c01a1
tctttttttatcttgctctgtttacaaaccagaaaatccctgtggggaatgggggtgaataatttaccctaccactcccaatacacattcttgtgaagcctggacaccatctatattcagacgccaaaaggagaccgatcaacaacctatccggctttgacaactggaaggccagtcaatacgcacaccgctaatgcccatactcgtgcgctagctccggccgcgtgcctactacgaagaaggggagaaccgtaaataccaggcggcctacgatcccatgaaagggcaagaagggggacct

SEQ ID NO: 15704 - DNA, 586 bp, Zea mays
  Clone ID: cC-zmpo148038c01d1
gcgtccgcgccgcgcgagctgctgctggcgtcgatgcgcgtcgttttggataaggccagggaggccaagagccgggtggacgagggcgcggcgaggaaccacgagggccggccgatggagtccatcctcggcgcctgcagcaacgggtacggcaacgttgtgcagacgctcgaggaggcgcggaagatcgtcgccacgcgggcggcggcgggcacccaggcccaggccgacgacatgaacacgaagctgtcggccgccgtcacgagcgccagcgactgcgacaacgccttcgccgacttcccggcgattaggtcccccttcttgcccatgcagcggaacgtctaccgcctcgtcgacaacgttctcaacatcttcgtcgtcgtcaaccagccggagcacgcgcacaagcacgggcactagccgcgtgcgcgctggccggcctgccagttgtaagagccgggatggtgttgtatcgatctcctttctgcacttgaatatatatgtgaacaaggcttgagaaaaatctgtattgctagttgtagtgtaactcgatcaggttactgctaacacggaatttagggtttat

SEQ ID NO: 15705 - DNA, 446 bp, Zea mays
  Clone ID: cC-zmpo148038c02a1
gaaaaaaaattctttaaaaaaccacaggggggcagaaaaaaaaaaaaaaaaaaatccctaaaccaaaaaaaaaatttgggcctaaaaacctcccaaaaaggaagtccccccccgggggtatgggcccaataaaaaaaaaaaaatttttttaaaacccaaaaaattccccagggggttttccacaaccttttttttttataaaaaacccaaaggggtttgaaaaaaaaaattcttttattttttttggggccgggggggttaaaacccccaaaaaaaaaaaaaaccccattttttcttttttaaaccacaccaaattttggaaatgctattccctgaaaattaataaaaaaaaaaaaatgggccctaaaaaaaaaaaaaaaaatgctacccttttaaaaaaaaaaccccccctcacaaaagcccttttttttcctactttctcaaaa

SEQ ID NO: 15706 - DNA, 627 bp, Zea mays
  unsure at all n locations
  Clone ID: cC-zmpo148038c02d1
gcgtccgcccacgcgtccgcccacgcgtccgggttaatcctcatatttcatcatctaaaattgtgtgactttggcagcgcgaaagtgctggtaaaaggcgaaccaaacatttcttacatctgttctaggtactacagagctccagagctcatatttggtgctactgaatacacaacagccattgatgtttggtctgctggctgtgtgctcgctgagctgcttctaggacagcctctgttccctggagaaagcggtgttgatcagcttgttgaaatcatcaaggttctgggcacacccacacgtgaagaaattaagtgcatgaatccaaattataccgagtttaaattcccgcaaatcaaagctcacccatggcataagatattccataaaaggatgcctgctgaagcggtagatctcgtgtccaggcttctgcagtactcaccaaaacttcggtcgactgctttggaagcattggtccatccgttctttgatgaacttcgggatccaaacacccgcttaccgaatggtcgttntcttccgcctctcttcacatttaagccccatgagctgaagaacgtgccggcggatttcatggtgaaatggtccctgagcatgcacggaaagcat

SEQ ID NO: 15707 - DNA, 537 bp, Zea mays
  Clone ID: cC-zmpo148038c03a1
aatattaacattttgcttgttttccactgtgtggaggggggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctagtacaattggacgttggaagtgtagacggcatcgggtctccagttcggcgggatgacctctttggcgatgaccttcttgccggactctctggtgaggcggatggagaaggggcccttgagcgccttggcagtgtccatcctccagatggcgccccaagagagcttcatgggcttccactcagccgacaacttgtcctggatttccatcagcacgatgtcgccgtcgttcgccacatacttcaccagcacgggcaagttaattggggttgcaccccttctcgatgtggaacaccatcttctgcccggggg

SEQ ID NO: 15708 - DNA, 604 bp, Zea mays
  unsure at all n locations
  Clone ID: cC-zmpo148038c03d1
cgtccgcccacgcgtccgcccacgcgtccgcccacgcgtccgcttttgcgttttcggacgcgtgggttcgaataacacgggtgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcgngcaggccttcggctccctggcaaagcccgggctcaacgacaagattcgccactgcggcatcatggacgtcgagttcagaagggtgcgatgcaagtaccccgtcgggcagaa

SEQ ID NO: 15709 - DNA, 639 bp, Zea mays
  unsure at all n locations
  Clone ID: cC-zmpo148038c04d1
tcaagtgcgacgagccagcggagtgctctggcaagctcgtggtgttatacattacagacatgaactatgagccgattgcgggggtaccacttcgacctagcaggcacggcgttcggtgccatggccaagaagggcgaggaggagaagttgcgcaaggcaggcatcatcgacatgcagtttcgaagggtcaagtgcaagtatggatctaaggtcaccttccatttggagaagggatgcaaccccaactacctggccctgttggtaaagtacgttgatggagatggtgacattgtggcagtggacattaaggagaagggctctgacacgtacgagcctctaaagcactcctggggtgccatgtggaggaaggacagcgacaagccaatcaagggacccatcaccgttcgactcaccaccgagggaggcactaagactgtctacgacgacgttatacccaccgactggaagcctcacaaccgctacaccaccatataaactaacccacatatattatgtattcaatgacatactngatagaccttcatgttattcttcatcaacaaaaggaataaggggatgacaacacacaaacattgattatttatgatcttcatgcatcccactttacatgaatctttt

SEQ ID NO: 15710 - DNA, 334 bp, Zea mays
  Clone ID: cC-zmpo148038c06a1
tcctctaaaaccaccgccctttctttttttttatctttttatttaaaccctttttttttttttggccccctgtatattttaaacctttttcccccgggacaaaaaaaatatattattaacccccattacaaatatctttttaaaaacccccatacatttattttaaaaggcccgccacaaaaaaatacaaatacccattaatttgctcccccaaaaaaacacatattcgaatctttatttttgaaataataactgctggcccaaccccaaaaaaaaaacccagcccttttaattctaaccccccgcggaataaaaaacccaaaatagcatcccc

SEQ ID NO: 15711 - DNA, 409 bp, Zea mays
  Clone ID: cC-zmpo148038c06d1
cccgggtatggacgaatatgctgacgttttacgctttttgtggagcgtgcattccaacatcggggagcggggggacctcggggagcagttctacatcagcgtcgtctcgccggcgcgatcactgcgcgacgagtacaacatgcccgacaacgccctccgctgcggcaaggtcgtggggctgccgctgccgccgtcctacgcccccgcgcgctaagacgacgaaggcctcgttttctcctcgtggtctgaccatccaatccaaactcaaaagaacaaatacgaaagaagcgtagtgaaggggaacaaatgaatggatatatgtaatcttgagatgcatgccctctcaaatcactgtactggggttctcaaaaaaatcattgtaatgggagttatatatataactttatct

SEQ ID NO: 15712 - DNA, 376 bp, Zea mays
  unsure at all n locations
  Clone ID: cC-zmpo148038c07a1
caatgcnccgaccatgtattaaagggggacggtgggcaattattgtggacaacggttgcaggatgcaaagcaagaactggagcccttgatcttaagaaactaagcagggagatcttaccggttgcattgtagcagccagcccatacaagacgacgtgtgcgtggcggcagatcatttgatcagctgatcaattaagagcgctagctatcatttcccttgccgttcctgcagtgagccgcccccgcacggtcgtgcgcggtccttcggatgcatgaagagcttgaacctgccggccttcttgcatggctgcatcaactcctgcgaccgcaggcgcatctgtcgtagtacgaggcgttcaccctcgcggtgcgcccgt

SEQ ID NO: 15713 - DNA, 566 bp, Zea mays
  Clone ID: cC-zmpo148038c07d1
gcgtgggcccctgcccttcccctgttcctcgaccactttttacgagtttctgctccgacgacgacgacgcgccggcgcggccagggggcggacgacgccgtcgccgccggagcggccgtttgctgcgcagggccggcctcgctgtcttctagcaggaagcagcaggagcagcccgacgacgccggctgcggcagcagcagcagcgacgaccactaccagcacgacgtgatcatgctgaggcggacgaggagcgggcgggcattcccgccggcgatctccgtgatcggcaagggcgggcggtcgaggctctgtctgcgggcgcaccgcgagggtggactccttttgctgcggcatatgcgcctgccgtcgcaggagctgctgcaaccctgcaaggaggacggcaggttcaagctcctcaagcacacggaggccaccgcgcggccgtgcgggggcggcacactgcaagaacggcaagggaatgatagctagcgctcttaattgatcagctgatcagatgagcttgcccctctcacacgatcaatagtatgggctggctgctacaatgc

SEQ ID NO: 15714 - DNA, 450 bp, Zea mays
  Clone ID: cC-zmpo148038c08a1
aaacacaaacttattcatgattgggatagggtgggtttacgcacaccacacaaccggtccattattaaaccaacactgacacgaacaggagatactttgacaacctccatatggagagggcaccagacgacgcaggcacattggcagcttaaacgacccatgacttactgaccaccacggagacggagcacaaggtggagggtgctctccttttggatgttgtagtctgctagggtgcggccatcctccagctgtttgccggcgaaaatcacacgctgctggtccggggggatgccctccttgtcctggatcttcgccttaacattgtcgatggtgtacgagctctcaacctccagggttatggtttttacagttagggtcttcacaaagatctgcataccacccctgaggcggaaaacaaggagaagggggctctccttctggattgtt

SEQ ID NO: 15715 - DNA, 555 bp, Zea mays
  Clone ID: cC-zmpo148038c08d1
ccacacacgcaaccagatctcccccaaatccagccgtcgttttcctccgttttaagatgcagatctttgtgaaaaccggggctggggggactatcaccctcgaggtggagtcgtctgacaccattgacaacgttaaggccaagatccatgacaaggagggcatccctccagaccagcagaggctcatcttagctggcaaacagcttgaggacgggcgcacgcttgctgactacaacatccagaaggagagcacccttcaccttgtgctccgcctcaggggaggcatgcagatcttcttgaagaccctgaccggcaagactatcaccctcgaggtggagtcctcctacaccattgacaacgtcaaggccaagatccaggacaaggagggcatccctccagaccagcagcggctcatctttgctgggaagcacattgaggacgggcgcacgcttgccgactacaacatccagaaggagagcaccctccacttggtgctgcgccttagaggaggcatgcagaactttgtgaagaccctgacccggaagactatcaccc

SEQ ID NO: 15716 - DNA, 489 bp, Zea mays
  Clone ID: cC-zmpo148038c09a1
gcaagtagcctcatcaggcatcgggttaaagttgaataggtcgaacatgtgtccaaaatgacaagtgagaagcattaggtagcaacaatagacattacagtcttgatgaataggagaaagcggttgccgacagaccggcagaaaactttgttcatgctaatgaagaaacagcaacaaaaggagaaagaaacggggcgggaggctggcgataatggctcctctcggcttgcatctcttgggcccaaagaattagaagcatttcctgtgcacaatggacgggccagactcggcggactcagccttggcaatccacatctgctggaaggtgctgagcgatgccaggatggatccttcaatccagacactgtacttcctttctggaggagcaaccaccttgatcttcatgctgctaggagccagggcggtgatttccttgctcattctgtcagcaatgccagggaacatagtggtaccaccggagaggacgat

SEQ ID NO: 15717 - DNA, 580 bp, Zea mays
  Clone ID: cC-zmpo148038c09d1
tcctcctgtcctccatctctcaacgcctgaagctcaccgcatttcccctttttgccgcggatcccccactactccgggggggaatgggggacgctgaggatatccagcccctcgtctgcgacaacggaactggcatggtcaaggctgggttcgccggcgacgacgctccgagggccgtcttccccagcatcgttgggcgcccgcgccacaccggtgtgatggtggggatggggcagaaggatgcctacgtcggcgacgaggcgcactccaagaggggtatcctgaccctcaagtaccccatcgagcacggaatcgtcagcaactgggacgacatggagaagatctggcatcacaccttctacaacgagctccgtgtggctcccgaggaacaccccgtcctcctcactgaggcgcccctgaacccaaaggctaaccgtgagaagatgacccagatcatgttcgagaccttcaacacccccgctatgtacgttcgcatacaggccggtctgtctctgtatgccagtggtcgtacacaagtatcgtgctcgactcggagatggtgcagcccactgtcccatta

SEQ ID NO: 15718 - DNA, 345 bp, Zea mays
  Clone ID: cC-zmpo148038c10a1
gttataaaaccgcttcaccattttataccgtgtcgggctctatttaaaagctggcttgccttctcaaacttgtacattgcaatgtccttctgcggcatgaaattaacatcatcgttatattttgaatggaaatatacatccacactattagaaatgaataaaaaagttcgcagattgccagatgcctaaaaaaagactggctagagtgataaagatagaggtgactaatagtgagtgatggatgcaagaaggttcatacgcatgcgatcttcttcatcattccaatggacttgccgatggcgttcttgcaaaccgacatggtcttgttgtctgacctcttgtact

SEQ ID NO: 15719 - DNA, 289 bp, Zea mays
  Clone ID: cC-zmpo148038c10d1
tgcggggatgaaggcagccgcggccgctctgtaggcgtttttcgcggagccgactgccgcgcgcgcgggggatggggaggcggttactaaggcaaatgctgtgatacgctcgccgatagtgaccgctgactcgctggacaactctcagctgcgcgctaagggcgacggcatgtcggacagcgcctcgatggtgctcaaggcgtggaaacacgcgagcgaagcgacggggcagtagaacatcgacatcccgtgaggcaactaccctgacgggtgcgctggacctggtggg

SEQ ID NO: 15720 - DNA, 414 bp, Zea mays
  Clone ID: cC-zmpo148038c11a1
gaattaagcactctgttacatttttttatggggtttgggtccttttctttcaggggatactgctatccatgccatgcgcgcgttcgctctgtatcatcgatatagatatgtgcagcctgtccgcgacgccgccgtggtacagtttactggtcgtcgtcgtcgcccgagtccagctgcttgagcagcgcggcgcaaacggggagcggcacgtccttgaagtaaccgagcgggttggcggggcgcaggctgtcggagatgccgacgttcctggtgagcaagacaccggcgcggtccctgagcgcctggacctcgtcgcagtccttgcgcgggctggccaccagcaccacctggcagatgtcctcctcgtggctgtccttgagctcgatcgtgtaggtgccggtcgcgtcggtgacc

SEQ ID NO: 15721 - DNA, 541 bp, Zea mays
  Clone ID: cC-zmpo148038c11d1
accctccctccctcacacaaataataaggaaaggtcccgcccttttcctccgttatccacaggggggaggggaaaacacgggcattcagggggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagtcacgaggaggacatctgccaggtggtgctggtggccagcccgcgcatggactgcgacgaggtccaggcgctcagggaccgcgccggcgtcctgctcaccaggaacgtctgcatttccgacagcctgcgccccgccaacccgcttcgttactt

SEQ ID NO: 15722 - DNA, 407 bp, Zea mays
  Clone ID: cC-zmpo148038c12a1
agctgccctggctcctgggggaaggggtgtagtaagtacagttcttagtacatggatcgactgttgctggaccaaaattagtacagtaacgtttttagttgacagaagacaaataaaaacaagaattttttaagaggaaacaaaaaaaaatggaacaacacattgctcaaatcgataatggatggataagctggaccggccaatggacgtgccgcggcactgtcaagcaagaagctctagcgttgttgttattggtgtcatgtcttcctcctcgtcatggacgtggcgttgccgtcgaagagctcgttgatgatggtctccacgttcttagcgctgagcttgacgtacttcttcgtttgccttccggcgctgaaatgctgcgcgaagcggccgatgaaggagcggtt

SEQ ID NO: 15723 - DNA, 540 bp, Zea mays
  Clone ID: cC-zmpo148038c12d1
ggacgcgctggaggcggtgatcgtgacgtggaccaaggcgtttttgcacgctttcaacgtgggcctgtccacggagcacgagctctgggcgcgcgtcttcgccggccgccacgccggcgtggggcgcggcatcttcgcggacctgtcccgctgcgtcatgctgcacatgctcagcttcacggaggccgtggccatgaccaagcgcgccgcggagaagctcttcaaggtgctcgacatgtacgaggcggtccgcgacgcgtcaccggtcatcgaggccttcctctccgccgacgagccggccgccgagcacagccactccggcctggcggagctcaagtccgagatcgccgccgtgcggtcccggctcggcgagtccgccgccgccatctttcgcgagctggagagctcgatccgcgccgacgccggcaagcagacggtgccaggcggcgcggtgcacccgctgacccgctacgtgatgaactacctcaagtacgcgtgcgagtacaacagcacgctggagcaggtgttccgtgagcacca

SEQ ID NO: 15724 - DNA, 431 bp, Zea mays
  unsure at all n locations
  Clone ID: cC-zmpo148038d01a1
aaaaacaacttcactggcaacagcgatgtaattaagagatggtttacaaccatccacagcccagcccacattagaacantgttgtttcatcagaagaacctccgtggagtgaaaataatgggagacatcgaagaaggttagtttgttacatggtgtggccagtcgagagtgtctctcccgacctatgccgctatgccaactgtagagaattcaagtgtcgtctccttgctcgatcacacactgatcatcaggtatcatcagccaataattatattagttggcacgcgcatgcacggacagtcggtcagctttgctgcgcctgcttctccttcctggcctcctcgacgtccttcttcttcgcctccaccgtcgttcgtggttctcggcggcggaggcgaccttttcctctgctttggcggctgccgctggct

SEQ ID NO: 15725 - DNA, 603 bp, Zea mays
  Clone ID: cC-zmpo148038d01d1
gtccgcattcaagcacctcctcctcccccgccggccaacaactttgccgtttcaaccgccacatcagccatgggcgcgggcgcggccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgtcgagaccacgacgacggtggaggcgaagaagaaggacgtcgaggaggccaggaaggagaagcaggcgcagcaaagctgaccgactgtccgtgcatgcgcgtgccaactaatataattattggctgatgatacctgatgatcagtgtgtgatcgagcaaggagacgacacttgaatttctacagttgcataacgcataggtcggagagacac

SEQ ID NO: 15726 - DNA, 496 bp, Zea mays
  Clone ID: cC-zmpo148038d02a1
atagtaataaagaagcacaaattaccatgggtacagtgtatatataggctgccctacacgcgtgcctctcaacgagccgtttcatcccacggtctcaagacatgtgccacgccgcaagaggcaacaccgaaaagaaggacacgcgctaggtccgcatgaagtcggcatgcgtccagtctatcgactgacagacacacgcgaccagcatcaaattacatatgttttaggccggacgacgacgacgacgacgacgacgacgttaccgaacgtagtagggggtcgggaaaaagaaacaaacaaatcaatggacatgttcgtaagggatcatgttggagagcgtgcggcagatctcggacatctcgatgagcgacctgttgtggtcctccatggggttcttggagacggcctttctgaactcctcgtcgcagttctgcgtgtcctgcgccaccatgctcatcgtggcgcggatggtgaccgcgtctcggaagcccatggc

SEQ ID NO: 15727 - DNA, 608 bp, Zea mays
  unsure at all n locations
  Clone ID: cC-zmpo148038d02d1
cggcagctagctagcgatggctggagcctgggcactgctctttgttttcgcggctgccgtcgcggtcctggccgggcgggcggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcacgtggacgcgttcaagaagcgcgtgaaggcggcgcggaggctcgccaaggaggaggtcaagacggccgtgacgcccgaggcgcggagggcgctgaacctctgcaagacctactacctggacgccgccgacaacctcggtgcctgcaagcgcgccatcggcttccgcgacgccgtcaccatccgcgccacgatgagcatggtggcgcaggacacgcagaactgcgacgaggagttcaggaaggccgttttcaagaaccccatggaggaccacaacaggtcgctcatcgagatgttcgagatctggcgcacgctctccaacatgatcccttacgaacatgtccattgattngcttgttctttttccgacccctactacgttcgtaacgtcg

SEQ ID NO: 15728 - DNA, 430 bp, Zea mays
  Clone ID: cC-zmpo148038d03a1
atggatgaatcgatagattattatatatctatgctggggcgaggtatatattgtagtgatgataattttgaacgtatactgagatcaattaattgtacaagatccatgcttggctcaaaactggaagaagctagctggaaatcatgagttcagttggtggtgctcttcttcttcttcttgttcttcttcttgaggtccgtggcatagtagttgcatgtgatgaagacgcctcccttgaagcactctgctcgtgcgcatcccaccttggtgctcctcttgccgaccatgagcgcgaagtggccgcactccttgtacgccctgccgcctgtgcactgctccgcgttcctgtcgaagatggactcctccttgccccaccagaagacggcctccttggcggtggcgttccagtcgtcgtggctcctgaacaggc

SEQ ID NO: 15729 - DNA, 584 bp, Zea mays
  Clone ID: cC-zmpo148038d03d1
ggttggcaagagaggagggccggcgtcggcgtgcctagtttgatcttgaaccatagctagccagcatggcgcgcggcaggagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtgtcaccgaccaacggcacggggtggtacaagggcatcgcccgggagttcgtggacgcccacaacgagctccgcgcgcgctacggcgtgccgcccatgaagtgggacaggaagctggcgcggcaggcgcggcgctggtccaaccgcatgcgtcaggactgcgagctcgtccacagcggtcacaagtacggcgagagcctgtcaggagccacgacgactggaacg

SEQ ID NO: 15730 - DNA, 355 bp, Zea mays
  Clone ID: cC-zmpo148038d04a1
atacttaaattactagatgtctctgttacaaaatatggtatatagacatccttttagtcccgggaccacatgcaaaatgcactagccaactcgcacgaacacgcaagtacattaatgacaggaaacttgggcagaaattatctgcttctgcactagacagccataaatccttgggtaacccatggaaataatcgatcggcggcggccacagccactcctagatagatgtaattatggttgtggtggttcatgctgaggtgtggccggagagtccggtgcgatggtgaaatgcactccccttccttggcctgactgcaggatgaatgccacctccgctgcaactagagcaactgcc

SEQ ID NO: 15731 - DNA, 351 bp, Zea mays
  Clone ID: cC-zmpo148038d04d1
ggccgctgctctagctgcagcgtacgtggcattcatcctgcagtcaggccatttaaggggagtgcatttcaccatcgcgggggactcgggggccacaccacagcatgaaccaccacaaccataattacatctatctaggagtggctgtggccgccgccgatcgattatttccatgggttacccaaggatttatggctgtctagtgcagaagcagataatttctgcccaagtttcctgtcattaatgtacttgcgtgttcgtgcgagttggctagtgcattttgcatgtcgtcccgggactaacgggatgtgtatataatatattttgtaacagagacatctgggttctatg

SEQ ID NO: 15732 - DNA, 365 bp, Zea mays
  Clone ID: cC-zmpo148038d05a1
atgatcctataataaaaaatgaaggcctatcaaatagtccattgtgcacttattatataacgtgccaatccatttcttaactcttctcttttaaacaacagccaagcctcactctagctatatatggagatgaagaacatggagaaggaggatgacaccatcattgttggcgccagcatcactgtcgtaatagggtaatggtagcaaatagatatcacggtccaatgcatgcatgtgtaatgcattgcttggcatccaacccaatctagtatagctagcataggtcggcttacagtattgtcagcactaaagttaattatttggcggtgtatgcagtgttggccttccagccggcagggatgaca

SEQ ID NO: 15733 - DNA, 589 bp, Zea mays
  Clone ID: cC-zmpo148038d05d1
acgggccgtgaatgtgagaaccatgtggtcgtcgatgcgggcacattttgcgatttctgtggcgttggtgttcttggtgagcggggcatggggcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctacgcatggcgggcatcatcgacatgcagttccgaagggttaagtgcaagtacgactccaaggtcaccttccaccttgaaaaggggtgcggccccactacctggcactgctggtcaagtacg

SEQ ID NO: 15734 - DNA, 412 bp, Zea mays
  Clone ID: cC-zmpo148038d06a1
ctttcttttttttttttcaccaatccaacctttaacagtactttgcatatgcattttggaatttgtcaacccgacgctaattaaatctgtccacaacaatgtgacctgggacgacattagatcgagcaacaagggcaattgatctagtttcactcggacacgactaattcatcgccatcgcaaccacttgtacgggtattatgtatggaagaagagcgtgaataaaacactgacgaggatcagctcgagtgcttcactgaacaagccactacttgagcccagtgcctgagccttgtcttcacaagcagagggttatctcctgggttgcaaatcttccatgactccaaggcgttactagagtgcgcaccaatgctacctgggctgggcgtgccgcacaggttgggcgaggact

SEQ ID NO: 15735 - DNA, 409 bp, Zea mays
  Clone ID: cC-zmpo148038d06d1
cagatacaacggcagaggagcagcatgcgcctgatttaagccgtttatcagggcacgtggcagcactgctgtcgggcctgggggcggcgatgcgagctcgagcgcggagcggatggccactggtataaccgacggggacctggatgagctgaggggatccatggatctcggcttcaggttcgacgagcagaagggcggacaggacctgtgcgacaccatgcgcgccctggacttctatgttgacgacaaccgtcaggagtctgagcccaagatgtcctttgccacgagcacgatctgaaggccgtctatgtcggtcaccaagtccatgcccaacctctgttgcacgcgcacaccacgtgggcctggtgcgcactctagtcaccccttggagccatgggggattggcaac

SEQ ID NO: 15736 - DNA, 130 bp, Zea mays
  Clone ID: cC-zmpo148038d10a1
ggaacagctcaatcacacacatgcgtgtaggggtctgtgtttacaaaccataccacaaccaaactttaatttgggggtggaattacaaacattatctgcccaaatgcatggcaccaacatggaacaaaaa

SEQ ID NO: 15737 - DNA, 75 bp, Zea mays
  Clone ID: cC-zmpo148038d10d1
catacttctatgagcacctcatgtaccaaatcgattgtcaccacttttatctccgctgccataaacctccacggg

SEQ ID NO: 15738 - DNA, 364 bp, Zea mays
  Clone ID: cC-zmpo148038d11a1
ggggtatgggtttttttttttttcccaaccccccgttccccagggaaaaaacaagggggctccccataccaccgtccaaaaacacccgcctcacgcctttaatccccaataaagaggggggcgggttaactcccccatccccccctaaaaattttggggggcctggatctttttgccaaaccgccaaatccggggcgaaacctgcccagaggaacccttgcggggggggggggctattacccggaacctaaactactcgccggggggggcgcccctcggggtccaaaacttcccccatcttccctttattgggttacacttagccccctgggtggccttcaccccaaaggtccccaattacccg

SEQ ID NO: 15739 - DNA, 596 bp, Zea mays
  Clone ID: cC-zmpo148038d11d1
ggacagactacggcaccctgacggcggccgtgggcccgtcgtttaacaccatttgcaccgggtgcggcgcgtgctatgaggtcaagggggccaaggtcaccgtggtggtgacggccaccaacgaggccccgccgccggtgagcgggcagaagggcgagcacttcgacctcaccataccggcgttcctcaagatcgccgaggagaaggccggcatcgtgcccatcacctaccgcaaggtggcgtgcgagaggaaaggcggcatccggtacacgatcacggggaaccagcactacagcgaggtgaaggtgaccaacgtgggcggcgccggggacgtggtggcgctgtgggtgaagggcaacaagcgcgtcaagtggacgccgatgaagcgcatctgtggccagctctggaccacggaggtcgacctcaccggcgagtcgctgacgttccgcgtcatgaccgccgaccaccgcaaggctaccttctggcacgtcacgccccgcgactggcagattggtaaaacgtaccaggccaccaagacttttagggtcggatcgtgagctgacccggcccttcttatatgtatatatatgcatgaa

SEQ ID NO: 15740 - DNA, 498 bp, Zea mays
  Clone ID: cC-zmpo148038e01a1
ataactctcaagcatgccctttattcagggaatcagcgagacaaaaaattaccgcaaatgcttatttgcgtgacgttacattaattgggctgctatatatgtgtatgaagcagtcgacgaaactatacatcgtcggtcatcaaattggtaggtatacccatgcatgcatgcatcaaatcgtcatcgcatcccatgcatgcatgtatatatgatgtatcagtgattcagtgtcacgcaagcaggcagaagacgacgaccggcgggcgtgctctgcgttcaggaaggaggaggggtgcaggacctcctgcagttctcgctgagcagaggctgcttctccttggcgcaggtggtgttgcaagccttggtgacctcagccgtcttgaccacgtagtccttgtcgcacgcctcttggcacaccttcatctgcggcgcggtgatgcccttctgttcggggcacttgcccttgcactggatccggccgtacagcaccaagttgga

SEQ ID NO: 15741 - DNA, 626 bp, Zea mays
  Clone ID: cC-zmpo148038e01d1
gcgtccgatcatcttctccgatccatcaacaatcgccgttagcgatctgagagataaataaagatgaagaaaggggcatggtcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcacatgaaggtgtgccaagaggcgtgcgacaaggactacgtggtcaaggcggctgaggtcaccaaggcctgcaacaccacctgcgccaaggagaagcagcctctgctcagcgagaactgcaggaggtcctgcacccctcctccttcctgaacgcagagcacgcccgccggtcgtcgtcttctgcctgcttgcgtgacactgaatcactgatacatcatatatacatgcatgcatgggatgcgatgacgacttgatgcatgcatgcatgggtataccta

SEQ ID NO: 15742 - DNA, 333 bp, Zea mays
  unsure at all n locations
  Clone ID: cC-zmpo148038e02a1
ttttatatatatttttccccctcttttttttccctggctctgtgangggtttcaaacggaaaaaacaacccacccccaagtaaaacccgaaaaatccggacccccaccataaagcaaaccaaaccttccaaaagaaaaacctataaaaacttggcgaaaataaaaacaaaaccgtaacctgagaaaaaattatatcccctcacaaatccacacaaaaaacaaaccgaaaaaaaaaaaggaaaagcctggggggcccaaaaaacgagctaacccaaaaaaaatgcgaatccccaaatgccccttttgcagagggaaaacctctccccccaacat

SEQ ID NO: 15743 - DNA, 106 bp, Zea mays
  Clone ID: cC-zmpo148038e02d1
ggactccccctgaaggggggcattaagttcgccggttgttaaggttactcgcaaagtgaccgatccactagctagcgccctaccgcccgttcctttaggtttcttc

SEQ ID NO: 15744 - DNA, 415 bp, Zea mays
  Clone ID: cC-zmpo148038e03a1
tctatttttataaataagaaccagttcattacttcaggttatatgaaaaatacaaaaacgggaaaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcttcgtcgacattcattccagctggtacgtagtatttacattccctgttcaagcaggtagtcgcccatcctttccaccaccatgttgcactgcccaggcgtcatcggctcttcttagatgccaacca

SEQ ID NO: 15745 - DNA, 532 bp, Zea mays
  Clone ID: cC-zmpo148038e03d1
cccccgcgtccgcggacgcgtggttgaaaacagccgaacgattttctctttctctccctctccgatccattctccaggggaggggggtaaacatgtctgaccgggcaaagatgtcgtggcaggcgtacgtggacgagcacctgatgtgcgagatcgagggccaccaccttgcggcggcgggcatcgtcggtcacgacggtgccgcctgggcgcagagcacggtgtttcccgagttcaagaccgaggacatggtcaacatcatgaaggacttcgacgagccagggcacctcgcgccgacaggactgttcctcggacctaccaagtacatggtcatccaaggcgagcgtggagccgtcatccgtggcaagaagggatcatgaggcatcaccgtgaagaagacagggcaggcactcctggttggcatctacgacgagccgatgacgcctgtgcagtgcaacatgttggtggaaaggctgggcgactacctgctcgaacagggcatgtaactactacgtaccaactggaatgcatg

SEQ ID NO: 15746 - DNA, 341 bp, Zea mays
  Clone ID: cC-zmpo148038e04a1
tctattcttatgaggcacaacacaataacaatttttggcaaaaaggctgaatcatacatatatatatccagaggccatctcacttaatggcagtaggaattacaaaaaaggatgaatggatcgatgtatgaaaaccaacacctgcaacaaagagataacgtagtacaatgagaagattcaatgggccgggtctagagatcatgcatgggctgacgtgaacgacggatctagcaaacgattgtatatgatgatatcgagctgaacccgctcgccaataaaacccggttctatcaaaccttccctccgggggcggcgcccttgtcagctctacctcacccctg

SEQ ID NO: 15747 - DNA, 321 bp, Zea mays
  Clone ID: cC-zmpo148038e04d1
gcgcgtgggcggacgcgtgggcggacgcgtgttcggactgttggggaaaaaacaccatcatctcatccggcggtctgagcgccaccctagccctgtgatatacaatggcggcccacagcacgaggatggtggcgctggccctggtggtcctcctggtggtggcgacggcgttggtgtccacggccaccgcgtacggatgttacgacgactgctacgagcggtgcgccaacggcaagaaggacgaccccgcctgcaccaagatgcgcacccaggcgggcggaagaaccgacaagggcgccgacgccggtgcgccggcttgat

SEQ ID NO: 15748 - DNA, 496 bp, Zea mays
  Clone ID: cC-zmpo148038e06a1
atccggctttgccatctataagaggctgtcgaagcagctgtcggtgaagggtaccaccttggaggtcaagtgggagaagcccaagcggcagatacaacggcagaggagcagcatgcgcctgagcgaagccgacgacagggcaggtggcagcactgctgtctgtcctgttgacggcgaggcgagctctagcgcggagcgggtggccactggtataaccgacggggacctggatgagctgaggggatccatggatctcggcttcaggttcgacgagcagaagggcggccaggacctctgcgacaccctccccgccctcgacttctatttcgccgtcaaccggcaggtgtcggagcccaggatgtcgttttccacgagcacgagctcatggccgtctctgtcggccaccaagtcctcgcccaacctctgtggcacgcccagcccaggtagccctggtgcgcactttagtaacgcccttggaggtcatgggaagatttgc

SEQ ID NO: 15749 - DNA, 525 bp, Zea mays
  Clone ID: cC-zmpo148038e06d1
ccgggccgccctttttttttttttttgtttcaaattttttacatattgttttagggagatagctcacacctttggggccatgcgagcctttaacagtactttgcatatacattttttaatttgccaacccgacgctaattaaatctgtccacaacaatgtgacctgggacgacattagatcgagcaacaaggtcaattgatctagtttcactcggacacgactaattcatcgccatcgtaaccacttgtacgggtattatgtatggaagaagagcgtgaataaaacactgacgaggatcagctggagtgcttcactgaacaagccactacttgagcccaccgcctgagccttgtcttcacaagcagagggttatctcctgggttgcaaatctttcatgactccaaggcgttactagagtgcgcaccagggctacctgggctgggcgtgccgcatacgttgtgccaggacttggtggccgacagagacggaacttagctcgtgcttgtgggatacgacattctggg

SEQ ID NO: 15750 - DNA, 201 bp, Zea mays
  Clone ID: cC-zmpo148038e07a1
gtggagtaattattggcatcctcattgcctgacaggccttcgacaccctgggggccaggagcatcagccgggccggtgggggcagtgggacgtcccgtcaaccacaggggcaaaggaagactttgcctcggacatcggtgctacgaccatggcgacgaagaggagagcagcaatgacaaagacgacgctagcgcgagccat

SEQ ID NO: 15751 - DNA, 98 bp, Zea mays
  Clone ID: cC-zmpo148038e09a1
ttatatctttacttaaccaaaaaaacacctcaatgggcgagggtgttatttaaaaaattttatcccctaaaatccagggtgttacacccatgaacaaa

SEQ ID NO: 15752 - DNA, 234 bp, Zea mays
  Clone ID: cC-zmpo148038e09d1
cgaccacgcgtactggtatcacgctgctcaacttttttttcttttcatgaacaagcaccaaagcaataagggggaaatgggggacatttttcatgacggttccccctcacacccccaacacggatggcatacacatgagcgactcatcctgaatcactattaccaacaccgtcattgtccttacttgaccactgcatctccttctgccctgtgacctctcaaggagaacattac

SEQ ID NO: 15753 - DNA, 388 bp, Zea mays
  Clone ID: cC-zmpo148038e10a1
aaagaaaaccctggggggtcggtggctcgtctatatatatatataagcaaaacatctcatcagtaaagagattagagattcgtgtctctcgctttttgcttcgtactcaaatagatatatcgtgtggcatgcgtcgcttcttgggcgggggctggatccacgtgtcgccgaggacgtagtgtgtgcccacaaatggcttggcctgcccctcggggaggtccagcgcccaccccacccttttttttttcttggccttagcgccggggccaaagcacgtgaacgcgccggaggaaatgccgctgctctccggcttggcgatctgccagccgttccagcccacggggaccaccttcctcccctctttgtgtaccagaagacgacccgggag

SEQ ID NO: 15754 - DNA, 640 bp, Zea mays
  Clone ID: cC-zmpo148038e10d1
gggccgaaccacgcgtccgcggacgcgtggggggctgcctcatccggggcattttcgactttatcttcggcttcggccgcagcttctacgaggactggggcatcgagtcggtggtcaaggaggtggcggtgctgacggcgcagcagcgttccaagtccatcgagggcgccatcgacaccggcttctcgttcaagaactgcagcatcggcggcgtcaagggcggccagatctacctgggccgcgcctggggggactcctcccgggtcgtctactcgtacacgaagatgggggaggaggtggtccccgtgggctgggacggctggcagatcgccaagccggagagcagcggcatctactacggcgagttcaagtgctttggccccggcgctgacgccaagaagaagaagagggtggggtgggcgctggacctcaccgaggcgcaggccaagccattcgtcggcacacactacgttctcggcgacacgtggatccagccaccgcccaagtagcgacgcatgccacacgatatatttatttgagtacgaagcataagcgagagacacgaatctctaatctctttactgatgagacgtttgcttatatatatatatgaccagctaaggaaagctcaggttttcat

SEQ ID NO: 15755 - DNA, 293 bp, Zea mays
  Clone ID: cC-zmpo148038e12a1
cttattccaaaccccacttaatattaggggggcgtgaatttaatggccaaccccctgaccaactttggtagaacaaaattaaaaaacaaaaaaaagaaggggaggaggatcctattgaacgtaactgacgacccttcaccatcagaatcacctccaaccccgaaacaggcaattgctacagtagtaaaataaataacaaaccaatcatcactgaggaaataagtcagcgctactacgaacgtacgtagataggaaccaacagatgggtggatggagggggggggggggggggg

SEQ ID NO: 15756 - DNA, 64 bp, Zea mays
  Clone ID: cC-zmpo148038e12d1
cgggagtacaaatatgtaactgacaaaggaacggatttcacactttgtactgcgcggctgtacc

SEQ ID NO: 15757 - DNA, 438 bp, Zea mays
  Clone ID: cC-zmpo148038f02a1
tctctttttatgaccaaaaaaatttatattattcatggataagaggtcaatatccaatgacaatccgaacacagcatggtgttgtttgctagtagcctcatcaggcgtctcattagaattgaatggaccttaacatattgtgtccaaaaaatcacaggtgataagcataggtagcgacagttattgcagtcttgatgaataggggaggaaagcggcggccgatagaccggcacaaaactttgttcgcgctaatgaagaaacggcaactaaaacgggggcaggagaggctggcggcggtaacagctcccccacggcttgcatttctcgggcccaaaaaattagaagcatttcctgtggacgatggatgggccggactcgtcgtactcggccttggcgatccacatctgctggaaggtgctgaaggatgccaagattgat

SEQ ID NO: 15758 - DNA, 442 bp, Zea mays
  Clone ID: cC-zmpo148038f02d1
accccgcgtccgccaatatgttcaaccttaacaccctttttgttcgtcgcatccagccggctctctgggttggagtggcgaccacaggtatcgtgctcactcgggagatggggagccacaccgtcccatctacagggatacccctcccccacgccatccttcgccttgatctggccggcgcgacctaccgactacctgatgaagatcctgctgagcgcggctctcttaccaccaccgtgacggaaatcgtgagggacatgaggagaagctcgcctacatcccctggactcgaccagatatggagaccgcaagaccagctcttcgggagaaagctcgagcccccgacggacaggtataccatcgggccgagcgcttcgctgcccgaggtctcttcagcatcttatggatggaagtgcggattacagaccacctcactcatatg

SEQ ID NO: 15759 - DNA, 418 bp, Zea mays
  unsure at all n locations
  Clone ID: cC-zmpo148038f03a1
tctctttttatatttaaatgaaaaccctgagctttggggagcttgtntatatttatatataagcaacccatctcaccagtaaagagattagagattcgcgtctctcgcttttgcttcgcactcaaatagatatatcgtgtggcatgcgtcgctacttgggcggtggctggatccacgtgtcgccgaggacgtagtgcgtgccgacgaatggcttggcctgcgcctcggtgaggtccagcgcccaccccaccctcttcttcttcttggcgtcagcgccggggccaaagcacttgaactccccgtaggagatgccgctgctctccggcttgactatctgccagccgtcccagcccacggggaccaccttctcccccatcttcgtgtacgagtagactacccgggaggagtccccccaggc

SEQ ID NO: 15760 - DNA, 603 bp, Zea mays
  Clone ID: cC-zmpo148038f03d1
gggcaaacccccgcgtacgggacacgctgtacgaccacaagggcctgcacttctttatgggctgcctcatccggggcagcgtcggcttcgggttcggcttcggccgcagcttctacgaggactgccgcatcgagtcggtggtcaaggaggtggcggtgctgacggcgcagcagcgttccaagtccatcgagggcgccatcgacaccggcttctcgttcaagaactgcagcatcggcggcgtcaagggcggccagatctacctgggccgcgcctggggggactcctcccgggtcgtctactcgtacacgaagatgggggaggaggtggtccccgtgggctgggacggctggcagatcgccaagccggagagcatcggcatctactacggcgagttcaagtgctttggccccggcgctgacgccaagaagaagaatagggtggggtgggcgctggacctcaccgaggcgcatgccaagccattcgttggcacacactacgtcctcggagacacgtggatccagccaccagccaagttgcgacccatgccacacgatatatctatttgagttctatgcagatgcgagagacacgaatatgtactct

SEQ ID NO: 15761 - DNA, 371 bp, Zea mays
  Clone ID: cC-zmpo148038f06a1
gtaataatatgatatatttaatggggctgagatatttactccttcagaattagaaattaaacgacaacgattaattttagaaccgagtgagtattgtacaaatttgaaacggatgcgtggaccacggttgtaacagcttaagctcaatcgtggcgtggcctgcgcgccatcaagatctagtacagctgcttgcgcatggcgcgccgccgtcggtgccgtgtgtgaaccatccgaagacgacgacagatgacgccggcagagatacaaccaggccgacgtagacgtccggctgtactgtttaggccgggcagttatagtggtgatggacgtgaatgtttctccacgaggagcagtcctgcactgaccagaac

SEQ ID NO: 15762 - DNA, 489 bp, Zea mays
  Clone ID: cC-zmpo148038f06d1
ccgatcgccgggtgcctgatcttgcacggcggcagtgtctctgttccacgggagcaccatcaggaccgtcgagtgggtcttcggggagggcaacctgacggtggaccacctgaggaacttcgccgacagcttggcggcggcgaaggacatcacgatcaaccagatcttcctcccggccgatgtccagcagaagatcgacgtcgtcgaggagaagctcaactcctccgcgggcgtcttctccactcgcctgcaggagaactccaggaagatcaagggagtgctgaaccacatggagcacgaactgtttgctgttgcagctgttatggctggcctatcaatactcggattcttgttctccgtactggggggggcggttcttgtctccctactggtgatcgctgcttggatccttcttaccaataccatcatcagttctggtcttttcctcctttgcacaacgtggtggcggacacgttcgtcctgatgggc

SEQ ID NO: 15763 - DNA, 465 bp, Zea mays
  Clone ID: cC-zmpo148038f08a1
ttatatttttttttattactgcaagtagcctcatcgggggtgcgagtaaaattgaataggtcgaacatgtgtccaaaatgacaagtgagaagcattaggtagcaacaatagacatttcagtcttgatgaataggagaaagcggctgccgacagaccggcagaaaactttgttcatgctaatgaagaaacagcaacaaaaggagaaagaaacggggcgggaggctggcgattatggctcctctcggctttgcatctcttgggcccaaagaattagaagcatttcctgtgcacgatggacggggcagactcgtcgtactcagccttggcaatccacatctgctggaaggtgctgagcgatgccaggatggatcctccaatccagacactgttcttcctttctggaggagcaaccaccttgatctttatgctgttaggagccagggcggtgaattccttgcttatcct

SEQ ID NO: 15764 - DNA, 525 bp, Zea mays
  Clone ID: cC-zmpo148038f08d1
ccgctggtatccacgagaccacctacaactccatcattgtgtgctatttggatattaggaaggatctgtatgggggcatcgggggctccggtggtaccactatgtcccctggcattgctgacaggatgagcaaggaaatcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagactggcccgtccatcgtgcacaggaaatgcttctaattctttgggcccaagagatgcaaagccgagaggagccattatcgccagcctgccgccccgtttctttctccttttgttgctgtttcttcattagcatgaacaaagttttctgccggtctgacggcagccgctttctactattcatcaagactggaatgtctattgttgctacctaatgctcctcacttgtcatttggacacatgttcg

SEQ ID NO: 15765 - DNA, 419 bp, Zea mays
  unsure at all n locations
  Clone ID: cC-zmpo148038f09a1
canccggcaatttggaaaaggggtagggggccttatgataagagatacaaaatgcaaatcctatttcatcgattcggattaattagagacttaccaggacaataatctccattgactgcacgacaccatagatctaaaatgccaatgcatctgtgaacccggcatcataagcggcgtcggtctcatagtcaccgatcgcctctccgagcattatccccccgaccgcaccgactaggagccctaggccgagccccatccccatacctccgtcatgcctcgccggggcagctaccggctgtgctgcatacttgtacatcgccggttgtggggaagcatctttgtccccgtacggtggcggagcagggtacccgtaaggctgccgcgggtcccccgcgtacggcgaacaatattgttgtggc

SEQ ID NO: 15766 - DNA, 578 bp, Zea mays
  Clone ID: cC-zmpo148038f09d1
ccgctttctccctcctccacctttctccttttcttgtttcggcaattttccttcgccggcgagagcatggcgagggcgtaccgggtcctgtaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagctaccaggtgcgcaggccgcactctggccgcgcccacggcgtcctctacttctgctatatgttcaccgaggtccccgccgtctcttgtgtctcggaaccggaaagcaaacacgtccagtacggccagaagtacgtgcaggactccaagaacacgacgga

SEQ ID NO: 15767 - DNA, 372 bp, Zea mays
  Clone ID: cC-zmpo148038f10a1
ttatatttatcttttttcttctttttttttttttctcgtgttggggttttggttggaaaaaaaaactccttgcgggggggtggggggccttgattactaaccatttccccctccctttgggtttttgctcaaccctgaattatttttgtcgatatttaccgggattggaatggagccaatctctgaacggggatgggccccccaacatttttacatacaaagcctcaaatgaaaattgttgcggttatggtccatccccaaaagagaactttatccccggttttttttttcttttgggggatggggtgggggttgtttggctttttaaaagaaaaatcttcattccaactttagctcccgacgggacttttt

SEQ ID NO: 15768 - DNA, 473 bp, Zea mays
  Clone ID: cC-zmpo148038f10d1
ccgaaagaaaccaagaagctatcgaaacgtcaaggcttttacgcatttagcgtaagaagcgacagaagtggttcgggggttcggggggacttgcagtcacccttggtgccacggccattgcctggtcttatctaccttcatcgcagccccgagctagtgcagattcaaatagtaccgtcagtgactagagctaggatgaagatatctcatttcagaagcctaacaaacctctaactatactcctagaggagaaaaaaaacgttgtataagttctcttttggtgatcgtccatgatcgctacaatcttcatttgctgctttgtatgtaaaaatgttgggtgggccatctccgttcaggattggctccattccaatcaccgtaaatctctgcatagatgattcatggttgagcacattatacaaagggatgtggatatggttagtaatccatgcccaccgaccccactcgaggag

SEQ ID NO: 15769 - DNA, 518 bp, Zea mays
  Clone ID: cC-zmpo148038f11a1
tccaccatcctccgtatctcggtcttggagaacctgcactggagcgcggggtcggtgacctctcggaagtcgtccgtctccaaggcgttcacgaggagaagccgagcccattcaaccaggctctcttcttccagtggctgagatgcgtctacgggcttccgcccggtgatgagctccaggagcaccaccccgaacgagaacacgtcggacctgtccgtcagcttcccgctctgtgcgtactcgggtgccatgtacccgaacgtgcccattacgcgcgtggagatatgagtcaactagtcgtttgtcagtttagcgaggccgaaatctgcaaccttggcctctaaggcgtcttccaggagtatgttggccgacttgatgttcctgtgtatgatcctaggaaggcagtctttgtggaggtacgtcagcccacgcgccgtttcgaatcgaattcttatccgcttcggtcaatccatcacgggccgcctctttccgtgcaggtgatgcttcatcgtattgtt

SEQ ID NO: 15770 - DNA, 471 bp, Zea mays
  Clone ID: cC-zmpo148038f11d1
ccgcccacgcgtccgcccacgcgtccgcgggcatcacttgcgggtatgtggcggcgaacgtgatcggcgagggggggttcgggggggtgtacatgggcgcgctgggcgacgggcggagcgtggcggtgaagcagctcaagctgggcagcgggcagggggagaaggagttgctcgccgaggtggacatcatcagccgcatctaccaccgccacctcgtcacgctcgtcggctactgcgtcaccgagaaccaccgactcctcgtctacgagttcgtggccaacaagacgctggagcattacctgcacggaaaagggctgcccgtgatggattggccgaagccgatgaggattgcgatcggagcggcgcgtgggctgacgtacctccacaaagactgccattctaggagcatacacagggacattaagtcgggcaacatactcctggacgacgccttccaggccaaggttgcag

SEQ ID NO: 15771 - DNA, 106 bp, Zea mays
  Clone ID: cC-zmpo148038f12a1
attgacaaacaaaaatcgcagaccaaacgggtacgggtgtcagtaaatcaggtcccagggcaatgcttcccctgttgtagcagtacagcccagttcacaactacca

SEQ ID NO: 15772 - DNA, 107 bp, Zea mays
  Clone ID: cC-zmpo148038f12d1
tccgtggtagttgtgaactgggctgtactgctacaacttttgaagttttgccctgggacctgatttactgacacggggacatgtggggtctgcgatttttgtttgtc

SEQ ID NO: 15773 - DNA, 411 bp, Zea mays
  unsure at all n locations
  Clone ID: cC-zmpo148038g01a1
tttttctttattttatncggagtatcatcttggtaataaggataaaattatgatgaaactctcactggccatgacgttaatgggtaagtaggtgctgcgcctgcgcctcagctatgtacacgtaagcaagaatcgatcggaccggacccgaggagctgtcgtctccattgtcgtctcttgtgctgctgaacgatcgacgatccatggtgtcggatcgtagatgactgagctgctgttagcacgtcggccggtcagtggatggtgtcgcactatcagtggcgcgcggaggggctcctcatgccgccggaggagaggctgtcgacctaggagaacttcttgggggccatgctatgcgccttcttgaggagcatggcctccccgtccgcgtccagtgtgccgtcctccctgcgc

SEQ ID NO: 15774 - DNA, 602 bp, Zea mays
  Clone ID: cC-zmpo148038g01d1
gggccgacccccgcgtccggcagttcgaggagcgcgccgagaccatccttttctctgtttaagctccagttccccggcacgccgcgggcgcggctcgacatctccaagatacagtacaacagggacgtcgggtacgccctcctggagagctactcgcgcgtgctcgagagcctggcgtacagcgtcatgtcccgcatcgaggacgtgctgagcgcggacgcggcggcgcagaacctgacggcgagcgaggcggcgcggcgagcgctggagtcgacgtcggcggagctgcccgcggcgcggaagctggacgccaaggaggagctggagaagctgaacgaggccccggcgtcgatgacgctgttcgacttcatgggctggcacttcgaccaggacgagctgatgaagcgcagggaggacggcacactggacgcggacggggaggccatgctcctcaagaaggcgcctagcatggcccccaagaagttctcctacgtcgacagcctctccttcggcggcatgaggagcccctccgcgcgccactgatagtgcgacaccatccactgaccggccgacgtgctaacagcagctcagtcatctacgat

SEQ ID NO: 15775 - DNA, 294 bp, Zea mays
  Clone ID: cC-zmpo148038g02a1
tatctttttatatttttccccccttttttttttaggggttttttgttttttttttaatctttttcccccttagacccgaaaaaaccactaaactcgtttacaaccaaaaaaaatttgtgaaaaaaaaaaacttcaccccctaatatatgtgggtgtggggcaaattgccccccccctccccaaaaaaccattacataaaaaaatcaacgtccctcccctaaaaactcactcctttaaacccccgccatggcccatacaagggtcctccttacccataactctagaaggtggggg

SEQ ID NO: 15776 - DNA, 532 bp, Zea mays
  Clone ID: cC-zmpo148038g02d1
agggccaacccccgcgtccgtccgttgtaacctgcgcggcgaaacaaacattatcaggatgctgtccattgtcttcgccccggcgggcggtcgggatggagggcggcggcgttggggacgcgtacggcgaggaccgcgccacagaggagcagctcatcacgccatgggccttctccgtcgcaagcggctacaccctgctgcgcgacccccgccacaacaagggcctggccttctcggaggcggagcgcgacgcgcactacctgcggggcctgctgccgcccgcgctggcgtcgtaggagctgcaggagaagaagctcatgcacaacctgcggcagtactagcggccgttgcaccgctacatcgccatgatggacctgcaggagcgcaacgagaggctcttctacaagctcctcatcgacaacgtcgaggagctgcttcccgtcgtctacacgcccaccgtcggggaggcctgccagaagtacggcagcatttaccgccggccgcaggggctctacatcagcctcaaggacaa

SEQ ID NO: 15777 - DNA, 445 bp, Zea mays
  unsure at all n locations
  Clone ID: cC-zmpo148038g05a1
angattggaattgcatctgggaagagggggcacttaaataacaatcgactaagagggggagaccatatggataaagtgctggagacggtctaagaggatggcttcaattatgatggctgaaccactgaaggagccatgttctcctcagatcggctgctccagcagatgtcgctgagtgaaggtcttaggcccttgctgcagaacatctcatactccagcgtgtcgcctgccgacttcttcacctcgacgacgtgaaaggccggtgtcacctctaagatctcggcgtcgatcgcgagctgccccttcctcccttgcttggacccctgcagcttcaccagcccgtcctgttttttcaccatgaagcgctctgtctcagcgatctgctccagctttgacactatcgccgacgccggcttctgggtcatgaaccgcgagttgctggcct

SEQ ID NO: 15778 - DNA, 629 bp, Zea mays
  Clone ID: cC-zmpo148038g05d1
gtccgcgaggtgatggccagcaagagcaagatatactttttcatggtgtacgtccggggcggcgagctcttcgcccgcgtcgcgggcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggagtgccagaagcaggacggcctgctgcacaccacctgcggcacccccgcgtacgtcgcgccggagatcatcaacaagaagggctacgacggggccaaggccgacatctggtcctgcggcgtcatcctcttcgtgctcctcgccggctacctcccgttccacgacgccaacctggtggagatgtaccgcaggatcagcagagccgacgtcaagtacccgcagtggttctcccctgagctccggcggttgatgcccaagctcctcgaaccgaacccaaacaacaggatcacgatcgagaagctggtcgagcacccctggttcaagaaggggtacaggctcgccgtcatgctggcacagtcggacggttccagcag

SEQ ID NO: 15779 - DNA, 437 bp, Zea mays
  unsure at all n locations
  Clone ID: cC-zmpo148038g06a1
tctctttttttataaangaacaatctataaatatatgggtagagggtgcccttccagccacgagtacaatatagggttttttaagcttacaatgacagtaccgacaatgtgttccccgcccagccacgaataggatgtcccgacgagcgactgaattactgcgccgcgctgggcgacctcttggagcacttggcctgcacggcgagcgtggcggtggtgccggagcaattggcgtcgccgccgtagacgtcggcggtcacgggcagcgtgcagacgcgcttgccgaggcacgccttctccaccaccttcttggcgcgcggcgtgtggcatctgccgacggtgtagttgccgcacatgcccgcgggggttccgtagcttgcgaacaccacctgctggatgagcttctttgggcgggcacgccagcgccgcccgggccc

SEQ ID NO: 15780 - DNA, 606 bp, Zea mays
  Clone ID: cC-zmpo148038g06d1
tccggtgggcacgggaccaagatgaacaaggcgttcacttctcgagattcccatggacctgaagaagggcgtgaacggcgtcgggggcttggcatcgtcgatgggaatgacggacagtggcgcttacatggagcaccgtctggccggcgtggacagggtgcagatcacgggcctgaacgcgggcacgctggacctgacgaataacggctggggccacatcgtcggcctcgtcggcgagaggaagcacatctacaccgacaagggcatgggcagcgtcacctggaagccggccatgaacgacaggccgctcacctggtacaagaggcacttcgacatgccgtcgggagaggacccggtcgtgctggacatgagcacgatgggcaagggcatgatgttcgtcaacggtcagggcatcggccgctactggatctcctacaagcacgccctcggccggccatcgcagcagctgtaccacgtgccccggtccttactgcggcagaaggacaacatgctggtgctgttcgaggaggagttcgggcggccggacgcgatcatgatcctgacggtgaagcgcgacaacatttgcaccttcatctgtgagcggga

SEQ ID NO: 15781 - DNA, 435 bp, Zea mays
  Clone ID: cC-zmpo148038g07a1
atatctgggacaaccatcatcatcgattggccttggccatatacacaacccacggtcaccttggaacattaagaaacaatacgtatgcatgtatatatataactaaacccaacatctgtgacagcttatacatggtaccaggaagttcccctttgttgttggcacgacaaaaaaactcagtgtctggtagcagtttacgagtagaactggtacgttttcgcgtccatatatgatctgccgaagccctccgattggcgacagaattatcatgatcaccccgagaatgatgccgatccagttggtgaaccacgagaggctgaacctcttgggcttgtagatcgcgagccacatgacgcagggaaggaaataggtcgtctgtgcaaaggcgaatccgccaagaagccgtgcattctgtctaaaaggggaaggtgatgg

SEQ ID NO: 15782 - DNA, 486 bp, Zea mays
  Clone ID: cC-zmpo148038g07d1
ccggcaggcgtccggccgggcacaacgtggtgctggttatccaggttatcatcccgtcgactcccgataagcgggggaagtaggcgatgtttaagggcgttctcctcccctacatcgtcgtcgcgctctgctacttccccgttgcgctcatcggctactgggcgttctgaaacagcgttcaggacaacattctcatcacgctcagtaagcccagttggctcatcgcgctcgccaacatgatggtcgttatccacgtcattggcagctaccagatctacgccatgccagtgattgacatgatagacactgtgctggtgaagaagctgcgctttccttccggtctgacacttgtctttcatcgctgggaccgcctatgttgcgttcacaatgtttcatatgttttcatccttccccttcttctgtgggactgctcggctttcttcggcggattcgtctttgccccgaccgaccttattccttccctgc

SEQ ID NO: 15783 - DNA, 595 bp, Zea mays
  Clone ID: cC-zmpo148038g08d1
tccgggggcggtacaaggacgagaaggacgtggaggatttgaaggtttttggggtgcacgctcgccggcaccaccgggggcctgggcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacatccacggtacctccaacacgccggaggccatcacgctcaactgcgccaacaacctgccctgccagggcgtgcagctcatcaacgtcgacatcaagtacaacaggtccgacaacaagaccatgtccgtctgcaagaacgccatcggcaagtccattggcatggcgaaggagctcgcctgcgtctgaacctacttgcatgcatcactcactcttcgtcactctctctttcttactctcgccagtctttttttaggcctttggcaatctgcgaacctttttattcattctactagtgtggatctataagtccattcaaaatatatacatgatc

SEQ ID NO: 15784 - DNA, 360 bp, Zea mays
  Clone ID: cC-zmpo148038g09a1
gggcatggggtaggggccaattgtcatgtccaaaccaatagtgtctcccattctcccctctttacatatcgaaattaacagaaaggggagaaatggcataccaaataaaatgaatggatcaatcgacatgttcagacccaaattaaagttcttaaatatatatataaacggaatccaaccgaatacaggcaatggtagccagcagcatttccctccgaccctcctttaattttactgcaggtagtaggctaaaaaagaaaacacggaggcgcccagtacggttcccactgtcgggaacgcggtcgaagaggctcttgtgggggcgggcccccgggccctggtggagaggaccaccgtggc

SEQ ID NO: 15785 - DNA, 538 bp, Zea mays
  Clone ID: cC-zmpo148038g09d1
tccggccacaggcaagggcgcaaccaataatagcaagtgtgatcattcgttgatccatcttgctaataaccctgcgggccctggggtctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtcgattgatccattcattctatttgctttgccatttctcccctctctgttaatttcgatatgtaaagaggggagaatgggagacactattcgtttggacatgacaattgggaa

SEQ ID NO: 15786 - DNA, 483 bp, Zea mays
  Clone ID: cC-zmpo148038g10a1
atcgttggcgtaaataaatggtgagatagggttggggatataactcccattacaatgatttttttgagaaccccagtacagtgatttgagagggcatgcatcttaagattacatatatccattcatttgttccccttcactacgcttctttcgtatttgttcttttgagtttggattggatggtcagaccacgaggagaaaacgaggcctttttcgtcttatcgcgcgggggcgtatgacggtggcagcggcagcctcacgaccttgccttatcggagggcgttgtcgggcatgttgtactcttcacgcaatgatcgcgccggcgagacgacgctgatgtagaactgctccccgaggtagtaccgctttcagatgttggaatgcacgctccacatgcccgcgttgtcaacgtcaacatgattgccgttcatgaaccgcggtacacctggatcgtgtgccggcttaccgtgttcagcagggtgt

SEQ ID NO: 15787 - DNA, 467 bp, Zea mays
  Clone ID: cC-zmpo148038g10d1
tccgctcgctgaatacttcaacgtcaccgacggggtgttcagctactatcagatgggcgacgtgccccccgccgggaacggtggggtccatgtcatccccaatgtcatcaccgccgagttccgcaccttcatcgagatcgtcttcgagaaccccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtgctacctcggggagcagttctacatcagcgtcgtctcgccggcgcgatcactgcgcgacgagtacaacatgcccgacaacgccctccgttgcggca

SEQ ID NO: 15788 - DNA, 253 bp, Zea mays
  Clone ID: cC-zmpo148038g11a1
gcttcaattcaatgaacagaggagggatgggggcaggttcacagcacacgactttaccatatacacactagtagaaataataaccaatgaaacaaagacgcaagtccctatcttcttagaccggtcaagatcacgaattggcaccgagaatccgatccattaacaggttacaggcccaggcccaccccctgcattcttcttcatgcacgcatggtccacgggtcggcgcgcgcgcgcgcgcggtagctttcag

SEQ ID NO: 15789 - DNA, 256 bp, Zea mays
  Clone ID: cC-zmpo148038g11d1
ccgctgaaagctgccgcgcgcgcgcgcgcgccgacctgtggaccattcgtgcatgaagaagaatgcagggggtgggcctgggggtgtaacctgttaatggatcggattctcggtgccaattcgtgatcttgaccggtctaagaagatggggacttgcgtctttgtttcattggttattatttctactagtgtgtatatggtaaagtcgtgtgctgtgaacctgcgatcatttatcctctgttcattgaattgaagc

SEQ ID NO: 15790 - DNA, 305 bp, Zea mays
  Clone ID: cC-zmpo148038g12a1
aactgggggggtgcgtacctattatccgcacggggcccaaaacatttcgggattataaatacacattggggggagaaaacggcctggccatttgtaattggaagaaaaaatcgtcctttctgaataggcaccaaatgacccaaaattcgggtaattgatgacgcttaagctgatccgattaacccggacaatggctccggggccttggaggacccattaaacaacaatggtgccggggcgacggaggacccattataccactactgctctggggcgcccgaggaattaaaccacaatggagccga

SEQ ID NO: 15791 - DNA, 360 bp, Zea mays
  Clone ID: cC-zmpo148038g12d1
gggccgaacacacgcgtccgcccgcgccatcgtcgtctgagtcctccggcgcacttgggccgtcttcgtctgatgggtcctccggcgcccgggcgccatgggcgtctgatgggtcctccagcgccccggcgccatcgtccggcgacgacggatcagcttgagcgtgagcgatgacgcggagtttgggtcatttcgtgcctactcagagacgacgatctcttcttccaattacaaattggccgtccgtttactcctcacaatgtgtaatgataataacggatgctactacgtaccgtacggataatgggtacgtagctaaaaaaaaaaaaaaaatataaaaaaaaaaaaataaaataattg

SEQ ID NO: 15792 - DNA, 241 bp, Zea mays
  Clone ID: cC-zmpo148038h01d1
aaaatgtaataaaatgtacggactaaatattattccttttaaaccaaacaccctctaagttggcgcggtgcgtgtatattatataatggaagccctcacctcccattatagggcaactcccaaccacaatgcgtttaggccaccacctctcatgactgcgttcagttttatgctggtttacccaaattatatacattgcatatactataccctgaatcttagaacgccgtttaccttcata

SEQ ID NO: 15793 - DNA, 339 bp, Zea mays
  Clone ID: cC-zmpo148038h02a1
cccccgggattttttaaaaaaaaaaaaatatccccccaacaaaccccgggaatggccggaccccaaaaaaaaaaaaaaaatttttgccccccccccccttttttcccccccgggttggcaaaaaaacaatttaatttcccccgaaccttccctccccttacccgcacttaactaaaaaaaaaaatgtcctttgattctaaaatgccccccccttcttcccccccaaaggaaaccccaacaaaaacccttcctcccccccaaatcccaacccctttttaaacaatcaaacaaaagttttttttcccccccttcccctcccgggcgaataattccacaaaa

SEQ ID NO: 15794 - DNA, 606 bp, Zea mays
  Clone ID: cC-zmpo148038h02d1
ggccaacccccgcgtccgcgcaaggccgggctcaaggtccaggccgtcatttccttttaccagtgcggcggcaacgtcggcgacgccggcagcatcccgctgccgcggtgggccgcggaggagatggagagggaccaggacctctgctacaccgaccagtggggccgccgcaactacgagtacgtctcgctcggctgcgacgccatgcccgtcctcaagggacgcacgcccgtcgagtgctacaccgacttcatgcgcgcgttccgcgaccacttcgccgactacctcggcaacaccatcgtggaaatccaagtcggcatgggccccgccggcgagctgcgctacccgtcctacccggagagcaacggcacctggaagttcccaggcatcggcgccttccagtgcaacgacaggtacatgcgtagccgcctgaaggcggcagcggaggcggccggcaagcctgagtggggccacggtgggccgaccgacgctggcggctacaacaactggccggaggacaccgtcttctttcgcggtgacacggtgggtggagcaccgagtacggcgacttcttcctgtcgtggtactgcagaagctgctggagca

SEQ ID NO: 15795 - DNA, 473 bp, Zea mays
  Clone ID: cC-zmpo148038h03a1
atcatgatgacgttattatggtataaaggttttgtgtggcgtttttacaagatcagcatccttttcccccttcttttttttttatttttgaatgaaatcctcgtcctttcttttggttgtgtaaatgcaatgttacaaatgtgtcagaattacacaatacacaaacaaaggataacaaaagttctgtggtatatcttctctagtccaaaaaataaataaatagcccatccaagtgaagctgtacatgtccttatgatgcttttaccgttttaagatatttctcgtgaatctgcaatgcttctctgcatgccttttttgcatccagactaccagtgatttcatttaaaatcttgacaacatcgtctagaccttttgcctcacccaataacttcttgtttctagcctcaagaacactagcaacaacaaagacagatagagggatctggtcatctttcttagctgcttgcaatttt

SEQ ID NO: 15796 - DNA, 565 bp, Zea mays
  Clone ID: cC-zmpo148038h03d1
ggttggcaagagaggagggccggcgtcggcgtgcctagtttgatttttaaccatagctagccagcatggcgcggagcgggggcatattagcactgctgctcatcgcgaggggcttcattcacctgatcctcgcttcttcttcttccgtcccactggttcgcgttgattgcatttggaggagggggcagtcaagatgaggcttcggctcctggcctgctgctacaatgatccggagatgcggatcgatccggacaccgtctaccccatccgccccgactgccgcgacgacgcccccaagacgcgcttcaagccccggcctggcctgacccttagtccaaagagatggaagcttctccacaacgaggaaggctgcgtggacatagctggaatgatcaagagagtgcaacgtgggggagtccacccaacaatcaaaggagaagtttgggaatttttgctgggctgctatgaccctaaaagcactaccgaacagtgcaaccaattgcgacagcagcgaacgttagagtacgagcaactgaaagctaagtgccgagaaatggacacagct

SEQ ID NO: 15797 - DNA, 293 bp, Zea mays
  Clone ID: cC-zmpo148038h04a1
gggcccttggtttttttttatttctttttttctccctttttcccctggacaaacccaaaaacccccaaaaggcgtctaaataaaaatgaagggcccctaacataatggggccaaaaaacccaagggaaaaccctagggtgccacccttattggggccttaaaaaaaaggggaaaaaaacgggggcccaaaaacccccacaaaaccttgtcccccctaaaaaaaaaaccgcaacaaaaaccggggcaaaaaaagcttggggcggaaaccccccccccacgggttgaatttttcg

SEQ ID NO: 15798 - DNA, 251 bp, Zea mays
  Clone ID: cC-zmpo148038h04d1
gtccgcgagaaatgcatgccgtgggggagccgttaccgctgccagcctctcctgcccccgttttcgttgccgtttgttcattagggcgaacaaagttttgtgccggtctatcggccgccgctttcctcccctattcatcaagaccgcaataactgtcgctacctatgcttctcacttgtgatttttggacacaatatgttaaggtccattcaattctaatgagacgcctgatgaggctacttcggattgtc

SEQ ID NO: 15799 - DNA, 470 bp, Zea mays
  unsure at all n locations
  Clone ID: cC-zmpo148038h05a1
atagtaaggagcctcatcaggcatcatcagtaaaattgggataggtcgaacatgtgtccaaaatgacacgtgagaagcattaggtagcaacaatagacattacagtcttgatgaataggagaaagcggctgccgacagaccggcagaaaactttgttcatgctaatgaagaaacagcaacaaaaggagaaagaaacggggcgggaggctggcgataatggctcctctcggctttgcatctcttgggcccaaagaattagaagcatttcctgtgcacgatggacgggccagactcgtcgtactcagccttggcaatccacatctgctggaaggtgctgagcgatgccaggatggatcctccaatccagacactgtactttctttctggaggagcaaccaccttgatcttcatgctgctaggagccagggcggngatttccttgctcatcctgtcaacaatgccagggaaca

SEQ ID NO: 15800 - DNA, 523 bp, Zea mays
  Clone ID: cC-zmpo148038h05d1
ccgggatattaggaaggatctgtatggcaacatcgttttctccggtgttaccactatgttccctggcattgctggcaggatgggcaaggaaatcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaaagccgagaggagccattatcgccagcctcccgccccgtttctttctccttttgttgctgtttcttcattagcatgaacaaagttttctgccggtctgtcggcagccgctttctcctattcatcaagactgtaatgtctattgttgctacctaatgcttctcacttgtccatttggacacatgttcgacctattcaattttaatgagatgcctgatgaggcttcttgcat

SEQ ID NO: 15801 - DNA, 442 bp, Zea mays
  Clone ID: cC-zmpo148038h06a1
gcggccgccctttttttttttttatataatttaatttaatttgtatttcttagtatatgagggggaatacaaatataataacaagcatcgatcgatctctcgatcgagtggacacgattacaaatccatcgagatcggtgtgttgtcgaactttgtgggcaggcacgcacagtgtgcatacgcaatgcaatgcatgcatggataggcagatgatataggagcattaactagttcatgggatgtcaagtttgttatccttgtaagggtccctaggcccctgcttagcagcgatctccttgcacctcttcatgcagtcctccatgctcatgtggagtgggcccgtgacctcgtcacacccggccttgcagtccatggcggtcgccggaggggcggcctccagcacgagcgtgatgagaagcatcgccgcgacgatgaggaccgt

SEQ ID NO: 15802 - DNA, 503 bp, Zea mays
  unsure at all n locations
  Clone ID: cC-zmpo148038h06d1
gggccgaaccacccgtccgcccacgcgtccgcccacgcgtccgcccacgcgtccgcccacgttttcgcggacgcgtgggcgacgatggcgtcgaatagggcggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccactcgatcgagagatcgatcgatgcttgttattatattngtattccacattatatataagaaatacacatt

SEQ ID NO: 15803 - DNA, 245 bp, Zea mays
  Clone ID: cC-zmpo148038h07a1
ataaagggaaaaaaacatttcatctgtgcgagggtgccactacaaaatgaacaaagaatagttccatacaacacatgtcccgctttttacaaggaaaccccgcaaccataaacctaacaaaaatgtcacccctgctcagaaaactggtgatcctccgttaaaatgacacacagaatacattttttttcactgagggcagcaacttaacataagcatatatatatgccttgagaccggtcatagta

SEQ ID NO: 15804 - DNA, 447 bp, Zea mays
  Clone ID: cC-zmpo148038h08a1
gggtgacagcagcaagtgaatcaaggagtctggggcattttttattttccttttcttccttttctttccgaagatactgctatccatgccatgcgttcgctctgtatcggtgtagttatgtgcagcatgtccgcgacgccgccgtggtatagtttactggtcgtcgtcgtcgcccgagtccagctgcttgagcagcgcggtgcagacggggagcggcacgtccttgaagtagcctaacgggttggcggggcgcaggctgtcggagatgccaaccttcctggtgagcaggacgccggcgcggtccctgaacgcctggacctcgacgcagtccttgcgcgggctggccaccagcaccacctggcagatgtcctcctccgggctgtccttgagctcgatcgtgtaggtgcccggcgcgtccgtgaccccgtataaggcgcgctcgagctt

SEQ ID NO: 15805 - DNA, 514 bp, Zea mays
  Clone ID: cC-zmpo148038h08d1
tccgccacgcgtccgaaataataaggaaaggtcccgcctttttccttctacatccacaaggggggaggggaaaacgcgtacatgggcccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgttctgctcaccaggaacgttggcatctccgacaggctgc

SEQ ID NO: 15806 - DNA, 503 bp, Zea mays
  unsure at all n locations
  Clone ID: cC-zmpo148038h09a1
ataaaaataaaacattcgagttcttttggggttggggttcttttctacacgcgttcattcatacaattatattttcacgcacatattcatgccatcgactgaatcataaataaaacgaaatcacaatttttttaaagcgaacaacctggccgactcgtgtcgcgcatgcctgtgtgctggtttggctttctgtcgaaatgacgcgcgaagcgcgacaacgacaagaggcgcggattgacggcatcacgatagggtctgcgtatatcgacaatgggtggcccgccctggcaagcgcgacacagcgaanggcgatcctgctgctacttgttgcggaattacgtcaagcacgccgagggcgcgacacggagggaatccacgtggctgcgcaaactggcgtcgtggctgctgcgcgaggtcgacggcgttgacgaccatgaaggcacgagcaggggcacgcgccggccatggggatttgcgtcacggtatccatggagaggagccac

SEQ ID NO: 15807 - DNA, 542 bp, Zea mays
  unsure at all n locations
  Clone ID: cC-zmpo148038h09d1
gcccgcgtgcgacgcacgcacctgctgttttcacctttttcatcttcctccctctgcttttgctcgggcatgggggcctggtgaccgcgcccctcacatggacgcgccccctgctcatgatctctccaagtcggcgccttccctcagcgtcatctcctccgcgcggcatggcggcatggtggcaggcaagcccctgcgagtcttcaccagcacaccgggctcctccctccttcgtgctcggcctccagggacacacaacccctcctccctggcgcgccttgacagcagcagggagcagccgctctcctctccctgccccacctcgccggtttcttctcgcctgtgcgctcggctccaggtgcaggcgccccttcccctagcggatccatgatgctaggaggatctcctcctcggccggcgctccaacccggcatccatggcgccggtgccctcccgcagcagcgcgccacgaacctttctgctcgtgcgtgggattgctggcanggtcctgccatggacggacctgcccctctagctgggac

SEQ ID NO: 15808 - DNA, 476 bp, Zea mays
  Clone ID: cC-zmpo148038h10a1
gattgcttatgcctcctgagcggggagaggggcatgatcaaaactgtcacacccgggtttcggggcaccaagacccgggcgcgaacataatcaccaggggtgctgggaccaagtctcacacatatgatgaatcatggcacaggatcgaatgtcacatctttactacataacaggagttctgtacaaaataaacaaataattacattatgaggagacaacggtccagcaacccaaagttgactgggagacaacgacctagaccttttacgaactcgttacaggatcctgcatgcgccacatcctgtggtacctgttcttgaccggttgattggacgatgcagcccactgtccacagagatgggtggcgccacggtggagcatgaacgacgatgagcaatcacgccgtccctgaacttcggcaaggcacccatgacgcgcggtgttccccagagaagatgcttcccaggcgtctttca

SEQ ID NO: 15809 - DNA, 545 bp, Zea mays
  Clone ID: cC-zmpo148038h10d1
ccgggccaccattgatccgacctcccctaagccatcgttgagtagttataaacagtgaacgccacctctgtactggccccacgggatggcgcgtcgctcctgcagtaccggcccacgctctgcgcggcgctcaggtgttacggctgccctcaaatccgtcgtcggaccattggcactggggcaagcaaaagcacggacaggtgctcgacgtgctgcaacggcttccgatttgcccggctagatggaagacggctggggagcatcttctctggggaacaccgcgcgtcatgggtgccttgccgaagttcagggacggcgtgattgctcatcgtcgttcatgctccaccgtggcgccacccatctctgtgggcagtgggctgcatcgtccaatcgaccggtcaagaacaggtaccacaggatgtggcgcatggaggatgctgtgacgagttcgtgagaggtctaagtcgttgtctcccagtcaactttgggttgctggaccgttgtctcctcataatgtaattattatgtttattttgtacagaact

SEQ ID NO: 15810 - DNA, 520 bp, Zea mays
  Clone ID: cC-zmpo148038h12a1
atataaaaaaatggcagaaatttactgggggggggggggaatcacacggttttatacagattataatggaaaagcctgcctttaagtttggaaattttaattcacaaaaccagagctttctattgattacacagatttttccccaagaagggaggagggagaactggtggcaggttggtttttctttttatgggacatgcttgtgatggttggcagcatgaagcttctcctcagaagcggtctggtgttcctatgcccggcggttttttaaaaaactttcccaacttaagtctgaggtacaggaagtcatacactttcaaggttttttggccctggcgacgggtgagcctttgggggtttttttccttcttgcggcattttttgagcttaccttctataggctttttgggtggctcaaccaattctgccctttttaagggcttttctggggcaaatccatggccctcatttcttgggggccggtttaaatttcttggaatgcctattctcactgggtttg

SEQ ID NO: 15811 - DNA, 549 bp, Zea mays
  Clone ID: cC-zmpo148038h12d1
cggtcggagtcaaagaatgctttgcaagaagctgaattgatgggtagagtgcagcagagctaagagaggaaggggaaaagggtggggttgaactagcagaagccgaacaaaagatgcaattggctttaaaggaagcagaagaggctaaagcagctgaagcaagagcccttgatcagatcaagcaactctcggatagagcaagtgctgctagatcctcaacatccgagtctggagcaattatcacaatttctaaagaggagtttgtatctctcagccgaaaggttgaggagtcagagaagttgagtgatatgaaagttgctgctgctatggctcaagtggaagccatcagagccagtgagaatgaggcaatcaagaaactataaactgcccgcaaggaaatggaggacatggaattggcaacagaagaggccctatagagggcagagatggctgaagcagccaaaaaggctgtagaaggtgagcttatgagatggcgcgagacggagaaaaaaaccccataggctcaacccgtcggcaggggcagaagaa

SEQ ID NO: 15812 - DNA, 450 bp, Zea mays
  unsure at all n locations
  Clone ID: cC-zmpo148041a01a1
aagataaaagtatatataacntggatggcaatgattgttttttaaaccccattacagtgatttgagagggcatctcaagattacatcaatagatatatccgtgcgttctcatttggctcacccccacccaacgtcccttctcccttccctaggcttccttcgtctttgttctttttgatgattttatttcgccgagcagcacaggaatggattagttagactggatggtcagaacacgaggtgaaaacggcgccttcgtcgtctttagcgcgcgggggcgtaagatggcggcagcggcagccccacgaccttgccgcagcggagggcgttgtcgggcatgttgtactcgtcgcgcagcgaccgcgccggcgagatgacgctgatgtagaactgctccccgaggtagtaccgctcccagacgttggaccggacgcttcacatgcccgcgtt

SEQ ID NO: 15813 - DNA, 448 bp, Zea mays
  Clone ID: cC-zmpo148041a03a1
atctaagccgacccaagacattgatgggcagggattaaaatagcccactttgatacattttcttatcagctgtcatcatcatcatatacctaatttacagtatgacattacataccatggttatgtgacacacacacaggacagggcattctcatcaccactagaccagtgatgtgaaggacgatactaaagaattcttcaattagagacgcagacgcaggactgtctcgacgaaatgcgggaccaccatgccagttgccacacagtacgacgatgaggtcagtcaggcgccccagacggtgatcccctgcatcatgcacttgaactcgttgaagtcgacgcggccgtcgctgtcgcggtcgacgttgcacatcatctcccggacgttggccatgctgctggcctcggggaggccgagcttcttgagcacctcctgcagcttaacggc

SEQ ID NO: 15814 - DNA, 605 bp, Zea mays
  Clone ID: cC-zmpo148041a10b1
cacccgtccgcccacgcgtccgcccgcgcgtccggatagaccaagaatcatttttatcatctaatagggatgctgaggcaagggggtctactggcatgaaacctgttaaaactgaagaagcaggagcagatcttcttcccaaagagatgaatattatgacaattagcgacgacaaagctgatggtcataatgataaggaaggtgagggtgttacacttgatgggactggaacagagacagggcagataattgtgacaacaataggaggtcacaatgggaagccaaagcagaaggtctcatacatggcagaattggttgttggtactggttcgtttggtattgttttccaggcgaaatgcttggaaactgacgagacggtggcgataaaaaaggtgttacaagataagcgctacaagaatagagagctccagactatgcagttacatgaccacccgaatgtagttcagctgaagcatcacttcttttaacaactaaaagggagagtttacctcaccttgtacttgatttgtattcagacagttatcgtgttgccaatactacaaccgatgaccagcggtcccataatatatgtagctgatgcatat

SEQ ID NO: 15815 - DNA, 478 bp, Zea mays
  Clone ID: cC-zmpo148041a11b1
gacgccgacgcgtgggcgggcgttcaggggcaagcaggcgatcatttttcattgtttttgacgaggagcccgacaagggcacgctggagaagatcggggccattccggccatcgaggagttcgttttcctcgaactatgatggctagcagcgagttttctctaggattgatattttgttatagtacgtactgaactggggtttgacgtctcatgtcatggccacagggaggagaggaacctgatccgctctggtctgtctgtctgtttggtgacctctacattttttatgcggggagaagcaagcaatatatattgtaaaagggtgccttggcttgccccctgcctaaataagaggtgtgtgccgcttgtttatctgtaaactgtgtatgtgtatgtgcttaatgcgtgattctaattaagcaagcacatcatcattgcgtctgaaatgaagaccggatgtgtactgtgtggggcaac

SEQ ID NO: 15816 - DNA, 592 bp, Zea mays
  Clone ID: cC-zmpo148041a12b1
cccgaacgcctatttgaaacaggtagaattcatatataacagtgcatttatatattttatcctgccaagacaaaggtggtggagtggggacgcatgttccagccggccatcatcctgcttctcctgctcattgtgaccaccgatgtggcgcatgcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgatttttttccccctaacaataagaaaacgcacgtgctggcatgtacgtcgtgttgtatatgcttttcttgctggcttcatttgctgattactgatgagttgtaaggtccctgcacgatccatttcacatggatatgatgcttaattgcattcctgcttatatggtatgtatatttaattaattaatgatggaccatcgagttcaatttgtaaaaaaaaaaaaaaagggcgg

SEQ ID NO: 15817 - DNA, 499 bp, Zea mays
  Clone ID: cC-zmpo148041b01a1
caacctgtattgaaattaggggggggggcaaggtatgctatccgcaccgccttctgtctgtacaaaattcttgagtacaaagaacgtgatatacacactaccggttgcgctcatcctgtactcaacccactagcctggcaccatcagtctccgtgtatctcaggacatgtcagacgattaccacctgtgtccgataaatcttcactcaaagttgtgtgtagaaaatggtcgtgtatgttgaaatggtaacgatagccccattggggacgtgtgttccatggcacgcttaaggcttctttgcttgtacctttttcaggtattttttgtgaagtttcaatgctccagcgcaagctttcttagcatctaagttcccatttacatcgttcaatatcctgataagatcatccaatcctttggcttcttggaacaacttttctctcttctccttgaggacacttgcaaccattaagactgaaatcggaaccggaccatctttacc

SEQ ID NO: 15818 - DNA, 444 bp, Zea mays
  Clone ID: cC-zmpo148041b02a1
atgttcattatatagcagttctgcttacacaggggcaggggttccgcgaggctaacacaactccatgccaaaatcgccattgtcatgagcctcatcagacgtaacgaaggcatctggtacacttacagccagctggacgacaaaccgagttcacggagagatagatgaaaggagggaataacgaagtcgtagagaaaaagaaaagaaaaatggcaaacgcagacttgagtgtgagaatgtgtgagtgtgtgtgtgtgtgtgtgatatatattggtggcggtcccttcctcctagttgtcctctccttccccgtcttgcggtggcgcccgttccggcggttgctcgtcggctgccatgtccggcagcgtatcctgggacgggctcttcttcatcatgtggctgtagctccccttcttcatgaacagctgcgcgaagtggatcttg

SEQ ID NO: 15819 - DNA, 388 bp, Zea mays
  Clone ID: cC-zmpo148041b03a1
gttaccagcaattaaaaatgagtggatgggaacagctaacatccggctgccaaaaagtgaagtcgtacttttggcgagacacattttttttttgaaaccaagaacaagaagctaaacctgaaattccgtgttagcagtaacctgatcaagttacactacaactagcaatacagatttttctcaagccttgttcacatatatattcaagtgcagaaaggagatcgatacaacaccatcccggctcttacaactggcaggccggccagcgcgcacgcggctagtgcccgtgcttgtgcgcgtgctccggctggttgaccacaacaaaaatgttgagaacgttgtcgacgaggcggtagacgttccgctgcatgggcaagaagggggacct

SEQ ID NO: 15820 - DNA, 399 bp, Zea mays
  Clone ID: cC-zmpo148041b10b1
cggccacgcgtacgcctggcaccactccctcctccttggaatctttttaggatagtggagggagagggaggacccgcgcaacggggatctccctaggcagactggggcttgcacgccggccctacccctaactcactgaccacgctgttatatcaccaactctatctctctcttatcctcttccaagattcccccatatttttcttgttgtcccccccattcttgctaggatcattacttgatcttttactcgcttcattactcccgctttccagctccggagatcccatctatgccacctgctgccgtctacaagctccaagaggccagattccatcacaaatgtgaggtcaatttgcccgctgagctctgatcaatccgctcggcaacatgtgtcct

SEQ ID NO: 15821 - DNA, 534 bp, Zea mays
  Clone ID: cC-zmpo148041b11b1
ggcgatccacccgtacggcacgtgtgatcatccgttgatccatcttgctaataaccctgtttgccctttgttctcgtctcgatcccgacggcgctcgggtcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtcgattgatccattcattttatttgctttgccatttctcccctttctgttaatttcgatatgtaaagaggggagaatgggagacactattcctatggacatgacacatggaaaataatcaatac

SEQ ID NO: 15822 - DNA, 360 bp, Zea mays
  unsure at all n locations
  Clone ID: cC-zmpo148041b12b1
cgtacgaccaaaaaaaaaaaaggaaaaaaaaaaaaaaaaaaaaaaaaatttttaccttttcccccaccccccccccccccngggattangggnaaacattttatacctataaccccccaaacacccaccattcaacccttctttccctccttttctcctcctttccctatccctccctcccctcttccctcccctctttttacctctttctttctctaatacaccttcttactccccccccctccccatcccccctctttcccatttcatccacactacttatccccttcctctacctactcacccccaatttcccactatctcttcttctcctcaattttctacttttctcctccctcc

SEQ ID NO: 15823 - DNA, 348 bp, Zea mays
  Clone ID: cC-zmpo148041c01a1
gacgctgatccttaagcggcgcccttttttttttttgatttgtatctgaacaatacccaattttagggagggcttgttagactacctatgtacataaaggcgtagcccacatacatacacggagcatatttgtgtcagtacaatgcaaaagcatattgcacaatttagataagacttccataacatttgtgcagaaccctcatccattgcacttttgacccaccgtttaactcctaaacagataaggcgaacacctggttatcgggcacggagaagggcatccccacttttggatgtatatcttaaaaggacagcaccagcatgtggcgacgggtgcagcgccttcac

SEQ ID NO: 15824 - DNA, 454 bp, Zea mays
  Clone ID: cC-zmpo148041c03a1
gttaaaaaaaagataacccgtttctcggccggggaaagaataaatgacaaaaacacggcacacacacagagaaggatggttttttttcactgatggtcgtctgatggaaacacttgttccgtagtgtatacgtgtggacgtgtggttaatttcatgcaggagctctcccttaaaccttaatcactgcagcagcagcagcagccgccgccgccttctgatgagcggcggcggcgaccgccgagaaggtcttctccatgactttgagcttctcgggaggcggggccgcagcgaccgcgtgggccgcctggccgtatgcagcaaggatttttgcgatcttgtccttgtccccctccgcgtaggccttgttgatgttggcgtcggtggctagcctcaacttgagcacggcgttcgtgatccccagcttggttttgggcgtgttcccggaggcgatggt

SEQ ID NO: 15825 - DNA, 408 bp, Zea mays
  unsure at all n locations
  Clone ID: cC-zmpo148041c10b1
cccgtacggcttcttcattagcatgaacaaagttttctgccggtctgtcgttagccgctttctcctattcatcaagactngggggtctagtgatgctacctaatgcttctcacttgtcattttggacacatgttcgacctattcaattttaatgagatgcctgatgaggctacttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaataaaaaataaaataattataaaaaaatataaaatatattacctggggggggggttttactgggtaaaaattaatattcaccctcgctctaactataatattttt

SEQ ID NO: 15826 - DNA, 613 bp, Zea mays
  Clone ID: cC-zmpo148041c12b1
cggcccagatgatatctagggtagagtacatgcacacgagggggtttcttctttgtgatatcaagccagacaactgcctcaggggcttatgccgtaaaacaagtcaggtttatgtcattgactatggccttgcgaagaagtatcgggacctccaaactcatagacacattccatacagggagaacaaaaacctcacaggaacagcacgatatgctagtgtaaacacccatcttggagtagaacaaagcaggagagatgacttagagtctcttggttatgtgctgatgtacttcttaagaggaagccttccttggcaaggcctgaaagctggaacgaaaaaacagaagtatgacaaaattagtgagaagaaaatgctaacctcaattgaggccctgtgtaaatcttatccatcagaattcgttacatatttccattattgccgctctttgcaatttgaagataagccagactacagctatttgaagaaaaattttcgggatttattcatccgtgaaggttaccagcctgattatgtatatgattggactgtatcaaggcaagctgcggacataacagattgcgactgagtgggaagacaggtgggttggtggga

SEQ ID NO: 15827 - DNA, 533 bp, Zea mays
  Clone ID: cC-zmpo148041d01a1
gcatataaataaacttggaactggggacgcacgttcttcgtttccaaacagtatggcaccattgcacgcacgcacgcacgcaaaaacgctacctgtgtgcgaagctcttgagcccgccggccacaccgttgatcttttgcgtgtggagaaacttcttggtcgccaccctgtggagcttcttcagcttcctaccgttgccgtccggatgcttctcgccgccgtcgtcctcggcatcctgatggtcctgccagtgcacggaaccgctgtggtgcgccgtctcggcttcggcttgggcttcggcttcggcggcggccgtcacactctaggctaggccgcctcctggacttggtgcgcttggggtcgcaggcgacggcgtctgcgtggaggacgtcctcgatccgagacagaaccgcgaaggctaggctctcgagggtcctggagtagctctccaggatggcgtacccgacgtccgtgttgtactggatcttgctgatgtcgagcgccgactgaaggatgccggggtaccctgtctt

SEQ ID NO: 15828 - DNA, 353 bp, Zea mays
  Clone ID: cC-zmpo148041d02a1
ggggggggtttttttttttttttttttttctcccttccctctcttttcttcttttttaaaaagaaaaagaaaaaacggttcccacccttttttttttaaaaaaaaaccaccggccccgggttaaggaaaaacccccctccacggggtttaaaaaaaaaaggggataattaccccccggggtaatcctccataccggggggggggggccccccttcccctaacaattatttaaattatttagggcgaaaacccccacccttaaaaaacggggggcccccccccccccaatatttttttaaaccccccttcggtaaaaatgttggggcccccccgggggggccctccctttgggg

SEQ ID NO: 15829 - DNA, 239 bp, Zea mays
  Clone ID: cC-zmpo148041d03a1
ggccaaaggacttttcgagtttggggaggggaaacatccaaaggaatgcaaatggtgaacgtacaaatgtcagcccttctgttctccgacccctctgtttgcaagtctcagtcattgtacatacacacaaacatgtgtgcgcgcgcgcgcgagcgtgtgtgccacctcactatatatgatgggatgtatgccatgccatgcggcctttaaaacttgaaaccaattttgggcggggcccc

SEQ ID NO: 15830 - DNA, 624 bp, Zea mays
  Clone ID: cC-zmpo148041d10b1
cgaacgccaagaagatccaggacgacttctgctcgacgctgtgcgattttaagaattttacggacctggtcgtgtgcggggagtcgggggcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaactggtttttttcaaatataccgtcgatggaactccaaatgtaatgtcacgcaaatgtgtgtttttcatcgattgaagggtaataataaaaggcatgctggcgttac

SEQ ID NO: 15831 - DNA, 601 bp, Zea mays
  Clone ID: cC-zmpo148041d11b1
acgcccaccctcgaagccgaaggcctcgtgccttctcttcctccttttcatggtttaagtagctgtttcacctatgggcgttgcggccgtattgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagccccaagaagagagccatcgcggctgctgatgacgattgcaagcctgccgatgacgagtcaacgtcgtggaagcgcctcgtggacggtatgcgcacgctccgacttcgcgggcagctggagtactacccgacgtcaccgacgacaccgacgattggccacgccgatgtgtaccatgacgtgaacctc

SEQ ID NO: 15832 - DNA, 583 bp, Zea mays
  unsure at all n locations
  Clone ID: cC-zmpo148041d12b1
cacccgaacgcccacgcgtccgcctcgcaccagtccctcctccttggaagcgttggaggatatgtggagggagagggaggagcggggcaacggggagctcgggaggcggcgtggggcttgcacgccggccctacccccagctcactcaccacgctcttctctcaccaactctctctctctcttatctccttccaagattcccccatttttttgttgttgtcccccccattcttgctaggatcattccttgatctttcgctcgctccagtacgcccgttttccagctccggagatcccatctcggccacctcctgcggtctccaagctccaagaggccagattccagcacaaatttgaggtcaatttgcccgctgagctcgaatcaatccgctcggcaacaagtgtcctttgttcccccgatccccgggcttcgattcgatcgaatccgacctaatnttattgtgtgtgtgtgtgtgtttaaccttctctcgctgcacttttcctttctcctccctgtcgcaaacgcaaagtgggttccatcgcgtcacccgcacggctcctctgatcgggcggagaaagaaag

SEQ ID NO: 15833 - DNA, 265 bp, Zea mays
  Clone ID: cC-zmpo148041e01a1
gacatacggttttttaccagagcgagcgcgggggattttctatgactctcacaaaacaatggcccaaggcctgatcccgtgacgacacactcatagtagcacacatagctctactgatatgtaactacccgatcgcggggcacccattttcgtacggcaaggcgtatgcttggctggcgtccatctgcgggctcagccgcacatcgaatcatggcatctgttctgggaatgtatcgtacaatccccacatacaccgagctaaggt

SEQ ID NO: 15834 - DNA, 504 bp, Zea mays
  Clone ID: cC-zmpo148041e02a1
attccagcaaggaattcatattatttgggggggggcgcgaacccagttctacacgaagtgacgaaatccccactctacacgaacacaatcacattcacaagcaacgccaatagcgccgccatcaatagagctggcgccacccgagcactggcactgattatctggaccgggaacaggcagccgcgcgtggaggcgttcttgtctgtgatcttggcaagcccttcgaagtcgcaggcgcgcacatcctggtcctgcatctggaagtacatgttgaacgcgtaagagatgttgctcttctcgtccagcccattgcaggagcagccatagccgagtgccgtgcagtcgccgctcgcacatgcatactggacgttgctaggcagcttggacttgtcctcggccccgtcgtcgaacacgcaccactggttcgggaggtacttaacgtctgtaactggggagaggagcttttcgtggccctgccccgtcaggtcgatggggaacttgggc

SEQ ID NO: 15835 - DNA, 552 bp, Zea mays
  Clone ID: cC-zmpo148041e03a1
atatatcatatattccattccagggcgggggtatgataaaattgggattgcatatataggagatacatatacaatacaatatttgtgttgttgtttgtcacactccttatatccttttattaaataaaaaataaaaaatataggtctatcaagtgtgccatttgatacttattattatttggttagtttatttggcggtgtatgcagtgttgggctttcatccagcggggatgacatcgtcatatacggtcttagtgccttcctttgtggtgagtttgtaccgtgatgggtcccttgatcggcttgtcttttttctttcttcaaatggcgccccaagagtgctttagaggcttgtacgtgtcggagccctttttcttgatcttaaccgccacaatgtctccattgtcgtctacgtacttgaccaacagtgccagtgtgttggggttgcaccccttcttcagtggaaggtgaccttaaatacatacttgcacttgacccttcaaactgcatgtcaatgatcccgccttgagcaacttttcttcttaccctttt

SEQ ID NO: 15836 - DNA, 468 bp, Zea mays
  Clone ID: cC-zmpo148041e11b1
ccacccgtccggcagggccgcgcggacgcgcgcgaggccacggttttcgtgcttcataagtgcgaattccaggcgggggccgggcgccgggacgccaagcgcccggccatccgcaactacctgggccggccctggcgcgagtgctcgcgcaccgtcgtcatggagtcggagctcccggacttcatcgacaaggccgggtacctgccctggaacggcgacttcgggctcaagacgctgtggtacgccgagttcggcaacaccgggcccggcgccagcacggcggggcgcgtcagctggccgggcttcaagaaggtgatcagcaaggcggacgcgaccaagttcacggtcgagaacttcctgcacgctcagccctggatcgatcccacaggcacgccggtcaagtacgacctgttcacatgagcgcccggtgatcggaccggaggatgcatcttagcttgttcacgatgt

SEQ ID NO: 15837 - DNA, 530 bp, Zea mays
  Clone ID: cC-zmpo148041e12b1
cacccgtccggccacatcgacgtcgtcgacgtcgagctcgtcaattccgttgtttgcggtgctgcccgagcacggacgcggaggggaggccaaaacggtccgatcggcgacgccggaggaggaacgagccggagccgcccacgtgcacggcgagccggctgactgcgcgatgacggaggacgtacaacaggccggtcccgccgtgcacagcgcggaggccaagccggacgactgggcgacgtggccggagccaccgcctccggccgtcgacgactcgttcgcgtcgtcggacggcggggcctcgctggcggaggcgccggtctggccggccaacctcggagcggcgggggcgggggcgggggcggggtccggcgggttcgaccccgggaggatcccggcgtccgtgttccagcacaggacgtcagtgtcgcaagccgagtggagcatggcgttcaacgagtcgctcttcaacattcatggcgccggcgacctgtaccccggcagcagcaggtcgcacttcgactttttta

SEQ ID NO: 15838 - DNA, 426 bp, Zea mays
  Clone ID: cC-zmpo148041f01a1
catgacatactattgaataaaggttggtggtcagtaacaaatacatagagttactcaatatatataactcataatttcaatgaattcttaattaaatgaaaaatgaatgcaagcattccctgcatgcgatggcacctcacgctggggttgcatgcgtggttcatatcatgtttgcaagagccatgcatttgttggccatctggttgagctccttgtcaaacttccccatggggttggggaccccggcctgggtgaaggggcggtctcacaaatctaaatcctggacggcgagctgcaacatgatcttggcggtgcccgtgtcctttaacgtgatggcccgctgcgccgcgcccatggtgttctgcgttgttcatgtacatggtgtcccaaaacctgagcccctgcttctgctgctgcggtatggtg

SEQ ID NO: 15839 - DNA, 282 bp, Zea mays
  Clone ID: cC-zmpo148041f02a1
ttttttttttctatccttttttttttttttttttttttggggggggttttttattaaaaatccttatacacccctacccttttatatttaataatctctatataaaaaaaaaaaaacaaaacataataaaaataataatataaccaaagaatttcttcccccccccttatattcaaaaaaaaaattttaaaaaaaaaaaaacaataaaaaaaaaaaccgggggaccctataactataaaaaacaaaaaaaactggaaacaaaattattacctgttttatcat

SEQ ID NO: 15840 - DNA, 419 bp, Zea mays
  unsure at all n locations
  Clone ID: cC-zmpo148041f03a1
attaaaaatataacggcattcagatacaggtngggtgttattatcgttacatagtcaagaacaaacatagtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcagaatcgtcgccggacgatggtgctggggcgctggaggtgccatcagaagatgggcctggtgcggcggaggactcatacgacgacgagggcgctggtgcgctagagggaccggatgaggccgtcgccgccggagcatcagcaggcgacgcgctggcaccagcaccggacgccggcgcgtcgtcaccagacgggccgctggcgctcgca

SEQ ID NO: 15841 - DNA, 484 bp, Zea mays
  Clone ID: cC-zmpo148041f10b1
gtccgtgcattcattgtactgggaagtgtttaatattattttttatgttcataaacggagggctgcataggggctatgggtgatccattaaaagcttcatatttgtgcattctattgttcgtttaatttcgtttgacctgttttgtccactcatagtattttttttatttttattaatatcttctctatctacccacctaataataaagaatgaagagtttcttccagcctgcattttttattctgaaaacacccttgggtcctccatgcgctgtatgtgacctggactcacgtcctatgctcatacgagttagaacgacctacatgcaatgatggtacggacccagacttcaagacgtagtgggtactgttgctgcgcatggtcacgtttgcacgtcatatgttgatgtccagttatttttttataaaagatgtttgtattcaatgaactagatccaattttttccaggctgtatggcttctt

SEQ ID NO: 15842 - DNA, 530 bp, Zea mays
  Clone ID: cC-zmpo148041f11b1
cacccgtccgatcaaattcttgttgggatatattcctccaatttttctccttttcccaacaaggcaacaacaatgggttccgggcgccaaacaaaacccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtctgtggcgccgtcgcgggcggtgttcgcctgccgggccgcggcgtcggggagcgcggccgacctggcctccgggggcaggaggtcgtccggcgtgccggtgttcgtcatgatgccgctggacaccgtcaaggaatgcggcaccgcgctgcaccgtcgcaggcggtg

SEQ ID NO: 15843 - DNA, 336 bp, Zea mays
  Clone ID: cC-zmpo148041g01a1
aggatcaattaatcaaatcgttgggggggataacggttgaccccataaagttacaagagcaaacgaagtgagcaaagcaaagcaacacttgcgttattggtccctcccgaccagacgagcaattaccgcacagccaactacgtgcccaccctcgacgacacggtccctggtgaactcagtagaagatcatggtagcgacagcagcggcgacaccagcgatggcagctccgctttcaagggtagcagcaccggaggcatcagcagccgccggtcccttatcaggcccattagcggcaggggacgccacctcggcggtggatgccgaccgcgaagggc

SEQ ID NO: 15844 - DNA, 363 bp, Zea mays
  Clone ID: cC-zmpo148041g02a1
ggccaaaggggggtgggggttttaccaggagaaacagccaaaggaatgcaaatggtgaaggtacaaatgtcagccctcctgttctccgacccctttgtttgcaagtctcagtcattgtacatacacacaaacatgtgtgcgcgcgcccgccagcgtgtgtgccacctcactatatatgatgtgatgtatgccatgccatgcggcctttaaaacttgaaaccaagtatgtgcggcgcgccggtgtacttgagccacatggcgccctcaataaacggcccgggggagaacggctcggcctccttccgtccgatgacgtggaagccgggccagttgacccttttgctggtgccggcgccgggcccg

SEQ ID NO: 15845 - DNA, 313 bp, Zea mays
  unsure at all n locations
  Clone ID: cC-zmpo148041g03a1
ggganggatttgtttggaaaaatcaactccttcagtggggtccgggggcatggattactaaccatatccacatccctttggattatttgctcaaccctgaatcatttttgccaaaatttacggggattggaatggagcccatcctgaacggagatggcccacccaacatttttacatacaaagcagcaaatgaagattgttgccttcatgggccatccccaaaagagaacttattccacgttttttttttcctttaagaatataaggggggggggggtaggcttctgaaaagaaaaatctctatcctaactct

SEQ ID NO: 15846 - DNA, 301 bp, Zea mays
  Clone ID: cC-zmpo148041h02a1
ggctacaacgagggggcgggaatttttgaagagtttacaggatcaacttacaaggagggaggaggacagttacaaatcttcccggtgaaaatgaaaatacgaacgaatctttacaaatatatatatgtgtgtggtttgtatttgtctgcaaaaaaaagcaaataaaaaaactgagtcgagtttacacggtgtagctttgctgaatggtgtcaatgtcgaggcccttgagcttgacgacggactcgacgtgtcccttgagcgtgtgcagctccctgagcctgggcaccttggcgcccttggc

SEQ ID NO: 15847 - DNA, 277 bp, Zea mays
  Clone ID: cC-zmpo148041h03a1
ggccaaaggacttttccagtttggggtggggtaacatccaaaggaatgcaaatggtgaacgtacaaatgtcagcccttctgttctccgacccctctgtttgcaagtctcagtcattgtacatacacacaaacatgtgtgcgcgcgcgcgcgagcgtgtgtgccacctcactatatatgatgggatgtatgccatgccatgcggcctttaaaacttgaaaccaattttgtgcggcgccccggtttatttaaaccacatgccccccaataataaacccc

SEQ ID NO: 15848 - DNA, 613 bp, Zea mays
  unsure at all n locations
  Clone ID: cC-zmpo148041h10b1
gggggaaccacccgtccgcgatctccccccagcggcgaggagagccggcggtcacaggatttagaaatggcttccgcacacagggctctgggggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaaggggagcaacatcgccatccagctggatggcaacctgctgggatcaaacgacctggacaagtacacggcgagctggatcgaattgtctcacgttaacaacatcgggatcaccggctcgggcacgctggacggccaggggaccgccgtttatagcangagcatgaccgacaacgtgaaggcgatgcccaacacactggtgctgtttcacgtgatcaacgccactgtcgcccggatcaaactac

SEQ ID NO: 15849 - DNA, 600 bp, Zea mays
  Clone ID: cC-zmpo148041h11b1
cacccgtccgggagaaccctgattgctatagtgatcttctcatttaaaacctttatataagggtcaggttggtggggaactacgggggccttagcgttggtgcagtgcgagatgtgtttgagaagtcccttggcctgcggctgcagaagatgaatcctaacacagactttcactgcttgaagacctttggttctcacttcacagaagatatcgctataccttcgggtacgaagattgacttctgtcaaacatcagatgggaagcttataacagaaattgatgggaaacaaattggtgctgttcggagcaaacatctttgcaaggctttcttcgacatgtatattggtgattcaccggtttcactggaggccaaaaaagtcgttgcccagaacgtggctgggctcattggaagacgctgaggatagcgagaggatggttattttcattcttctgtacagttagagaggattcatatgagcgggaaaataggccacgtatgtagagtgatctgtcttgtatagaaagcaggcaaaaaggtccaatgtatatgtggaaggtagcatcttcagttgtgctatgccttcattctttttttttttt

SEQ ID NO: 15850 - DNA, 555 bp, Zea mays
  Clone ID: cC-zmpo148041h12b1
gtccggggtgcaaggtggcgccggagcccaaggagctggatgaggttatcgccgcgctcccgtcgatgcggggctcggcgagcttcaggtactactgccagaagaagacggcggccgtcgataggatcgtggctgatgccatcgacgccgatgacaccgtcaggatcagagcgacggcgcgacagctgagcaataggagcgaaatcacggcaaacaaggcacaggactccaacgaggtctctcaacctaaagggggaaccaaatggcttaggttcagtggcttgtcgatcgtcgctgccgcttggcacaagcacaacttgttcagccgccaaagaagcaagccttcgccgcctcctgctgccacttcagatgcaagctcccaaccctgatcaggcagcgctgtatgggatcttctacattttactacgtctcagcttataaaaacacacacgcatggctcattcagtcatcgtttatgatgcatcgatgctggctttgcatcattaactgatatttttcagccttggttagtccctgtaagctaaagctgattct

SEQ ID NO: 15851 - DNA, 356 bp, Zea mays
  Clone ID: cC-zmpo148042a01a1
gaagccgcatcttagagcgacccccttttttttctttttttcattatttttccctttcctttctcagggggaaaaatgggatacatttgaagaggatttcatgtttaatgccaaccactctgccacgactggggcccgtcgttcaccacttgctattacatattcatcgtcgaccttccatgtgatattactgatcgacgttttcattcgagtccaactgtttgagcagcaaggcacaaatgggcaaagtcacttcctttaggtatcccaaccggttggcagcgcgcatgatgtcgctgatgccgaccttcctggtgagcaggactccggcacggaccctgtcctgctgcacctct

SEQ ID NO: 15852 - DNA, 507 bp, Zea mays
  Clone ID: cC-zmpo148042a01b1
tcgtcgtggtctcactgaccccgccttcactcctccctcaccatctattgttccgcccttttccgacattcacagaggagagaggaaatcatcagccatggcctcgattccggcgacgaccttcgccgtcatcttatccgtcctcttctgtgccgcggctggcaccgccgtctacaacgaccttcccgactacatcatccagggccgcgtctattgcgacacctgccgcgccgttttcgtgaccaatgtcaccgagtacatcgcgggcgccaaggcgaggctggagtgcaagcacttcggcaccggcaagcttgagcgctccatcgacggtttgaccgactgtaacagcacgtacacgatcgagctcaatgacagccacgaggaggacatctgcgaggtggtcttggtggagagcccgcgcaaggactgctaccagttgcatgcggtcagggaccgcgccggcgtcctgctcaccagtaacgttggcttcatcgacatcctgcgccc

SEQ ID NO: 15853 - DNA, 303 bp, Zea mays
  unsure at all n locations
  Clone ID: cC-zmpo148042a02a1
ctcctctcttttctgtttaccaaattatatattccatcccatgatnggggaacgggtggacacaaatagataaattaactcacgtctatgtaattaacacaacccgtcaccatgcttatatattcatatcacatcacatcaataataatatatggaaacagcggtgcaggtgacttcttccaagtcgaccaccgcagcaacagtcaccaataacgagcgaggcaactgtaacggcaacggtggacggatccatcttcatccatgctcgcgtacgtaaccactcacacgcttatagtaagttaa

SEQ ID NO: 15854 - DNA, 281 bp, Zea mays
  Clone ID: cC-zmpo148042a02b1
cacgcgtgcgttagaagcatcatcctccaataatagccagcctctcatattttataaaactctcaccgtcgccataggagagagcattcctacctaccccgtccccaacgcaatccgtctcctacgtaccaccgccaccttaagatcgagatggagatgaataggatcctcttctccgtcctcgtcgtcatctccgtctcggccaccgaattgcttgcctccaccgatgccgcctccgcttactccccaactgtctcctagtcgtccgcctaagctccccc

SEQ ID NO: 15855 - DNA, 437 bp, Zea mays
  Clone ID: cC-zmpo148042a03a1
cggatccttaggggggccgcctttttctctctttattttctctttttaccccaccttgccgccggaacaagggcttcacatatcatcgggaacatcctccgccttctcgtcaggaactagagcttccacgcatttgtcgggctgtacatcggcagtggaggccgtggccgtttcagcctgtttttcaccaacgggtttctggtcatatgtgtcagcgccagcggtcgtcgccggcgtagcttgcgcgttcaggacctgctccttgggcttcctggcggccatctccagtggcccgtatgcgtctagggacatggtcttgacagagccatgctcgtcggcggcaaccgcagtagcatcatcttcttcgatagccttgctcttggacttgacgtgccgcgagaagcacaccgtccggactagtagaggctccgtggcga

SEQ ID NO: 15856 - DNA, 485 bp, Zea mays
  Clone ID: cC-zmpo148042a03b1
tccacccttcttccaagggccacgatgagggcgcctctcctcttctctctcttcgtcctcgccgtcgtcgccacgaggcctggtctagtcccggcggtgtgcatctcgcggcacgacatgtccgagagcaaggctgacgaagaatctgctgctactaccgttgccgccgacgagcatggctctgtcaagaccatgtccctcgacgcatacgggccactggagatggccgccaagaagcccaaggagcaggtcctgaacgcgcaagctacaccagcgacgaccgctggcgctgacacatatgaccagaaacccgttggtgaaaaacaggctgaaacggccacggcctccggtgccgatgaacaacccgacaaatacgtggaagctctagttcctgacgagaaagccgaggaatttcccgattaatatgcggaagctctaattcctgacgacaaggtggaggtgaagaatagcaagtaaataataaa

SEQ ID NO: 15857 - DNA, 371 bp, Zea mays
  Clone ID: cC-zmpo148042a05a1
acagcctcatacagaatgcgggaattgggctttcattaaaacaaggacactaaaacacaagaccgttcccaacacacaatcaatgattcgacgacccactggcatgcaggagccgatgcgcccctgcagcgtgcaggtgcatcggccggggctgtttcagagggctcgcgacttgacgatgtccatgctcatttcgctcgggtcggttgcttgtagctccacctgaatgccatccagctccctcttgaaccggtccttgtagctcgcgtacagcatcttgcttttcacccttgatgtatcctgtgcccaataaataaagaacatcttgcttttttggcacttctcgtcagtgactaaatcaaaatctaaca

SEQ ID NO: 15858 - DNA, 333 bp, Zea mays
  Clone ID: cC-zmpo148042a05b1
tggttgcggtggtccacatccttttctctcctcctcgcctgcctttctctgattgttcttcaaccaaaaggaggataggatggaagggaccgtaagcatcacccatgtcgaactcggcgtcgggaatggccgtctgtgatgaatgcaagctcaagttccaggagctcaaggcaaagaggagctttcgcttcatcgtgtccaagatcaacgagaacgtgcaacacgtggtggtggacaggctaggggagccagtcgagagctacgacgccttcacggtctgcttccccgccaaccagtgccggtacgccgggtgcgattttgacttcttcactg

SEQ ID NO: 15859 - DNA, 170 bp, Zea mays
  Clone ID: cC-zmpo148042a06b1
ttgcgcaacgcgcgctgtacttaacgtatccaggcatgtattcgtgttgtttggtcgagaggccaacgatttatggggagggtacaaaaaaaattatataaaaaaaaaaaaaaaaaaaaaaaaaaaaaaaaaataaataaacaaaaaaaaatataaaaaaaactgggcgg

SEQ ID NO: 15860 - DNA, 410 bp, Zea mays
  unsure at all n locations
  Clone ID: cC-zmpo148042a07a1
aattccactctgcatgcataatgttttnggcnatggttaagcatccgcgtttcatacaacctatcccactctgtacattcaagtagttctctactgactagtagtagatagagtaactaatagatgcaatccatcaaaggtcctcagcgtgcgccatcgaaccaagtaggcaatcctatagaaagatccaatccaatccaagcaagaactcggtcgcgtcatccccccacgcttggcgtgcgtgaagctcggcgacttgggtgtgtgcgcgcgcgtgcattgcttatgcatgcttcctagctaggcgtcgcgtccctcactgtttgccaccggcgccggcctcgatgtcgttgctgttggtgctgctgtcctcgccatggctctcgtgccactccatgatgggcttcatc

SEQ ID NO: 15861 - DNA, 494 bp, Zea mays
  Clone ID: cC-zmpo148042a07b1
atggcggaggccaggcgcaggacgacgccccggccccgcgcgttgtctttcgctgctcgccgaggtggaggtcgggaacgggtccggcttcgacgtcaccccaacgccgagcccgcacggtcaggacgccaccaccccgagcccgcgcccgcccacgaagccgtcgtcccgccccggggtgccgccgatggaccgcgtgccgtgccgcagcgaggtggtgttcccgccgctggactcgccgttccaggcgccgggctaccgctccgtgcagcccgtctccataagcctcccggcgtcgcccatcggcttctgcttcggcgtgcccgccatccccgcgccggccaacgccgccgactcggacgacgactgacttcaggccaacgccgcggccggcgagccacagcaggcgccggcgcatgcgccgacgacgtccgcgcgggagaatggatgaagagggggcgttcggatcatgcaccagacggacaagctggtgt

SEQ ID NO: 15862 - DNA, 430 bp, Zea mays
  unsure at all n locations
  Clone ID: cC-zmpo148042a08a1
ctctgngncacaagaaccaagtgaggacagcttattttcattccagcaaacaacacctgagcctaaaactcggaaaaagatcaatacaatgtgcagggaaaacaacggcatgcatctaattcccagcagaatcctcggtggcggtgcgcctccttagcttggcgcgcgtcacacggatcgtctcctccatcaacgtctcctcgagcgcagggtcaagctcttccgcgccctctttctttgggctaccgccaggttttggtgtggatgcagctgctgcatgctttgtggatgccaccgaaccaggtctccctgacgtttgacgctcgatcttgagtgaatattgaacgggtatagtctccaaagaatgctgtgccattgctgcttgccgagcaaaataaatgctcctttgcgcataacaagtgctgcttgt

SEQ ID NO: 15863 - DNA, 618 bp, Zea mays
  Clone ID: cC-zmpo148042a08b1
ggacgcgtgggcggacgcgtgggaaaccatagctcctgactgtattacttttcctcctcacgggcgggctccgtcgggtcggtgcatccaccgccccggtcgtctcccggccagatccctctcctgcaaggtttctttgcgagtggccggagaagatgatgggcgggttcctctccagggtcctcctgctggcttttggctatgcctatcctgcctatgaatgctacaagaccgttgaactgaacaaaccacagattgagcagctcatattttggtgtcagtattggattttagttgccctgttgacagttttggagagatctggagattatacaatatcatggctaccgttttactcagaagcaaaggtgttgttttttgtatatttgtggtaccctaagacaaagggaactacgtatgtttatggaactttctttaagccatatatttttcagcatgagaatgaaatcgaccgaaatcttcttgagcttagagctcgagccaccgatatgggtgttctttacttcctaaggctgcttcggtagggcaaaataccttttttgacgttttaaaaatgttgctgcccaaccccttttcggaaataagggtgccccttat

SEQ ID NO: 15864 - DNA, 358 bp, Zea mays
  Clone ID: cC-zmpo148042a09a1
aatcatcatctcatacagccataattattctcaataggccggtttaattcatgggaactaacgactctcacaacatcatgtgttgtaaaccacacattacttcataacagacacacattacactatagcagtagcatctcacggcatatcacggtataagggcatcacactgtcctgatgctgcgtcatcagcaaacttctctagtactcgtcaccctcgtctccatcctcgcccttatctaactcaatgccgacctccttgtattccttctttagcgccttcaggttcctatcttcctcataaaacttacctttcttcatacccttacctacgtaccattgcacttaatcactcttt

SEQ ID NO: 15865 - DNA, 319 bp, Zea mays
  Clone ID: cC-zmpo148042a09b1
actggtctacctgccggctcaaacctttcccccttcttttattttttccgtcggccgccgctccatccggggcgggtcaccatgagtgagtcgcatttcgatccacatcgaccaggtcggtatccaggtcacaaacgcgtgctgggagctctactgccttgaccatgtcatttaggctgacggttacatgccctttgacaagaccatcggggtcaatgacgatcttttccacagcttctatagggagactgtggctgcgaagaccgtgccccgtgctgattgtgctgacctcgacgcagtttcaacgatgaggtcagga

SEQ ID NO: 15866 - DNA, 191 bp, Zea mays
  Clone ID: cC-zmpo148042a10a1
gagcataaaggtttggatattttatcaatgcactttcatgttttaacaagcaatacacggtgaataaattaccatcatttgctcatttaatcactctggcctcaatttaacaaaaaaaattcggacccaaatgttacccccatcgtgtcctccaatacatcggcttaaacgaggaccaccaaccaaccaac

SEQ ID NO: 15867 - DNA, 189 bp, Zea mays
  unsure at all n locations
  Clone ID: cC-zmpo148042a10b1
ttggttggttggtcgtcctcgtctcagccgatctactggacgactttatttcggtcacatttgcgtccgaatttgggggggggattgaggccagagtgattaaatgagcatatgatggtaatttattcaccgtgtattgcctgttcaaacatgaaagtgcactgatacaattttaaaaaacttatgcnc

SEQ ID NO: 15868 - DNA, 451 bp, Zea mays
  Clone ID: cC-zmpo148042a11a1
atattctgaatttacctgagcatgtcacaatgattaaggacggacattattaggtaaaaggagtgatcaagggcacaacttgcattagacttgacatctcaggtactaggatgatctttcgattctcgtggcctcgctgctattcgtagcaatacaaaccaacatggtataggaaaaattaacatcacaccaaacataatcacaaaatgcatattaatattcgcatcgtaacgagatcctcgagaaccactaaattcggagttactgtgattaagttatgattttccgaagatttaagtgtatattataaaacaaatgaggtacaagattttaaccacaggttttatggtaatacatggttactagatgatgaagaatattactagagatttatgcaattggaatgggtcaaaaagagtcaaaatgaattacttattaaataaaacaatat

SEQ ID NO: 15869 - DNA, 572 bp, Zea mays
  Clone ID: cC-zmpo148042a11b1
cgtcggcgtacgaagctggggaattatacctggagcttcgccattttcattgaatacgggcgtggcatcatcggggggagctcggcctgtacgggccggaattcgtcgttggtgctctcctccatcgcagatccgccttccgtcgtgagccgggtagaacgccgtcatggggtgggtatcttctctggttgccgtcttcgctgtacgtagggccgttcaactagaggttagggcgaggtagggccgtagggtcgaccccgggggggctcctgtcatgtccgccgttgtgaggggttgggcggcgtgcagttcgcattctggctgggggaggaagataagcttctagccgttgatcgtctggcgtagggctgatattagaagggcctcataccgattcgctcattatatcgcggccatagattgggtgttgatcggtcctgatgaactcctgccggtgggcgtcgatctcacatggagcggctctgattagcacacgaacatatctattcgcagtcgttgcctcgttggttgttgaaatgaacctgcagtccggaatattgataagaccattg

SEQ ID NO: 15870 - DNA, 389 bp, Zea mays
  Clone ID: cC-zmpo148042a12a1
ggccgcccttttttttttttttttaattttttttttttctcaatttacattcgagtagaaggaggggcgatgtttcgtgtaatctataaaaacaaaacgttgtataagtagtaggtacatattaaagccaaacgaacaggctctatgtccatcacgtctaactttataacctaaaaattgtgattatgttcttaacaaggtcgcttgagctactgaattgatggtagaacagcggtcgtcttctaatcaatgctcttcgataatctggaatacacatagccgttgcacctcacaaaaagccacttttcttcctacgggtgttctttatcaagtctgtcaagaacgcgttaaacgccacgtgagatgagcctccttccttgagaacctcc

SEQ ID NO: 15871 - DNA, 535 bp, Zea mays
  Clone ID: cC-zmpo148042a12b1
cacgcttgtctggaatggctggacgcccatccggaccggagcgttgtttttttcagcttcggcagcctggggagggggtgggggccgcatctgatagagatagcacgtggactggagaactccgggcagaggttcctgtgggtcgtccggagcccgcctgagcaccggagcaactccgtggagccggacctggacctggagccgttgcttcccgagggtttcttggagcgtactagggaaaggggcttcgcggtgaagaactgggcgccgcagagcgaggtgctacggcacctttccatcggtgccttcgtgacgcactgcgggtggaactcggcgctagagggaattgcgtctggcgtgccgatgatctgctggccgttgtacgcggagcagaagatgaataaggtgcacatggtggaggagttgaaagttggcgtggtgatggaggggtactaggaggagctggtaaaggcggaggaggtggaagcaaaggtgaggctggtgaatgcgcccggatctggcgacggagaggagc

SEQ ID NO: 15872 - DNA, 322 bp, Zea mays
  Clone ID: cC-zmpo148042b02a1
atatgcagcattgctacggtacggggcattttggtttccaaaagttaaatagccgacaccttgtgtgttcgtgtaaaacttttcctttacaacccagcgaaacagattgttcgtcatgatccggcctaaaaataaacccaccggtttaggcctcggaagcggccttgagaacaaacacctggccgtccaactcccaaaggtaaaagaatcgtgaaccacagtggaccatgcatcctagagttgtgatcatcaatggcctcctcccatggagaccgaccggaagctggtcttgggctgccccacgcgttcgcccacgcgttcg

SEQ ID NO: 15873 - DNA, 344 bp, Zea mays
  Clone ID: cC-zmpo148042b02b1
ggacgcgtgggcggacgcgtggggcatcccaagaccagcttccgttccgtttccatgggaggaggccattgatgatggcaagtgtaggatgcatggtccactgtggttcacgattcttttacctttgggagttggacggccaggtgtttgttctcaaggccgcttccgaggcctaaaccggtgggtttatttctaggccggatcatgacgaacaatctgtttcgctgggttgtaaaggaaaagttttacacgaacacacaacgtgtcggctatttaacttttggaaaaaaaagtgtagtacctagcaatactacattaaaaaaaaaaaaaaataatataataat

SEQ ID NO: 15874 - DNA, 440 bp, Zea mays
  Clone ID: cC-zmpo148042b03a1
cacagcgctgatcattgtggggctatgggggaaaggaacaggagttccatgcccaacaatttctgctacaagaagaaaactggcaaaagatgatcacaaagagccctacagcctgatgctcagtcgagcaaggtcctagctctttgagaaagggaaaaagaaagagaggatggattgtaattgcatctccgaagaggctgcacttaaataacaatcgactaagagggggagaccatatggataaagtgctggagacggtctaagaggatggcttcaattatgatggctgaaccactgaaggagccatgttctcctcagatcggctgctccagcagatgtcgctgagtgaaggtcttaggcccttgctgcagaacatctcatactccagcgtgtcgcctgccgacttctttacctcgacgacgtgaaaggcccgtgtcacc

SEQ ID NO: 15875 - DNA, 566 bp, Zea mays
  Clone ID: cC-zmpo148042b03b1
cgcctccgcgcgtgtctaggtttcctctctcaccatagcgcccgctctgtcgcttttcgttcacctctccttcctctcgtccctgggtgccagggagaggggaagtcagaggcacggagtggcgcatagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgttcgccaccccaacgtcgtgcagctgcacgaggtgatggccagcaagagcaagatatacttcgccatggagtacgtccggggcggcgagctcttcgcccgcgtcgcccgcggtcggctcaaggaggacgccgcgagaaggtacttccaccagctcgtcggcgccgtcgac

SEQ ID NO: 15876 - DNA, 445 bp, Zea mays
  Clone ID: cC-zmpo148042b04a1
ccaagttctgcattttcgcattccaaaggagaccaggtggttggtatcatccatgatccatcgtacaccattttctagaatagaataggatgatgacagggcacacaaaccaggaggcgcatcgcttacaaaacaatttacaatacacagctgcatggcaaagctcttctctgcgccaaggcgttggcagtcacgacacagcaacaccaacgctccacaagacggtcctttttcgtgaacccaaagttgtcgcagcgatgggaaatcacagtccggatcgctctgctgctgcggcagcgtgggaggccgactaggcaatagggcggttgccagaccggctgtgcagcaaggggttcagagccttgacgacgatgctcatgttgggacggaattcaccctcgtattgcacgcagagggcggccacagcagccatcttggctacagc

SEQ ID NO: 15877 - DNA, 618 bp, Zea mays
  Clone ID: cC-zmpo148042b04b1
gtccttgctatgagtatgcactggggatcattgcatgattcctttatggaaaaaggggtaaaggaggggagggggggcagtcctgtcatggatgcgccagctggattgccgtatgtgctgctcgggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttattgaagacaaggtgaggcaatgcgtttatccaaggcttcgagacgaataccctccaaggctgtagccaagatggctgctgtggccgccctctgcgtgcaatacgagggtgaattccgtcccaacatgagcatcgtcgtcaaggctctgacccct

SEQ ID NO: 15878 - DNA, 425 bp, Zea mays
  Clone ID: cC-zmpo148042b05a1
cacatacagtatataatatgggcccatgggtacataaagaactgaagaatggtcacaatcaaaatgaacctggaatacatagtaattaggaaaatagaaaggtttcaaattgtaagatcgagagcgtagtccacggatgaatataatctctcgtgcacgatgtggttagcagtgggtgggtctgaaattaataaacgatactataatgatgcatatataatcgacgtgttgcttgatgtgatgatagtaggacgatgaccatcagttggtccggctcttgacgatgtcgaggctcatctcgctggggtcggtggcctggatctcgcactggatgccgttcagctccctcctgaacctgtccttggagctggcgtacagcatcttgctccgggtgcgtgcagtatcaggggaccaggataagaaga

SEQ ID NO: 15879 - DNA, 609 bp, Zea mays
  Clone ID: cC-zmpo148042b05b1
acgcctacgcccacgcgtccgcacgcgtccggcattgcttgcgcgagcgcagtttgcacacacgtacagccatggcgaactcggggggcgggctggcggtgagcgacgagtgcaaggtgaagttccgggatctgaaggcgcggcggagcttccggttcatcgtgttcaggatcgacgacaaggacatggagatcaaggtggaccgcctcggcgagccgaaccagggctacggcgacttcaccgacagcctccccgccgacgagtgccgctacgccatctacgacctcgacttcaccaccgtcgagaactgccagaagagcaagatcttcttcttctcctggtcccctgatactgcacgcacccggagcaagatgctgtacgccagctccaaggacaggttcaggagggagctggacggcatccagtgcgagatccaggccaccgaccccagcgagatgagcctcgacatcgtcaagagccggaccaactgatcgtcatcgttctactatcatcacatcaagcaacacgtcgattatatatgcatcattatagtatcgtttattaatttcagacccacccactgctaaccacatcgtgcacgagagatat

SEQ ID NO: 15880 - DNA, 492 bp, Zea mays
  Clone ID: cC-zmpo148042b06a1
acgcattaacaatactctttgatggatgggtaagggggaacacaatcaagcacatcgatttctgcattaccattaattattacatggcaaacagcgcatacatgctagctatctctgagactgttttttcatcatcacatcagcaccgatatccggtgagtatcctccaagcaatgcatacatgtgaatccaacatcgacttcgttcttcacatccatccagcaaagatgaaaaccacaggcaaacgaaaacaaaaaaagaacctttttatcccgaagattgcagaacaacaatcttggcgagtactgtataatatatgcgcatggtgttcggcggacagctcgtattataacctgcgcggtgcatttgtgcgtacggcgctcggcgaggcgagatcagtcgctgtcgctgctgctgctgctgtggccgtcaccatcaccatggtcatggccttccccggcttcttctctttcttcttcttcttatctttct

SEQ ID NO: 15881 - DNA, 486 bp, Zea mays
  Clone ID: cC-zmpo148042b06b1
aaagagaagtagccaggagcatgtctggcatcatcgacaagatttttgatacgctccacatcgggggcgaccacaggtaggggcacgagcacaataagggcgaggagcaccacaagaagggcgaggagcaccacaagaaggacgacggggagcacaaggagggcatcgtggagaagatcaaggacaagatcaccggcgagcacggcgacaagtccggcgaccacaaggacaaagaccataaggagaagaaagataagaagaagaagaaagagaagaagcacggggaaggccatgaccatggtgatggtgacggccacagcagcagcagcagcgacagcgactgatctcgccttgccgagcgccgtacgcacaaatgcaccgcgcaggttataatacgagctgtccgccgaacaccatgcgcatatattatacagtactcgccaagattgttgttctgcaatcttcgggaaaaaaggttcttttttt

SEQ ID NO: 15882 - DNA, 411 bp, Zea mays
  unsure at all n locations
  Clone ID: cC-zmpo148042b07a1
accaggatcctaatagcggccccctttttttttttttttatggaatatcttcttcaattaatatttacaactgggggntgatttaaatcatacatgatacagcacctacaaataatcaaaaggcccatccaaacaagaaaaaaaaagaatggaggcctagcacaactgaagattctaccttccacatatacattggacctttttgcctgctttctatacaagacagatcactctacatactttgcctattttcccgctcatatgaatcctctctaacctgacagaagaatgaaataaccctcctttctctatcctcaccgtctttcaatgagcccacccacattctaaacaaaaactcttttttcctccattgaaaccggtgaatcaccaatatacatgtcgaagaaaacc

SEQ ID NO: 15883 - DNA, 406 bp, Zea mays
  Clone ID: cC-zmpo148042b07b1
ccaaaaactggaataaaagttccaacatttctggaagacgactcctgtccatttgcagcggtccttgttgggatagggggcaagggcttgatagtgatgagggtcaaaaatcttaacctctacgcttttggtttatatatgcaaccgacttctatccctgagaagttgggtcctaagtatgcttcatttccaactgacaagctgatggagaaccctgattcctatagtgatcttctcagagaaaaccttgatataagggtcacgttggtggttaactacaatggccttagcgttggtgcagtgccagatgtgtttgagaagtcccttggcctgcggctgcacaatatgtatcctaacacagactttcactgctagaccacctttggttctcactttacataagata

SEQ ID NO: 15884 - DNA, 347 bp, Zea mays
  Clone ID: cC-zmpo148042b08a1
gggacaatctctttcatcgattctcctttataccatatagacaaggctcggtcaccttggaacattaattaataaacaatacgtatgcatgtatgtatatagctaacccaacatctgtaacaacttatacatggtaccaggaagttcccctctgttgttggcacgacaaaaaactcagtgtctggtagcattttacgaatagaactggtacgttttcgcgtccattatgatctgccgaagccctccgattggcgacagaatcatcaagatcacccctagaatgatgcacatccacttgttgaaccacaagaggctgaacctcttgggcttttacatcactagccaca

SEQ ID NO: 15885 - DNA, 589 bp, Zea mays
  Clone ID: cC-zmpo148042b08b1
cacaattcctgaggcaccaaccaagcctctcttgttgactctgtctcttatcgacggccatggggacccaagcggcggggggggagaactacccccctgaaaaggatgcgaggagcgcacgggagaaggccatcgacgagtggctcccgatcacctcgtcgcggaacgccaagtggtggtactccgccttccacaatgtcaccgccatggtgggcgccggcgtgctcagccttccctacgccttgtccgagctcggctggggccctggcatcgccgtgctggtggtgtcgtgggtgatcacgctgtacacgctgtggcatatggtggagatgcaccatatggtgcccgggaagcggttcgaccggtaccacgagctggggcagcacgcgttcggcgagaagctgggcctgtggatcgtggtgccccaacagctggtcgtgcaggtgggcctaaacatcctgtacatagtgaccggcggcaggtcgctgaaaaaattccacgacttgctggtgtgcggcgaccgccgagcgttgtgccaggggaaggacaacattatgaccacctacttaattttgatctttggctccgt

SEQ ID NO: 15886 - DNA, 436 bp, Zea mays
  Clone ID: cC-zmpo148042b09a1
ggttgggtttttttaaaccaatcccaaacaaacggggttcattttatacaaaccgttttcctaaaaacccccgtgtggaaataaaacaaaccctacttcccctgggggaaaaaaaaagacccacccgttcctgtatgtgtaacaatgccccaacacaattctttaaggcaaacctttatttatttgcaaaaccacaacctgtgaaccatccttgcttttttccaaaaaaaaaaacccaaccctttcaacctgttttggccaagccattaactaaaaaaaacagccttttactattaaaaacaaataccccccaccgtccctataaatcattacccccatcccgaaggccaacacaattagaccggaatcctttgatgttttcccctgccttattttcccaaacgaaggctttcttttaacccctttatttttttaa

SEQ ID NO: 15887 - DNA, 388 bp, Zea mays
  Clone ID: cC-zmpo148042b10a1
gagaccaggcgagagattatacagcacggctgttacttgtacactgtattgttcgattcctatggttcgctcggttcaattcatagcctaacaaaaaagatggcgagctccgggcagtcgccgccgggcgttccgaccatgtatagcgactcctagtcccaggacccgacagtgtgctcaaatctcccgcgcatgtactccatctctccgtctgagccgtccatttcctacctgtcgttgagcactccgcctcccatggagacagcccacatcttctccaacactgttatttcctcctcgggggggtcccgccgcaccacgtttcccaccctcttgccgtttcaaaacatggtccacattagctccttcatcacccaccctttttggt

SEQ ID NO: 15888 - DNA, 465 bp, Zea mays
  Clone ID: cC-zmpo148042b10b1
gccgatcgggggagcgcagcaggcgggccgcgccggccgccgcattaccttgtagcccaggccgcgcgcgcgcgcggggcaggtcgtctgctgtcgctcctccgtgatggccgacgtcgacgtggacgccaacaacgaggccgagcaaaggacgcgctcggagccggggacctccatgtcgccgtcatcggaggccgacgacgacacggtcagcagtacacccaacgagtccccggcgcgcgccttcgcggggcacacgctcgaggagccgcctcggcggcgggcgccgtcccggcggtcccgtcccgttcggatgctccagagcgtgtgccggtcgctcccgctgctgaacccgcggtgcgggcggccgatgatgcaggccggggcgtgccagatcgtggtgccgtctacgcggaccgccgtcgtcgacgacgtgccgtagtaggactcatcgagctcgctgat

SEQ ID NO: 15889 - DNA, 396 bp, Zea mays
  Clone ID: cC-zmpo148042b11a1
aagatctctattttccatgctagaattatcatgcagggggacggcacattcacgatacccgtgcgtgcaacaaaggaagaaaagggagcatccatccaccacccaacaaggctgaataaataactatgaacaataaatcgatggtaccaacaacggctttgtgaacaagctgcagacttgatcttcagtccagtccagttcagatcagctcaccaatctaggctaatgttcctcgagaggaaaaggttgtccatgtactctatgataggactagaagcatcaatgtatctcctcatctccttctgcacggagaaatcagtttcattcatccccactatcaactgctccctatttggaagagtgtacatgccagcaccaacagcctttctgatcgcc

SEQ ID NO: 15890 - DNA, 384 bp, Zea mays
  Clone ID: cC-zmpo148042b11b1
cgcctccgccagccgtcacgcgtgacgtttcccggggggccgggggagagagatttatattgaggaggcacggagaggactagaggggatgctcgggttcaggcagatgccgtggtcgtcggcgcaggagcaggagcaggcgccgtcggagcagctgtgcgagggggtgtcggccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttcagcagccttgggatggccttcaggttcgccgagatcgagtacgtcaccaaggtgaacgatct

SEQ ID NO: 15891 - DNA, 227 bp, Zea mays
  Clone ID: cC-zmpo148042b12a1
ctttttctttttgatgcctactttctgtgagataaaactatatatatgaggggcagtttcaattatttttttgaaaacccccccccactgactttagagggcatgcatctcaatattacatatattcattcattctttcccctttactacacttctttcgtatttgttcttttgagcttgaattggatggtcataccactagaagaaaactaggccttctccctctt

SEQ ID NO: 15892 - DNA, 195 bp, Zea mays
  unsure at all n locations
  Clone ID: cC-zmpo148042b12b1
ccacgcgtgcgtccacgggtccggcatctcccacagggaccctatacctttttgaagctcgctgaatacttcagngggacggggggattgttcatttacaaccagatcaaccacgttccccccgccgtgaacagtcccctccatgtcatccccaatgtcatcaccgtcgagttccgcacctatatctagatcgtt

SEQ ID NO: 15893 - DNA, 367 bp, Zea mays
  Clone ID: cC-zmpo148042c02a1
attcatcgaatcggggagacggagaattatcgtaaatgcttatctgcgtgacgttacattaattgggctgttatatatgtgtatgaagcagtcgacgaaactatacatcgtcggtcatcaaattggtaggtatacccatgcatgcatgcatcaaatcgtcatcgcatcccatgcatgcatgtatatatgatgtatcagtgattcagtgtcacgcaagcaggcagaagacgactaccggggggcgtgctctgcgttcaagaaagaggaggggtgcaggacctgctgcagtttttctctgaacaaaggctgcttctccttggcgcaggtggtgttgcaggccttggtgaccttagtcgtcttgaccacg

SEQ ID NO: 15894 - DNA, 515 bp, Zea mays
  Clone ID: cC-zmpo148042c02b1
gacgcgtgggcatcatcttctccgatccatcaacaatcgccgtgtgcgttctagagataaataaagatgaagaagggggggtgatcgtcagccgttctcttcgtgctagccctgacgctagtttgtgccccgctgatagcagaggcaaagaagaagagagtcgccgccgccgccgccgaggagaagaaggtgcatgacaacttctgctcgacgctgtgcgagggcaggaaggggatggacctggtggtgtgcaaagagtcctgcgacctctcacagcgctccaacctggtgctgtacggccggatccagtgcaagggcaagtgcaccgaacagaatggcatcaccgcgccgcagatgaaggtgtgccaataggcgtgcgacaaggactacgtggtcaaagcggctgaggtcaccaaggcctgcaacaccacctgcgccaaggagaagcagactctgctcagcgagaactgcaggaggtcctgcaccccttcctctttctgaacgcagaacacgcc

SEQ ID NO: 15895 - DNA, 546 bp, Zea mays
  Clone ID: cC-zmpo148042c03a1
acccccctctcaaaaaaggaaaaagggaaattttttatctctttttcccccctcttccccttttttttaaggaaaaaaaaatttaaccactctggtgaaaaaaataaggtaatttagcctccaaaaaacattattgaaaaaaaccaaaaagcacttccaaattccccaaaaaaaaaaaaaaaaaacttttttcttaaaacaattaacaagaggccaacaccacccaaaaaattgggaaaaaaaaaaaaggggaaaaggaaaaaaaaaatccataacaaaacccgggggttttttttccaaaaaaaaaaaagcaccaaaaaccgtttccaccccccaaacccctaaaaattccttggctattaaaaactaatccccgcctttataaaaaggccccccaattaaaaatcccattccccatttttccttggtcaaaatattggaaaaccaacccgaaacccgggattccctctataaacgccccttggacctcaaaaaaaattttttttcaccctcagcaattgggcccaaaaaaaaaaaaattttttt

SEQ ID NO: 15896 - DNA, 541 bp, Zea mays
  Clone ID: cC-zmpo148042c04b1
cgcctccccacaccctggtcttaccgtacctgcctcacacaaatcataaggaattttccttcccttttcctccgacataacacaggggggaggggaaaacacatgcattcacccggccgcaataatggtctaggctccggctccggcgacgactaccccctgcgtgcttctatgcctatgcgtcctcctctcctgtgccgcggatgacaaccccaacctgcccgactacgtcattcagggccgcgtgtactgccacacctgccccacctggttcgtgaccaacgttatctatgtacatctcttactccaaggtgaggctggagtgcaggcacttctgcacctgcacgctcgatcgcgccatcgacggggtgacccacacgaccggcacctacacgatttagctggaggacaatcacgaggaggacatctgccaactgctgctggtggccaaaccgcacaaggactgcgactaggtgcatgcgcttaaggaccgcgccggtgccctgctaaccaggaacgttggcgtctcctacagtctgtt

SEQ ID NO: 15897 - DNA, 355 bp, Zea mays
  Clone ID: cC-zmpo148042c05a1
acataccccattaagtttttaccgtttcaccggaaccccacaactgggcggtatgggggtgtcttctgattacaatttatataatatttaacgaacattctgtaacactcaaatctaccctttcaggatctaataaggaaacacccaagaggaacaaggaaaactgtcaatggtaatccacaccaaggaaagatcattgcacaaaggtcaccaacaatatggcaaacattgccaacccacaagatgccgttcccctgcgctggaccttaacccctaggacgtgttctcagccccccctggcaccatcgccttagcggcgatcacagctataactgtaagcagctgtctggtccac

SEQ ID NO: 15898 - DNA, 522 bp, Zea mays
  Clone ID: cC-zmpo148042c05b1
ggcgtgtttcccggcagcacagatcttgcctaccagcaggcgatttatgttgccgccgacatcatagattgcacggggcgggtgtctaaagacggaacggccttctgcaagcactccgctgacatctccagctccacgaccgcgtccgtcgctttcgcgtccaaagcctccaccgtccacgagatccagaataagtctggcatcttctcgttcgatctgtcgtggagcgagatcgcaaccttgaagcccagcatcatctcccccttcgctcaggcaggcatgttaagaaatcctgcagcgaataatgccggcaagctgatgactttgcccgaattcttagacttggccaaggccagcaacatcaccggtatactgatcgaaatagagcatgcttcctacctcgccaagagagggatcggcgtggtggaagcggtgtccaacgcgctgaccaaggcgggctacgacaaggagaccaagcagcaggtgttcatccagtccgatgactcgtctgtgctcgcggcg

SEQ ID NO: 15899 - DNA, 109 bp, Zea mays
  unsure at all n locations
  Clone ID: cC-zmpo148042c06a1
ttctttctaccgcgtcacgctgacatcacggatcactttttcacccttctagcggaggcgggcaatcaggggatcngggcggcatgttacatcctccacaaactaaaca

SEQ ID NO: 15900 - DNA, 425 bp, Zea mays
  Clone ID: cC-zmpo148042c06b1
ccacgcgtgcgaaaccagtcccaggcatgcccgacctcctgcctatgtattattcacgcacggcccccgtcccaggggggggagtctgtccaccacctcggagctggccaccctgaaacgcccgtacggcaacaacgggttctgcgatggcagcaacaacagcagcgcgacctgttacaaacccaaggcgcagaggagggaggcggaccctgctgctgcgaaggccgcggtgcggcacaagtactgccagcacggcggtgtgaacatgtacatcgaggcgtccgcgacatacacagcgatggaaccggacacgatgcggaagctgatcgctggcgaactgtgccccgaccgcggagacatgtacatctacatccggcacttcaacccgacggagctggcgctggggcggcaaatagtggcgctgg

SEQ ID NO: 15901 - DNA, 407 bp, Zea mays
  Clone ID: cC-zmpo148042c07a1
gcaaattctatttcatcgtttggggttgggtttagatttacaaggacaataatctccatgactgcacgacaacatagatctaaaatgccaatgcatcgttgaacccggcatcataagcggcgtcggtctcatagtcaccgatcgcctctacgagcatcatccccccgaccgcaccgtctatgagccctaggccgagccccatccccatacctccgccatgcctcgccggtgcaactaccggctgtgctgcgtacttgtacatcgccggttgtggggaagcagcattgttcccgtacggtggcggagcagggtacccgtaaagcttccgagggtacgcccttttcggtgaacaatattgttgcggtggttatgcagacgccatggcctgctgcgatgggttcacggtg

SEQ ID NO: 15902 - DNA, 447 bp, Zea mays
  Clone ID: cC-zmpo148042c07b1
cgcatccccaagactatggtgccgcccaccgtgtacccaccgccgcaggccatttcgttttcatacccgccgcaacaatattgggggcggggcgcggcgtacccgcggcagccttacgggtaccctgctccgccaccgtacgggtacaatgctgcttccccacaaccggcgatgtacaactacgcagcacagccggtagctgcaccggcgaggcatggcggaggtatggggatggggctcggcctagggctcctaggcggtgcggtcggggggatgatgctcggagaggcgatcggtgactatgagaccgacgccgcttatgatgccgggttcaacgatgcattggcattttagatctatgttgtcgtgcagtcatggagattattgtccttgtaaatctctaattaatacgaaacgatgaaatagaatttgcattttgtatctctt

SEQ ID NO: 15903 - DNA, 312 bp, Zea mays
  Clone ID: cC-zmpo148042c08a1
ccaagacgcgtaataatatatggcggacgggttcttttatgccccccatccaaatccgacgcatataagaagaagaatatgtgcccgaccggacccctttctactaacacggctggccgacgatacactttagtggtccatctatactcatgagctgaccaacttatcgcccgcactttaccgagactaaaattaacctgtcgtacttaccctcgttctggcctccacactctcttaataatgcacccttcatcatgaccccgccctgctactttcacacccactccttgtttcccttgaacggcgtttact

SEQ ID NO: 15904 - DNA, 530 bp, Zea mays
  Clone ID: cC-zmpo148042c08b1
cccgtgggcgtcacgaaccgatacaacgcggacgtgctgagggttactattcggcgggcgctggcgaggtacgagggggggggcatggtgaccaaccccatcgaccggtgctggcgctgccgcgccgacatgggcgacggaccggaagcggatggcgcaatgcgcgcgcgggttccgccacaggaccgtcggcggcgcggccggcaagctgtacgtggtgagggaccctagcgaccaccagatgatcatcccgcggaagggcacgctgcggcacgccgtgatccaggaccggccgctgtggatcgtgttcgcgcgccacatggtgatcgagctgtggcaggagctgatcgtgaaccacaacatgaccatcgacgggcggggcgcgcaggtgcacatcatgttcgcgcagatcacgctgtataacgtgcataacgtgatcctgcacaacctgcacatccacgactccaaggcgcactctggcggaatgatccgcgactcgaagcggcactacgggctgcgcacgcggagcg

SEQ ID NO: 15905 - DNA, 422 bp, Zea mays
  Clone ID: cC-zmpo148042c09a1
gtatcctctataccggacgcccttcattctttttcattaaaattctcttttctcgaataccgacatctattttagcaagggggaagtactacctctatatgctactatcgccctacaaacccataactcctcccattttaccaccctactccaattacactcatgcattaccacctataaatctgacaaaaaaaaagataacccactcccctaaccatcgaaagaaaaactgactataacactactcacacacacagaaagaccgtttctctttcactgctgatcccctgatggaaacaccctttccacaattatacttatggacatatctttaatctgatacaagaggttttccttaaaccttaatccccaacataccaaccggaaccatcacctcctactgatgagcggcctaatcaacc

SEQ ID NO: 15906 - DNA, 623 bp, Zea mays
  unsure at all n locations
  Clone ID: cC-zmpo148042c09b1
gccccgccgtcgacaagcccttctgcgagacctacgccattatggtttataggccttcagcggaaccatcgcggggggggggacgcccaagagcaagctggggatcacggacgccgtgctcaagctgaggctcgccaccgacgccaacatcaacaaggcctacgcggagggggacaaggacaagatcgcaaaaatccttgctgcatacggccaggcggccgacgcggtcgctgcggccccgcctcccgagaagctcaaagtcatggagaagaccttctcggcggtcgccgccgccgctcatcaggaggcggcggcggctgctgctgctgctgcagtgattaaggtttaagggagagctcctgcatgaaattaaccacacgttcacacgtatacactacggaacaagtgtttccatcagacgaccatcagtgaaaaaaaaaccatccttctctgtgtgtgtgccgtgtttttgtcatttcttctttccattgctagagaaacgggttatctttntttttcccacatttataagcggcaatacatgcgtgcacctgtagtagtgtgaccatatgtactgtgctctcggtttgtatatcgatagtagcatataaagctactactcc

SEQ ID NO: 15907 - DNA, 415 bp, Zea mays
  Clone ID: cC-zmpo148042c10a1
gtcatcgctgtccttcttggtgttgatttcagtctcgaaggcgccgactagcgcgttgagcttgctccgactcttctccagcagcttcgtgcgcgcctcctcgatcacgtcgttgctccgcgccacctctcggcgacgcggctgctccgactccgctcgcgcctccaacgccgtcctcacacggctgccctggaacctccgcattgcctcctccttctcgtcctcctccgccttctgcttcttgatcgcctccttcacaaccgtcacgaacttgtccgccaccacgtcttccactgctgctactgcaacgatggcctccggcgccggcgccggcgacagagccgcttctttcttgggcgattccacctcctcctcgttcttcgaggttaaggcggcggcgatgacgataggctcc

SEQ ID NO: 15908 - DNA, 565 bp, Zea mays
  Clone ID: cC-zmpo148042c10b1
tggcctgggctggccgcctccgaccaccgtacgtcctccaccgtttctttcttcggccggcctctgcccagcccggggggcgggcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgtcgatcacgcccaccaagaagcaggacgacaagccgaagccgacgccggaggccgccaccgcggcgaactacgcgtcgttgtggtcgcccaagcgccttatgcagcgcgctgcccgcgctttccgccgagcaggtcgcgcgcccgcgtcaggacggtcaaggacctcgtcgaggaac

SEQ ID NO: 15909 - DNA, 541 bp, Zea mays
  Clone ID: cC-zmpo148042c11a1
aactctacgaagatgtgaatataagaaagtgtgtaaaagttttcaacaacgtacctaatcaaatgacaatggcacgtacatataatcgtaccccacattgatatatactataaacaaacaaatactatttggatcgatatatatatggcgctccttggattattcaacaaattaataatcaattaataaatcttggcgcgggctgaagacgcctgcaccttctcattacctgctccacccgtttccctctttactatcgcctggtcaactctcattatcgccttttatttcttttctttgagaacagccttttttttacaggcttatattgtgcctgcttccatcataatccttataaccacctatttcttcttcccccttttcaataacaacttcacttctttgttctttccttcgttgaagccacccttcgtttctttcaattttccatacccttcttaatctttccggtgcactctttcaagcactgcacatttttttttccttatcacttcttttttccccccattttttccccttt

SEQ ID NO: 15910 - DNA, 604 bp, Zea mays
  Clone ID: cC-zmpo148042c11b1
ggacgcgtgggcggacgcatggggctcgctctccaggcggacagttatttttatacccctcgggacctggcggagggggggggccgtgctttgactaccgtggtcggcgcggcgggcgactacgcgcggtacgagatggacgtggtgaaggacaacgacatgtggcagtgcctgaacgagtgcgccggggagatcgaggaggcgctggaccacctggacgacaccgagggcggtctcgacgacggcaagcttcacgacgtgaagctgttcctggacacggcggaggaggacacgtggtcctgcgacgtctgctgcaagcacgccctatccacgcccgttaaaaccactctgctcgccaagaacaaggacttcgaggtgctcatgcgcgtcgtccacgcgctcatcaagcgggccaccggtggcgccggtgacgcgccggtgccggcgcccgtcgcccgcgccaagattcattaattgattattaattcgttgattaatccgcggagcgccatacatatctcgatccatattgtatttgtttggttatagtatatatcgatgtggggtacgtttatatgtacctgccattgtcatttgattaggt

SEQ ID NO: 15911 - DNA, 259 bp, Zea mays
  unsure at all n locations
  Clone ID: cC-zmpo148042c12a1
catatatnccataataaaacgggggcctggttttatttttatttcatctatacgacatacatatacatttcaatattcgtgttgttgtttttcacactccttatatccttttattaaataaaaaataaaaaataaaggtctatcaattgtgccactttatacctattattatttggttaccttatttggcggtgtaagctatctttgacttccacccggcagggatgacatcctcctatacgctcttattgcctccctc

SEQ ID NO: 15912 - DNA, 499 bp, Zea mays
  Clone ID: cC-zmpo148042c12b1
ccgacgacaatggagggggctgcggctacacggacgtgaataacttttctatataatagcatgggcgcgtgaggcaggggtcgcgggtctttaatgacggtctaggttgtggatcctgcttacagatcaagtgtgacaagccagcggaatgctctggcaagcccgcggtggtgtacattacggacatgaactacgaacccattgcggtataccacttctacctagcgggcacggcgttcggtgccatggctaagaagggtgaggaggacaagttgcgcaaggcgtggcatcattgacatgcaatttcgaagggtcaagtgcaagtatggatctaacgtcaccttccacttggagaaggggggcaaccccaactacctggccctgttggtcaagtacgtcgacggcaatggcgaccattgtggcggtggacattaaggagaagggcttctacacgtacgaaaccttaaagcacttctggggcgccatctggaggaaggac

SEQ ID NO: 15913 - DNA, 384 bp, Zea mays
  unsure at all n locations
  Clone ID: cC-zmpo148042d02a1
cttaancaaatgaaaaaggggggcaggggttccctgcatgcgatggcacctcacgctggggttgcatgcgtggttcatatcatgtttgcaagagccatgcagttgttggccatctggttgagctccttgtcaaacttccccatggggttggggacgccggcctgggtgaaggggcggtcgcacgagtcgaagtcctggacggcgagctgcagcatgatcttggcggtgccggtgtccttgaacgtgatggcccgctgcgccgcgcctatggtgtcctgcgtgttcatgtacatggtgtcacaaaacgtgagcgcctgcgtctgctgcggcgggatggtgcgggccgaccttgcgacgtgcttgcgcgcctgcgcggtgcgcttg

SEQ ID NO: 15914 - DNA, 635 bp, Zea mays
  Clone ID: cC-zmpo148042d02b1
caacatcatggggcaagcctcacggctcgtcctcctcgccgtcgtttcgcttctgtccgccggcctcctcccgcaggggctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgtgcaggcgcgcaagcacgtcgtgaggtcggcccgcaccatcccgccgcatcagacgcaggcgctcacgttctgcgacaccatgtacatgaacacgcaggacaccatcggcgcggcgcaacgggccatcacgttcaaagacaccggcaccgccaagatcatgctgcagctcgccgtccaagacttcgactcgtgcgaccgccccttcacccatgccggcgttcccaaccccatggtgaagtttgacaaggagctcaaccagatggccaacaactgcatggctcttgcatacatgatatgaaccacgcattgcaccccagcgtgaggtgccatcgcatgcaaggaaatagctgcatcattttcacttattt

SEQ ID NO: 15915 - DNA, 426 bp, Zea mays
  Clone ID: cC-zmpo148042d03a1
cagttccaaacacacccttcattagggggtttaggggagctaaacattcatacaacagttgaggtcacagatcgagcgtttagtcagtatgtacacggtctggtagttaacgtggaaatggagacaatatgcatggtgacttgacgagacaagggtgaaactccggaatcccaacgaccgtggttcttcatccgtcgaccatcggcgcggccttggggagcggctgccccttgatgaaggacgagaagagagcgaagccgcggcccggctggtcgatcggtaccatgtgcccggacccgcgcaccgttgcgaacaccacgcccttgtactcgatcacgtacccggcgacctcctggtccttggcgtcgatggaccaggggcgccagtccttcacgacgccgaggccgagcttcttcatggaccgtt

SEQ ID NO: 15916 - DNA, 538 bp, Zea mays
  Clone ID: cC-zmpo148042d03b1
atcctcgccgtcaataacgctcggcccaaggacatggctcttgtttacctcaagggaatcgcgatcgggagcgccaggctggagttcgcggcggagcagagcgcgctgtacgagtacctgtggcagcacgcgttcctgtcggacacggcgcacacgctcatcggccagcgctgcaagaacgccgaggacaactcgccgctctgctcggggaccaaggacgccgcctacaaccagatcggcaacatcgacgcgtacaacatctacgcgacgacctgccatgacaagaaagtcaagcccagaggatccaactgcatggatttggctgatccttgcgctcaatactacgtggaggcgtacctgaatcagccagaggtgatgaagaccatccgtgccaacacagggctcaagtacaaatggactagatgcaggggcaccttctacaacctgctcaagttcggtgactcgccgtcgaaatcgatgcttgcctacgtcaaggccgtcgccgccgccggcgtccgcgtgtgggtcttcagtggcg

SEQ ID NO: 15917 - DNA, 392 bp, Zea mays
  Clone ID: cC-zmpo148042d04a1
ctgccagcatgcctttttattggtacccggtcaatctatgaaaaacacacatttgcgtgacattacatttggagttccatcgacggtatatttggaaaaaaaacaattagcttataaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatggttcattcatttcaaggggcttcgctttaagaaggaggaggggtgcaagacctcttgcagttctcgctgaggcgcgggttcttctccttggcgcaagtgacgctgcaagccttggtgacc

SEQ ID NO: 15918 - DNA, 429 bp, Zea mays
  Clone ID: cC-zmpo148042d04b1
cacaaggcgtacgtggtgaaggcggccgaggtcaccaaggcctgttttgtttcctgcgccaaggagaagaacccgcgggtgagggagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgttttttttccaaatataccgtcgatggaactccaaatgtaatgtcacgcaaatgtgtgtttttcatcgattgaatgggtaataataaaaaggcatgctggcagttactact

SEQ ID NO: 15919 - DNA, 183 bp, Zea mays
  Clone ID: cC-zmpo148042d05b1
taacatctaaggttcataataacaaattatattccatcattggtttatgcctttctcttacattccatgtatcatctattatgcaaaactagtcacaaatattacatccagaatctatgataatcatcacctttgtatactgctaatatatttctatgattaatcctctaaaaaaaaaattat

SEQ ID NO: 15920 - DNA, 367 bp, Zea mays
  Clone ID: cC-zmpo148042d06a1
attcaggtccattcgggggaatcgggagagatcaagccgcttgcactggcatatccatccatctgaaccagagggatcagatggtgtttaatattcttgcttgaatggcactagtagtatatacacgaacacgacacacacaagtccacacaggccatgcacgctcggaagcgcaagcgcgtcagtgcttgcggtggtggttgatggcggcttcggggccgtcgcggacggcggcggcggccttgagatggtgcgtgggcgtctgcgtctgcatgagcgcgagcgcgcgcttgaactgcgcccagcgctgcttcagcgtgccgttgtagccgacggacatgcggacgaggcccggtgagatgcccgc

SEQ ID NO: 15921 - DNA, 579 bp, Zea mays
  Clone ID: cC-zmpo148042d06b1
ccacgcgtccgaaaccattcccaggcaggcccgacctcctgcccttgtactttcgcacgcacggtccccgtcccaaggggcggggctctgtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggagacatgtacatctacagccggcacttcaacccgacggtgctggcgctggggcggcagatggcggcgctggagggcacggaggcgggctactgcacggcgtccgggatgtccgccatctcgtccgtgctgatgcagctggtgggcgccggcggccacgtggtggcgtcgcggtgcctgtacggcgggacacacgcgctgctggcccggtttctgccgcgcgcc

SEQ ID NO: 15922 - DNA, 407 bp, Zea mays
  Clone ID: cC-zmpo148042d08a1
cacttctccattaaattaaagggagggagggtatataatgaagtcgacgaaacaatttggcaggatcgagtcggataatatatattcggaggcatgcaatatcatgcatgtgggtaggcttggccacactttgcgtatctatatataattatggcaagaacagtattatcctgacacacgatcgagcccttaattagttctcggttttgaccaccttgcttggctggacccacgcttctcagttcaaccggactacggcccctgcgcctgcgcctgcgccggcgcatttgattccgtatgagccagcttcatgttcgcgtatactacgcggccttttgactcggggctgctgccgtcgctggagccgtctacgctgccgatgacctggatgtctttctggtgggcgg

SEQ ID NO: 15923 - DNA, 504 bp, Zea mays
  Clone ID: cC-zmpo148042d08b1
accggtgccttttgagacgcatgtctccggcaacatattttgtgcctgctgacgtggcccggggggggtgatctctgcacctgcaccaccgctcccccaccaaagacatcactctcggcagcgtcacggctccagcgacggcagcagccccgagtccaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactggtcttgccataattatatatagatacgcaaagtgtggccaagcctacccacatgcatgctattgcatgcctccgaatattatattatccgactcgatcctgccaaattgttttcgcgacttcattatatatattccatccctttaatttaatggagaagtgtgactgctgtt

SEQ ID NO: 15924 - DNA, 439 bp, Zea mays
  Clone ID: cC-zmpo148042d11a1
aaataattcatttagtttatgtagacaggttacccaacacaacaaggcatcagaagggacatgtagcatcacatatttcttgggtggtttggtgccacaaaataaccatagaaaaaatattgtcttgctaacatgagcaccaggtgagctcttttgaaatataattcatcatcagaggctgattacatgctgagtgtggtcttataggtggtgccggccttgaaatcagcggggatgacgtcttcagcgattcggtatccaccgtacttgacagcaaatcgtatgcaaagggggtacttgagcggggcctttttgtctagcgtccatttgcccgtctggccctccttgaacgtaaaggagaaatcatcgcccccgtgctctttgatcttcacgtttgatatggttgcaacattgggggtgaggatcaggtggccaggct

SEQ ID NO: 15925 - DNA, 595 bp, Zea mays
  Clone ID: cC-zmpo148042d11b1
cacgcgtgcgcacaagaacaaatacctcgctaccaacaatggccttttggttctccatcctacttgcaacgtcgagggggggggtgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcatccccgctgatttcaaggccggcaccacctataagaccacactcagcatctaatcagcctctgatgatgaattatatttcaaaagagcttacctggtgctcatgttagcaagacaatattttttctatggttattttgtggcaccaaaccacccaagaaatatgtgatgctacatgtcctttctgatgccctgttgtgttgggttgattttattacataaactaaataaattattatttaggatttt

SEQ ID NO: 15926 - DNA, 376 bp, Zea mays
  Clone ID: cC-zmpo148042d12a1
gataataactttacgtatgtgcataattgcagaggggattagatatacatttgcatgaaccgatcaacatatatttatatatatagtagtgagatctcccgctccatcaccgtgttcctctttcacggtgaacgagatgcgtgtgcgaagattagatatacatatacatatatacgtgcatcgttgtcagccttttgcagtggtgggaaggaaacatccaaacatcttggacacgaaaggggtcttctgatgggcgcgcctcatcgcggcgccctccggcggcgactgcacgcgcggcacattcgtcaccccggacctggccaccttccggttccgcttcacgttctctaactgcaccgtgaacccctgcgcggcc

SEQ ID NO: 15927 - DNA, 547 bp, Zea mays
  Clone ID: cC-zmpo148042d12b1
tctgtgcaggggaagggggagaaacataccaccagatcgatcgttatcttgccgtcgtccggcagggttaatatgggttggggttcttcggccgggtgtgcatggcaaaacgacccacggtgcccaagttcggcacctgggacagcggcgatgccgggtacacggcctacttcgacaaggtgcgcgagaacaagggcgccacggcgccgccgctgcgccggccgcgcagccccaacgaccccgaccccgaccgcgagcccgagccagaggaggggccaatgaggagagtccccccgtcgtcgtcgtcgaggccggtgaccgcaggaggccaccgcgagccgccgccgtcgggcggcgccacgggcagagccaccggcgaacggagagcagcggcaagcgcgccgtccgaccgccaaagcaagttcgcgcccgccgcgcagtactaccagcaacagcaacgcgcgaaccccgaatcagtaagccccgtcatcaccacggcggcggcggggggcaccagcagcagcaccccccgttcgcgcacgggcac

SEQ ID NO: 15928 - DNA, 244 bp, Zea mays
  Clone ID: cC-zmpo148042e02b1
cactatgccccacaacccttttacctttaaaattcttaccgccattcttttgttcttaatgccgctttctaagcctaaaccgatggatttatttctagaccggatcataacgaacaatctgattctctgagttataaacgaaaaattttacacgaacacacaacgtttaagctatctaactttaggaaaaaaaattgtaatacctaacaatactacattttaaaaaaaaatattaaaatttatc

SEQ ID NO: 15929 - DNA, 541 bp, Zea mays
  Clone ID: cC-zmpo148042e03b1
aggaccacgcgtccgtgctaccatgagtactgggcggagcgcgcggaggcggctttttcttacaaccgcgcggcgtaccataccggggcgggggccgtcgtgcagcgcttcaacgacggcgtgcacagggcgacggcgacgcggtcgcggtccctggcgcacagggcgcggggcccctgcacggcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgccgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgcggagcgcatgtgcacatcgtgggcgcgcagatcacgctgcagaacgtgcgcaacgtgatcc

SEQ ID NO: 15930 - DNA, 215 bp, Zea mays
  Clone ID: cC-zmpo148042e04a1
caaaaacagcccagccgaacccgtgcgaccaactcataggcagcaacatacgctacgaaggaataccccgacgcgggcaccttttcgtacgcaagcgtaagcctcgcgcgtccatctgaggctagccgcacaatctatatgctgcgtcctggtaaatgatcctacatcccaacaacaccgagcaaggaaccggggcaagggactactacattatg

SEQ ID NO: 15931 - DNA, 362 bp, Zea mays
  Clone ID: cC-zmpo148042e05a1
cttcaagccaaaccggcccggaacaggggcgactttcccacttttaatcacgaataatcaaaacaaaaaacgagtaaggcttgcattgctcatttattcattgtaatagcctttggaaaacctccgctcaactacgttgttttgcgtcggacgatacaaacccaaagaaaggttgtggctacttggtccttgcgaggagaatccttgcctaatactaggaacgtgcaaaaatccattccccatccctgctgggtacctagggacttgggaccagccccgaaccggtgtatatgaagcttccgtgacctcctactagagctgtggatgaaactgacgctgggtacttacgttcctttgtgcca

SEQ ID NO: 15932 - DNA, 384 bp, Zea mays
  Clone ID: cC-zmpo148042e05b1
ctacggtgcaccctctggcgcagggcgctctgcggcgacatctttttttacttaggggacacgccattctgcatcggggattgggttatggatcacatcgacatggaccgcataaggcaccggacgaagaagcagcaggccctcatagcgcatcagcagcagcagcagcaggcggcgccagcggaggcgatggcgcagagtgaccgacgcacccaacggctgcttcagccacagcactagactgagctcacggaagcttcatatacacctgttccaggctcagtccaagtcccaacgtacccagcagggatggcggatggattcttgcacgttcctactactaagcaaggattcctcctcgcaaggaccaagacgccaccacct

SEQ ID NO: 15933 - DNA, 388 bp, Zea mays
  Clone ID: cC-zmpo148042e06a1
ccacccctttttcacgtttaaccccaccacccaccccgcggggccggggggggacaaacatatatcctcttatattctaacgcttttttttctgtgtgtgtatgtgtgaacaacaaatgagtacatgtgcaattacatcacaagtgaaaattgatacagggtgttcctgtatcgcttaatatggatcgactcccatttacaaatgaaaaccgcatacttgcatcaaaacagcggcacgcgctggggcatcgtctgatatatgtttccaaggagatagatatatagatacattcctgccggtgggcggcagcaggccaatgtataacaaaactggaggcccagcggtccttttacgcacaattgcgagaagaggcccggccccagcctg

SEQ ID NO: 15934 - DNA, 614 bp, Zea mays
  Clone ID: cC-zmpo148042e06b1
tccggttccgccgtcctcttttactgcatctgcatcgccgtcgtttttcttttgtcgtcgtccatggtcgccgtgggggcgggcgccccgggggaaacccccaagttcatctcggcgagcgcccttgagtgctccgctaacgtaacggaaatagcaaaggcgcgcaagctgatcgatgtccatggccacgggctgtgcccggtgcggttcgaccacacgcgcgggatcagcgcggtggccagcagctgcaaggaccgcccgctgccgtcgccggagcgctgctgcggggcgctcaatgcctacgcgtgcccctacagcgagctcatcaacgacaacgccaacaactgctgcgccagcgagatgttctacgtcatcatgacacgcggcaggctgcggacgggcctcttctctcagctgtgcgtcgaaggcccgctgggcctccagtgctgatcaacactggcctgctggcgcccaccgcccggaatctatctatctatctatctccttggaaacatatatcagacgatgccccaacgcgtgccgctgatttgatgcaagtatgcggttttcatttgtatatccgagtctatccatactaagcgatacaggaacac

SEQ ID NO: 15935 - DNA, 437 bp, Zea mays
  Clone ID: cC-zmpo148042e07a1
gttacgtgattattatgagtatcattataatgcgggggcgttcactttcttacgtacagaaacaatagcgagtgatagatttggatggatccccgcacgcgcccgcagacgtcacctaatataatgaacaatgcgggggcggccggaatcaatgaatcatcagtaacggagtagaaatcatatcatgtcagggaagaaacgaaacagcgggacacacacgcacgcatggggatagatcactgcgtggcgacgagctgcacgcctctgacagcgagcgctgcgagcggtccgatggcgagggagttgatgtaggtgcagggctcggtgtatgaagagttgccgcgcttgtccacaaaaccgttcttcttgtctggcccgccgacgatggcgccggtgagctcgtttgggttgggcttgtcgggcgccatccattcccc

SEQ ID NO: 15936 - DNA, 558 bp, Zea mays
  Clone ID: cC-zmpo148042e07b1
ccgccgccatgcgcgcaccgaggcacggcagcatgcgcgcccatttcgtcttggccttcgcggcgctggtgctgggggggggctccctgcaaccggcgctggccggcggctgcggcttcgactacaaggatgccctcagcaagaccatcatattcctggaggcgcagcgctccgggaagctgccgcgcagcaaccgcgtaaagtggcgcggcgactccgggctcgacgacggcaagctcgccaatgtggatctcaccggcggatactacgacgccggcgacaacgtcaagtacgggctcccgctggcgttcacggtgacgacgctggcgtggacggcgctggcattcaagcccgagctggagtcgaccaaggagctgaagcacgtgcaccaggccatcaagtggggcaccgactacctgctgaaatgcgccgccaggaagaacaagctgtgggtgcaggtcggcgatcccaacctggaccaccagtgctgggtgcgtccggagaacatgaaggcgccgcgcacgctgtacgaaatcgactccaagacgcccgggacgg

SEQ ID NO: 15937 - DNA, 439 bp, Zea mays
  Clone ID: cC-zmpo148042e08a1
cagatgcatgtcagggcctcgtgggtggggtgcactacggatccactactcatacataatacagcgtgcagtcggcagcaagaagaatcttccctttcgcgctgcgttactttaaaaaaactcgtattcttttgtaatcagtcgtgcctccagatgcacgtcacaaggcataaattcaagcaaaagaagaaaaagaggaagattcgttggtaccgccggcggtttgaacaccctgctgacctggctctctttctccagccgcctctccttcctctcttctgaccggaggtgctggtcgtcttcaaccttcgatgcacatatgtggtgcagtgcagtgcagtgcaatgcatgctcttttgtacctcacctgcgcagtctacccttaaggcaacacgcactcaatctcctgcggtgctgcctccccatgtccaactctaac

SEQ ID NO: 15938 - DNA, 551 bp, Zea mays
  Clone ID: cC-zmpo148042e08b1
ccgcccacgcgtccgggatgacatcggctctctggcggttgtttttcttattctctccagggaacccggaaacaggggcgggcggtttctacagtcacttctccttctaaggctaaactgtcagaaagctgccatgcgcagtttgcgatatgctcggaacagcacgctccatgagcatgagaggctcgtataccaagggtggattctgtatgacagtgggcatcgcgacgaagcgttagccaaggccgagcagtcgatcggactccagagatcattcgaagccttcttcctcaaggcgtacgccttaggagattctagccttgacacggaatcctcgctctccgtggtccagcttctggaacatgccaacagctgtgcttccgacaaccttcgcaaggggcaggcatacaacaacatggggagcatctacgtggactgtgacatgctggacgaggctgccgagtgctacggcatcgcgctgaacataaagcacacacgggcgcatcaaggcctagctcgagtccactacttgaaaaacaggaaaaaggttg

SEQ ID NO: 15939 - DNA, 426 bp, Zea mays
  unsure at all n locations
  Clone ID: cC-zmpo148042e09a1
attacaataatagcagntctgctacagggttgcggtttttccgcgaggctaacacaactccatgccaaaatcgccattgtcatgagcctcatcagacgtaacgaaggcatctggtacacttacagccagctggacgacaaaccgagttcacggagagatagatgaaaggagggaataacgaagtcgttgagaaaaagaaaagaaaaatggcaaacgcagacttgagtgtgagaatgcgtgagcgtgtgtgtgtgtgtgtgatatatattggtggcggtcccttcctcctatttgttctctccttccccgtcttgcggtggctcccgttccagcggttgctcgtccgctgccatgtccggcaacgtatcctgggacgggctcttcttcatcatgtggctgtagctccccttctccatgaacagctgc

SEQ ID NO: 15940 - DNA, 562 bp, Zea mays
  Clone ID: cC-zmpo148042e09b1
ccggcgagagtgcgtgcgtgcagccacaggcaggcgtcggcactttgttttctttcaccggcacgcaggacaagggggcggggtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacggtggctgcattctcaccaccttctcctacgccgggctcaacggtgttctgtactgcaagatccacttcgcgcaactgttcatggagaaagggagctacagccacatgat

SEQ ID NO: 15941 - DNA, 434 bp, Zea mays
  Clone ID: cC-zmpo148042e10a1
tttcctctcggtgcctgtctcgtcctaggtcggggacctgatctcgggggagttgtttgtttttacttagcatcatcatcccttttcatctcatcatcaagtgttctggcgccgtggtccagtgctgcgtggactatgaggaagagctcgtgctgagcggcggcggttgcatctgctccggcgacgcgctgctgcggacgcttgctcatctcatgccgaccaaccggtacatcatctacgcggcgctgctcgcggaccatgtgccgtgcaacatgcgcggcctgtcctactacaccaactgctcgtctcatactgcctccaacccctaccgtcgtggctgctcctccatcacgcgctgctcccgcatcatgaactgagcgccaaagcggtggccggcggtctgatctgcctgctggctggctgggcagggggca

SEQ ID NO: 15942 - DNA, 358 bp, Zea mays
  Clone ID: cC-zmpo148042e11a1
attatagaagcacaaattagcatgttatgggatggtatatatatgctgccctacacgcgtgcctctcaagtctcaacgagccgtttcatcccacggtctcaagacatgtgccacgccgcaagaggcaacaccgaaaagaaggacacgcgctaggtccgcatgaagtcagcatgcgtccagtctatcgactgacagacacacgccaccagcatcaaattacatatgttttaggccggactactactactacgactactttaccgaacgtattatggggtcgggaaaaagaaacaaacaaatcaatggacatgttcgttaagcatcatttttgagagcgtgcggcatatctcaagacatc

SEQ ID NO: 15943 - DNA, 218 bp, Zea mays
  Clone ID: cC-zmpo148042e11b1
ggcgatggctggagcctgggcactgctcatcgtcctcgctgtagttctctcggtcctggccgcgcggccgggggctgggggcggttgagccgcggcggtggcggatatctgcatgaagactccgtcccccgacctgtgcaccatgacggcggggaagcacgccaacaagtacaaggtggtggacgcggtgacggtgctagagatgcaggtggaccctt

SEQ ID NO: 15944 - DNA, 461 bp, Zea mays
  Clone ID: cC-zmpo148042f01b1
tcctcctctgcctcaccctcccatctcactaaattttctttcttcagcaaagccacacccaccaaagagaagaacattttgaatccttttaaaactaaccattcctaacctttaaatttttacaaaaccttcaccacacatactgctagtttctaataagatactttttcacctcgatcacacattttcaaataagcttcttacaacaatttaattgcctctactcctaatagatcaccaaaaccattctttaattaaccttggtcttacaaaattatatagaaccaatgcaaccttctttaaccaactttatttaaagatgctattgataatttttctgcaataatatcttgtgtcttaatctttacatcaaattcattcatttttaaaattaatgagacttgaaacatcaataccatcaagacttcatcttacaaaagtgcaaagaaatttttatattt

SEQ ID NO: 15945 - DNA, 630 bp, Zea mays
  Clone ID: cC-zmpo148042f02b1
ggaccacgcgtccggcagaagtggcacgtctactacgccgctgagcaccctgatttgccttttgttactctagagatgtgcatgagggggggggacaagaagaaagcttctgtcttcttcaagaccactgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggctttaacccgggctctttctcttatggtgacctggttaagagggtgctgaggtgctttggtccaactgagttctctgttgccgtgaccatcttcggtgatcgggacaatgcgaagacctgtgggacgaaactggatgctgaggcctatgcttgcagcaacatggttgagcatgtgctgccgtttggtggcttgctcatctatcagagcttcactgttaccgccgaaacgacccatgggtcgccgaggtcagtcctgcatgacttcgctggtgacattgtcaagattcgctcagagagtgatgct

SEQ ID NO: 15946 - DNA, 446 bp, Zea mays
  Clone ID: cC-zmpo148042f03a1
ataccccggacaaactccggggatgggcggagccttaaacgtgacaaaacatctttgtcctcccctccctgctttccctcccggcttggtcacaatacaatctcatctacgccggagctgcactgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggcttccgttccgtcccgtcccgtcccggccggtcagctcctcaacgcgacggcggccttttgcaccaacgacccggtggcctgcgcgacgccgtgcgcctcccgctccgcggcctcccggcacgacccggcgccgttcatgcggtgcacgaaagcggtgaagcgccgtcagttgttccggtg

SEQ ID NO: 15947 - DNA, 492 bp, Zea mays
  Clone ID: cC-zmpo148042f03b1
gattttactaatcaaattcttgttgggatatattcctccaatttcttttttcctcccaacaaggcaacaacaatgtgggggggccgtcaaacaaaacccaaaaaaaaaacacactgaacccaataatccgatcccacagaaacttttctctcggtccgttcgatcgatcgctgccgtgtcgtttgccagacaccatcagcacccaaaaccatggcctgcaacctgtctcagtgcgccaccgccgtcgcagcgaccgtctcgccccgcacccctcgccctgctgcgtccgcgtacgtctccttctccgcgaggaagccggcgggcagcagcctgccgctgcagcggcaggcgtgctgcgagccgtcagtggcgccatcgcggtcggtgttcacctgccgggccgcagcgtcagggagcgctgccgacctggcctccgatggcatgaggtcgtccggcgtgccggtgttcgtcatgatgccgctggacaccgtc

SEQ ID NO: 15948 - DNA, 443 bp, Zea mays
  Clone ID: cC-zmpo148042f04a1
ataaataagcattatatttatggttaaagggatcgcaaacagaggtggttcatgttatacaaactgtatacgtagatacacgcgtgtgggattaaatcaatgattaaatcaatccctacttcctctgtggaaaaaaaatttgaccaaactgtactgtgatgtgtaacaatgccacaacacagtacttgaaggcaaacgtatgtagattaattagcagaacgacaacctgtgatccatccttgctttcttccatgaaatgaaacgcaaccagcgcgacctggcatggccaggccatgagctagaaaaagcatcctgatgcccaccggccttcagcacggcttgcccgtgcagcaggacagtgtgccggagaagcgggtgagccttgtaacgtaagttcctggcttgggctttacccactcgttggtgtccacctgcttgggggc

SEQ ID NO: 15949 - DNA, 572 bp, Zea mays
  Clone ID: cC-zmpo148042f04b1
ctccggcgccgaggcttcgggcacgcgaccaccggcggccttgtttgctttatctacgtggtgaccgaccccaccgggctgggggtggtgaacccgcgccccggcacgctgcgctggggcgtcatccagcccggcccgctgtggatcatcttcgcgcggtccatgatcatccagctctcgcaggagctgctcatgagcagcgacaagaccatcgacgggcgcggcgcgcaggtgcacatcgccaacggcgccgggatcacggtgcagctggcgcaaaacgtcatcatccacaacctgcacgtgcacgacgtcaagcacaccatgggcggcctcatgcgcgactcccccacgcacatcggctcccgcaccagggccgacggcgacggcatctccctcttctccgccaccaacgtctggatcgaccacatctccatgtccaactgcgaggacggcctcatcgacgtcgtgcagagctccacggggatcaccatctccaactgccacttcaccaaccacaacgacgtcatgctcttcggcgccagcgactcctgggccgaggaccagatcatgca

SEQ ID NO: 15950 - DNA, 417 bp, Zea mays
  Clone ID: cC-zmpo148042f05a1
ctcctttttttttttttttccccttctcccttagggggaaaggggggagggtatattaacatggatttcctatatactctggcgaatgttacaaacggggtgttacatcacagtcacaccttgcggttttcttcccatttgacgacgctcccgcacgggcgtacgcacgcgggaccgtcacctatggctatatttacaaagggcattttgcctgctgcagccggccaccaggaggaagaggacgacgggcatgctcggtcactttatggctccggcggctcgcacagggcaagaggatcgaaagacacgaccctgtccacccatgatatataccaagggtcgtcgtgcgtgtgctgcccaattactatttagaggaaggggtcgccaaaagtttatgatgggctcgcccatggtgag

SEQ ID NO: 15951 - DNA, 594 bp, Zea mays
  Clone ID: cC-zmpo148042f05b1
ccgtgcccgtcaggggagcaaggattgcctacagcatctgggtttttgtttgagaccaccagtccgtcgaccagggggcgggggtgtgcaaggacgccgtggcgatcctgtacatgttcgatctcacgagccgctgcacgcttaataacattgtagattggtacgggagggcgaggaaatggaataagacggctattccaatcctaatcgggacaaagtttgatgactttgctcagcttcctcttgagatgcaatgggccatcgttaaccaggccagagcatacgcaagagcgatgaaggcgaccctcttcttctcgagcgcgacgcacaacatcaacgtgaacaagatcttcaagttcatcacggccaagctcttcaacctcccgtggacggtggagcgcaacctcaccatcggcgagcccatcatagacttttgacgacccctttctctaactagtaactcggcagcacacgcacgacgacccttggtatatatcatgggttgacagggtcgtgtctttcgatcctcttgccctgtgcgagccgcccgagccatgaagtgacccaacatgcccgtcgtccttttcctcctgt

SEQ ID NO: 15952 - DNA, 388 bp, Zea mays
  Clone ID: cC-zmpo148042f06a1
aacacataaaccaaccggggactagggcatggtacgtacatgttagtgccacgttatatcgacaacgcagcctgccgatcatatatcatcttccttagatgtcagtgtatcctgcccgattgctgctgcggcagcagccccgggatgaatggcacgccgagctgtgggagccagtgctggccctggatgaagctctcgacggtgtacttctgcagcgcgtgctggtaggtgatgttcttgatacccctccacttgacgcgtttggtcatgttggcgccgggcccgtggttttccacctcggcataataacaggtgctgaggccgaagtcgtcgagccacggtagccagccctgcgggtcgatgaacccgccgatctccgactggatgt

SEQ ID NO: 15953 - DNA, 583 bp, Zea mays
  Clone ID: cC-zmpo148042f06b1
ccggtggacgagttctccgagacgctcgccaacctgggcctgtttagcttccaccgccggctcctcgcggagcgggggcggggcgcgccctcctggatgcccgacgccaagcgccggctgctgctggtctcccccggcgagaagggcttcaggcccgacgtgacggtggccaaggacggcagcggcgacttcaggaccatcaacgcggcgctggccaaggtgccgctgaagagcgccaccacgtacgtcatgtacgtgaaggccggcaagtacagggagtacgtgtccgtggcccggaacgtgacgaacctggtgatggtcggcgacggcgccaccaagacggtgatcacgggccacaagagcttcatgatgaacatcaccaccaaggacacggccacgatggaggcgatcgggaacgggttcctgatgcgcggcatcggcgtgaagaacacggcgggagccaagaaccaccaggcggtggcgctgcgggtgcagagcgacatgtcggcgttctacgagtgccggttcgacgggtaccaggacacgctgtacacgcacacgaaccgtcagtactaccgcgact

SEQ ID NO: 15954 - DNA, 499 bp, Zea mays
  unsure at all n locations
  Clone ID: cC-zmpo148042f07a1
gatatgattnctcaaaccaaacactccgtgaagggatagacatacaccactctatcttggagggagtgattttcttaaaccaaacacttcttattgaatgccctcattctccagggataacaattcagcttcaccacgatcataacaaaatgaggacggtgaagggcactgacatctctgaacactgggctatgatcaatcaaattggcaaacaatttacagttcacaaatacgagatagagtgaacaaaaggacaatatacgaatcatgtcctggcatgacttttttcccacaaaaatgcacaaaatattacttcatgggcttctttttttggcaggagattttcacattaacctgctcatgatttcagaagaacaagaaaacaaacatgacccgtcctggatcgagacatatccttgcctgcccagaaaaatcaagaataagatccctaggccgcagacttctcaatcagttattctttgtgtgttgtcattatcta

SEQ ID NO: 15955 - DNA, 363 bp, Zea mays
  Clone ID: cC-zmpo148042f07b1
tccggaggccccctcctcgctgacttggctcctccgtcgtggctgtatgttaagcaagtggggaccacagacgcgggagcggggtgaactctttcaaaaggggcaggtgcgctagtttgaatggctgctacaaagcttcaggccttttggaaccaccctgctggccccaaaaccattcatttctgggcgccaacattcaaatggggtatcagcattgccaacatagccgactttgcaaagccgcctgaaaagatatcttaccctcagcaagttgctgttgcatgcactggaatcatttggtcaaggtacagcttggttatcacaaccaaaaactggaaccttttcaatgttaacgttgcaatg

SEQ ID NO: 15956 - DNA, 440 bp, Zea mays
  Clone ID: cC-zmpo148042f08a1
agtggacacactaagaatttgggggttgggctattattctataaatcaacctgttccaacagtggatggtagcttcattcggtgtgtgcaatgcattagcggttgagattgatcacaactggttaagatgtcatttgagtttgcacattgatttacatttttttaactccggcaccatatcggaatgcatgagcgaaagaatgaatatgcatgcatgatgcatgttatcatctgcatggttgcttgtgggcatatgcaggttgaaaaaaaggaagaaaagtggctacttataacttcttggatgcctggtacgttacaccgaacttccagtcaacggggagaacctgccattaggtggccttgcgggggtcgctggtcatcacccggaacgttaactactcgcaagtgaggtcctccccggtcttccacacttgccccca

SEQ ID NO: 15957 - DNA, 579 bp, Zea mays
  Clone ID: cC-zmpo148042f08b1
ccgggcggtgcccaacctctcctgctgtcgctgctggtcgcttttctttcggtggccgccgatgtcgccaacggggggcgggccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccgcccaaggaccagtggtgcaagccaccgcgggagcacttcgacctcagcatgcccgcgttcctccagatcgcgcaagagaaggccggcatcgtgcccatctcctaccgcagggtggcgtgcgcgaagcagggcggcatctcgtacaccattcaccggaacaagtacttcaacatggtgacgatcaccaat

SEQ ID NO: 15958 - DNA, 419 bp, Zea mays
  Clone ID: cC-zmpo148042f09a1
atcatacatcagttcaaaaactagagtggtttatatatacagacactcacgtattgaatcacttacatacatgcaaaagattcaaaagaactgcggacttgatcgacagctctcggagggggagcaaaaaaaaattgcgagaggaatgcaagacgcgcaggcatactctccttgcaacctaaacgaagcctctaatcgacgtctccttcctgtgtctcggtcgcagcctgtcgtcgtcactccgtttgtgctttgcccctgtacggcttgaggatctggaacgagcatatcatgctggcgtcgacgttcatcatcgcgccggcgttgttgaactcgccgcagtagttgggcgccgaaaatatggtcaccatctgccggtcggagaataactcgtatccgtcctccacgacctggtgggc

SEQ ID NO: 15959 - DNA, 630 bp, Zea mays
  Clone ID: cC-zmpo148042f09b1
ctccgcccggacctggacaacctcaaccggatcagggagatccagttccctttcgacgtccccgaccagggcctcgtgtgcggggtcctgtggtccgacccggaccgcgacagctccggatggggcgacaacgaccgcggcgtctccttcaccttcggcgccgacaaggtcaccgagttcttaaacaagcacgacctcgaccttgtctgccgcgcccaccaggtcgtggaggacggctacgagttcttcgccgaccggcagctggtgaccatattctcggcgcccaactactgcggcgagttcaacaacgccggcgcgctgatgaacgtcgacgccagcctgctctgctcgttccagatcctcaagccgtacaggggcaaagcacaaacggagtgacgacgacaggctgcgaccgagacacaggaaggagacgtcgattagaggcttcgtttaagttgcaaggagagtatgcctgcgcgtcttgcattcctctcgcaatatttttttgctcccccttcgagagctgtcgatcaagtccgcagatcttctgaatcttttgcatgtatgtaactggatccaatacgtgaagtgtctggatatataaaagactatagtttctgaactgatcta

SEQ ID NO: 15960 - DNA, 417 bp, Zea mays
  Clone ID: cC-zmpo148042f10a1
aggcaagttcatatacttgccaatggtgggtctttttatagccatgacaactatatcatagagaacgttacatgagccaaattgacacactgaaaaaaaggctccaaattttcatgccggcatgctcctgctcttcctatgtacattggcaccaatgggctcaagcagcaacaatcatccatccttatattgcattattgctcaattctcccaatgatgcgaactgccgctgccgctaccggaggactgcgccgatggcgagaacaggctgttgaaccactgcaaggatggcggcaaccggctgccgttctcttcggcttcggctggctccgcattgcctgaaatacttgccctaccatcaccgccgccgttgtcattgccttcaccatccgcatcgacactgacaaaaccaccgtc

SEQ ID NO: 15961 - DNA, 541 bp, Zea mays
  Clone ID: cC-zmpo148042f10b1
gcccacgcgtccggtccgcggcacgcccgcggccgatgactttttactttttacggcgcggtggctcaagtgtaggcgggggccgaccgcccgagctccatctgggcgcacgctatcctcagcacggtcgacagctccgtccgccgccgccgcaaccggcggcagacggaggccgccggcgacgtctacgacgggaacgaccccgagttcgccctgcgccggcgtcgcgtcaccgcgttcctgcggctcctgcacgagctccgggaccgccagctgcagcggctggaggctgctgccggggtcgccctcgaaggcgaccagctgacccctttcggccggagcctcttcatcggcgcagctggcggcggcgagcatggcgtggcgctgggcgactacttcctcggacccagcctcgacgcactggtgcagcagctcgccgagaacgactcttgacggcacgggacgccgtcgccaagaaggaagccgtggaggcaatgccgaccgtggaaaatcgccgtggcaaaggcaacgatgactacac

SEQ ID NO: 15962 - DNA, 281 bp, Zea mays
  Clone ID: cC-zmpo148042f11a1
gatgggcttaaccacgatggcaaaggcatggagaaatttccttgtgccaggttaaaacagacgggcattgtctcaggtctcggaaagcatcactaaacatgtagcatattcacaccgccggccgcataaatacacaagttaaaaacaagcgaagcttctctctcggcgcatgcgttttgcctcctctggaggaggcgccaaaccatacgtttccttaggccgactccgcgaagccaaccctcagcttgccgtattcgaagacggtgtggtagactcccact

SEQ ID NO: 15963 - DNA, 290 bp, Zea mays
  Clone ID: cC-zmpo148042f11b1
ccgtgggagtctaccacaccgtcttcgactacggcaagctgattttttttttcgcggagtcggcctaaggaaacgggtgggttggcgcctcctccagaggaggcaaaacgcatgcgccgagagagaagcttcgcttgtttttaacttgtgtatttatgcggccggcggtgtgaatatgctacatgtttagtgatgctttccgagacctgagacaatgcccgtctgttttaacctggcacaaggaaatttctcgatgtgtttgccatcgtggttaagcccatcttgtaccc

SEQ ID NO: 15964 - DNA, 436 bp, Zea mays
  Clone ID: cC-zmpo148042f12a1
atattgcagtcggtcgagccagcattgaccgtatcagggattgacaatttggcagcacatcgacgtggttaaggcacaatttgatgcaacaagggaacaaaaaagaagaatgaaagaacatccttatgtgttacactcagaatcgcagcttgctggcatacgcaagcaccatctcgcttccatcacacgcaaaaccttttttttcgtgggcgtgaacaattcactgctgtttgcttctaccaacgaaagaaacgcttgcttttcttcttcttctcaatgtatgcaacgatctccaactgacgctcaagagtctcctgcaaggtcttctttgtagctgcaagctcctcttccagtgcactaacgcgggagacagcagcctgcagaacctcctccttatcagcaggcattgatgcgggttttgtcaagagtgcaatga

SEQ ID NO: 15965 - DNA, 540 bp, Zea mays
  unsure at all n locations
  Clone ID: cC-zmpo148042f12b1
gccagcggtccaagctatcagaagaggctgtggaggaagcttaatatctccgtctctgcaaagcgcctctcggggctgggggagaaggtcattgcactcctgacaaaacccgcatcaatgcctgctgataaggaggaggttctgcaggctgctgtctcccgcgttagtgcactggaagaggagcttgcagctacaaagaagaccttgcaggagactcttgagcgtcagttggagatcgttgcatacattgagaagaagaagaaaagcaagcgtttctttcgttggtagaagcaaacagcagtgaattgttcacgcccacgagaaaaaaggttttgcgtgtgatggaagcgagctggtgcttgcgtatgccagcaagctgcgattctgagtgtaacacataaggatgttctttcattcttcttttttgttcccttgttgcatcaaattgtgccttaaccacgtcgatgtgctgccaaattgtcaatccctgatacggtcaatcatggatggnaccgactgcatataaatatattataccac

SEQ ID NO: 15966 - DNA, 294 bp, Zea mays
  Clone ID: cC-zmpo148042g01a1
ttatcattcaatccccaaaaacacacatttgcgtgacattacatttggagtttcatttactgtatatttttgaaaaaaaacaattagtttagaaaatgccatattaataggaatacaatttatagtttcgtccatatcagatggttatagcatgcgtggtcagccggtgacgacctacgtatagactcgctcagcgcctgagctgaacgccatgttaccctggtgcatgcatacattcattcatgcatgcggggggcattcattataaggggctttccttcaaaaatgaggagg

SEQ ID NO: 15967 - DNA, 111 bp, Zea mays
  Clone ID: cC-zmpo148042g02a1
cttctttttttttccttttttttttctccctcctaaaaagggaaataaggaaatttttttttttttttcccccctttctcccccttatttttcatccttccactatttttt

SEQ ID NO: 15968 - DNA, 401 bp, Zea mays
  Clone ID: cC-zmpo148042g02b1
ccgaaaaaaaaaaaaaaaaaaaaaaaaaaaaaaaaaaaaaaaattttatatataacaaaacaaaaaaaaataccaaggggaagatcacatacatacaacacaataaatctcccctccctttacctaatttcaattcactgtcctcccctttacaccactaagacttttaaaaccctccctttcccaacttaatggccttgcattacatccccctttctccaactaacctaataattaccaagcccaatcctttcacccttcccaacactttccctacctaaattttaaatggaactccccctccatcatccccttaaacaactgtggttttgtcggttacgctcaccttaaccgcttcacttgccatcaccctatcccccgctcctttccttttctttcct

SEQ ID NO: 15969 - DNA, 259 bp, Zea mays
  Clone ID: cC-zmpo148042g03a1
agaatccgacgcaagttgcggctctgaggcagaattgtgtgaatacatcacacaactcgcaatatggaaagtcgttttctataggtgtatcggacaccgctcgtgcgtgtggcacggcgaaacgaactccgttacataattcgtacgtgtccccgaaaaaaaatctcgggacacaccgggaggcgcgagtaaagccatcgcccatagccgtaggtagtagtagttctccgtactcctgtcctgctcctcgtatcgtatc

SEQ ID NO: 15970 - DNA, 266 bp, Zea mays
  Clone ID: cC-zmpo148042g03b1
ccggatacgatacgaggagcaggacaggagtacggagaactacttctatttacggctatgggcgatggctttactggcgcggtccggtgtgtcccgagattttttttcggggacacgtacgaattatgtaacggagttcgtttcgccgtgccacacgcacgagcggtgttcgatacacctatagaaaacgactttccatattgcgagttgtgtgatgtattcacacaattctgaatcagagttgcaacttgcaacggattcttatc

SEQ ID NO: 15971 - DNA, 438 bp, Zea mays
  Clone ID: cC-zmpo148042g04a1
gccaaaataaaaagctctgcgggatatatgggcaatgggtcgatatatattttagtatggcttaacgccgtcgtagttccccggcggccagtagctgcacatgatgatggtgtcgccgctgatgcacttgatgcgtccgcagccgacgctggtggtggtcttccagacgacggccttgtagtggccgcacatcttgccggggtcgcaggtgtctgacttgtagtggtagttcttcttctcctcgctccagccgtccacggtgatcttccaggtcagccccggggtgccctccatcaggttctccccgtacggcgacgaccagtggatctgctggcagttgcccttgagcgtctccgcgtactgctgcgagaacctggccagcgttccgtccacaccagcggaggcacgtgctccttggcgcggaacacgttgtgctcg

SEQ ID NO: 15972 - DNA, 637 bp, Zea mays
  Clone ID: cC-zmpo148042g04b1
acccacgcgtccgtgcgtcgccgagccatgacgatgacaatagccgccgtgctttgccttctcctcttctctggccgtctcgccgggggggggaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaggcggcggcgggctggaccccgacggcgacccagaggttgggctgaacgggaaggcgatcgaggagatcgtgaacgagcacaacgtgttccgcgccaaggagcacgtgcctccgctggtgtggaacgcgacgctggccaggttctcgcagcagtacgcggagacgctcaagggcaactgccagcagatccactcgtcgtcgccgtacggtgagaacctgatggagggcacccccgggctgacctgtaagatcaccgttgacggctggagcgaggagaagagaacta

SEQ ID NO: 15973 - DNA, 349 bp, Zea mays
  Clone ID: cC-zmpo148042g05a1
actagcaaaaacagcggaacgggattcaggggatgttaaaaccgataaaaccaactttattgatccgaacatagaaacaacaaaaacaaagccatttattagtatcaaaacgttggaaaattaaatgtacaaccatctcaataatgaaaatagaccggaacaatatatttcacccaaaagaatcttaaataaacagcgtattcaattcatgtaataaaatcaatccaacacaacaaggcacatgaagagatggtgttgtgccacaaaataaacataggaaaaaaattaaatattggctccttgacacctggactggaaatattattcgtcatcactcattacaggctca

SEQ ID NO: 15974 - DNA, 387 bp, Zea mays
  Clone ID: cC-zmpo148042g05b1
gggcggcaccacctacaagaccactctcagcatctgatgatcttgtgtttagtgatgacgaataatatttcgggggcgggggtcaactatccaatatttaatttttttcctatgtttattttgtggcacaacaccatctcttcatgtgccttgatgtgttggattgattttattacatgaattgaatacactgtttatttaagattcttttgtgtgaaatatattgttccggtctattttcattatcgatatggttgcacatttgatttttcaacgttttgatacttataaaatgctttgtttttgatgttactatgttcggatcaataaagttctctttatcggatttaacatgcaatgaatcatgtaccactgtttatgctattt

SEQ ID NO: 15975 - DNA, 330 bp, Zea mays
  Clone ID: cC-zmpo148042g06a1
cccaaacaaggcaaaaagggaaatgggggggattttaaaaagatcaccccttatataattaaccatgcacacgtttggtttcttaacgaacaagaaagatcgatcggattgatggatcgtgcaatgagtcgccctcctcgtcatcgatcaaaggtcacgatggccggcggcggcgggcgctggaaaatggcccctgttggctatgacgaccatggccttgggcacgccggtgagctggcccttggcttacatcttgcgcaccacgttcatccctttcaccaccgtgccgaacaccacgtggcgcccgttcagcttcttgggcaaccggat

SEQ ID NO: 15976 - DNA, 588 bp, Zea mays
  Clone ID: cC-zmpo148042g06b1
ccggagagagagagacgcaggacctccggcgaccatcgaggtttttttttccagcaacccggcggcggccatcggggggggcgggcatctcatcggcggcgacgtgcctgcccctcgctctcgtcgcggacacgctggcgctggcccacggggcgcaaggaggaggaccatcggcatcggccgcggacctggacaaggtcacggccgagaccttcttggacatcgagatcgacggtaagcctgcaggccggatcgtgctgggactgtttggggacaccgttcctaaaacagcagagaacttccgagcactctgcacaggggagaaaggaattgccaattccggcacgcctctgtggtacaaggggttaactttccacatgatcatcccggggtttatgatccagggaggcgacttcaccaacggcaacagcacggggggcgagtgcatctacggcagcaccatcttcttcgacgagaacttcaagcacacccacggctaaaccggtacgctgtccatggctaactactggcccgactgcaatggctcccagtttttcatactaccggagaccaaaaccggttgcccaa

SEQ ID NO: 15977 - DNA, 317 bp, Zea mays
  unsure at all n locations
  Clone ID: cC-zmpo148042g07a1
cttttttttcttttctttttctttatctttttttttttttttagggatnggtttttttttaaatttaaataccccccccccccaccaataaaaactaaaccaaaaaaaaaaaaaaaaacaatactcaacaaaaccaataattataaccaaccaacccaaaacataaaaaattcatcccacaacataaaaaatactaacccatcacttataaacaaaacattaacccatacaaatccaataataacaacacccctccctctccaatataaacaaataaaaacaaccacaccactaaacaaaaaccttatcttcccact

SEQ ID NO: 15978 - DNA, 410 bp, Zea mays
  Clone ID: cC-zmpo148042g07b1
ccgccagggcaaccgcttccgcgccgtctacgacagcaggttttttgtgtttaccaagcgggagtacacgcaggggggggggcaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgcctttgcctgccg

SEQ ID NO: 15979 - DNA, 406 bp, Zea mays
  Clone ID: cC-zmpo148042g09a1
gggagaaccgatccgttaaaagggggagaaaaaaaacaaaaccgttgcctgccattgagtccgacccactcgctttcttacacagccacacaggcaagcattcagaaacgacaaaaaaaaaacgtcgcttgttattgattactgaaattaacgtaaccgaatcagcccttcttcccctgcgccgtcagctggtaaaagagggatccgtcgtacacggccctgacggtgtccttgggcaagcgcccgtccttgtccttggccagcttgtacagcatctcccactcctacttggctcccagccatcctgcgacatccatcttctcccggttatccttgagcatctcgtcgagctcctctttcgtcagagcgttcggtaccgtcttggcgtgcttggtgaacatctcgt

SEQ ID NO: 15980 - DNA, 605 bp, Zea mays
  unsure at all n locations
  Clone ID: cC-zmpo148042g09b1
ccgcgccccggcagccggcaacggcatgacggagctgcagaatttcgttttgttcttcgaccgcaaccacgacggggtcagcaccttctacgagacctaccaaggtctgcaggacgtcggagttggcgctgtcacggtcaaagccagcgccgcgtacattaacggcgccctcgggcccaagaccagacctgataattcaaactcctcaacattggatatctacgtagagaacattcagaagggcaaacatggaagcgacacgggcgcctacgacgctcaaggaaggttcgttcccgcgaagctggacgagatgttcaccaagcacgccaagaccgtaccgaacgctctgacgaaagacgagctcgacgagatgctcaaggataaccgggagaagatggacgtcgcaggatggctgggagccaagtcggagtgggagatgctgtacaagctggccaaggacaaggacgggcgcctgcccaaggacaccgtcagggccgtgtacgacggatccctcttttaccagcttgcggcgcangggaagaagggctgattcggttacgttaatttcagtaatcaataacaagcgacgttttttttttgtcgtt

SEQ ID NO: 15981 - DNA, 451 bp, Zea mays
  Clone ID: cC-zmpo148042g10a1
agcaacatgccctcattaaaaagagtgcgtgcgaaaatggcatgtatatttaacattttgcttgttttccactctttggaattcggcatacatgattagaattgcctcctaaacccaaacaaaaggattacatatactataattcataagtctcagtcgtatatatggttagcggtgcatgctctctcatgcaatatatataaacttaattagcttgctgttgcaggtccatatcccaccgcgccggatgaatcgaagggaattcaacgtctatttgaattggacgtttgaagtgtagacggcatctgctctccacttcagcaggatgacgtcttttgcgattaccttcttgccggactcgctggtgaggctgatggataatgggccctttatcgccttggcagtatccatcctcccaatggcgccccatgagaacttcatgggctttcac

SEQ ID NO: 15982 - DNA, 549 bp, Zea mays
  Clone ID: cC-zmpo148042g10b1
acccacgcgtccggcgacatttcgaataacacagttgagcgcgacgatgggattttctttttaataacatcatggtcgtgggtgtggggcgtgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggcttaacgacaagattcgtcactgcggcatcatggacgtcgagttcagaagggtgcgatgcaagtaccccg

SEQ ID NO: 15983 - DNA, 442 bp, Zea mays
  Clone ID: cC-zmpo148042g12a1
agcaaatcgcgcagggtatgaatatttttctcgtgcagaaagttgatttatgcagagcatcattttcgctttctatttttttatgttcagaaaaaacatttcccttcaaatgctctgatcaacaaaaccatcgaggtcagctttaccatcaccgggtgcaggtcgacggcatgaacctgacctccatgttcttgaggtcgaattcccagaggtgctcttgctgcatgatgttgccgatgaccgacacgccgggccactcgccctcctgcaagccgattcactttacgccaggtttcacgtcgatcacgtatctcttcgccggtggcttcaaccgcgcgcacccgttgaactgcaccgccagctttgggatctctcgcgctcccggtcgcggtgccgtccatttgatcagtgctcgaacggggggaagtccactttgggaccc

SEQ ID NO: 15984 - DNA, 528 bp, Zea mays
  Clone ID: cC-zmpo148042g12b1
ccgaccgactcggcgaccatcgcgctgcccggcggcaaggtgtttcagtttcaagacgtggtcctgggttgctggggcgggcgtgatggccatagcttcaagtcagtatacggcgtgctgagcctgggcaacgccaagatctcgttcgcgtcccgcgccgccgcgcgcttcggtggtagcttctcctactgcctcgtcgaccacctcgccccgcgcaacgccaccgggtacctcgccttcggcccagggcaggtgccccggaccccggcgacgcagacgaagctgttcctggaccccgcgatgcccttctacggcgtgaaggtcgacgccgtccacgtggccggccaggccctcgacatccccgccgaggtgtgggaccccaagagcggcggcgtgatccttgactccggcacgaccctcacggtcctcgccaccccggcgtacaaggccgtggtcgccgcgctgaccaagctcctggccggggtccccaaagtggacttgccccgttcgagcactgttacaactgga

SEQ ID NO: 15985 - DNA, 289 bp, Zea mays
  Clone ID: cC-zmpo148042h01b1
gaagaaaatgttatgctacatatcccttcttataccttattttgtttctttaatattattacataaactaaaggaaggatttatttaaaattttaaaaaaaaaaaaaaaaaaaaaaaaaaaaaaaaaaaaataaaaaaaaaaaaaattgcctgccgatctataataatcaaatttacttaccctatcatacaaaataataacttctctataatatcacctaaattaaattcacattccctcatttttacaaaataattaccgtaaaaaccctaattttaccaaatttaa

SEQ ID NO: 15986 - DNA, 423 bp, Zea mays
  Clone ID: cC-zmpo148042h02a1
cccccccctttcccctttttttcccccaaagaaaacaccgggaaaaagggcattccattgtactgtttataaaatggacctcaacacccacgaggccacgaatctgtttcccatattcaagggttcgaggcgcacgcagcagcaggagcacaacgccacactgtcatcgccaagcggacagcggacacatcacacctgtattgctacttgctagcaaacaccggtactgtccttgagcgcgcgcttgatctctgcccgctgccggcgcgtgagccgttccgggaacgcgacatcaaaccggatccttaagtggcctctgcgcccggtctcgcgcgcgatgggcatgccttctccaggcagcaccagctcgtaaccggggcacaccacgggcgcgtcggcctaatcgacctcgtcctcgccggc

SEQ ID NO: 15987 - DNA, 506 bp, Zea mays
  Clone ID: cC-zmpo148042h02b1
gcccacgcgtccgcatcaatcgaccccccttcaattcgatccttctatctgatgttctgcagtttcaagctaaggagcgggctcttcctttggcgagctctaacgctggcgttggtctcctttatctcccaattcctctggtgaaccatcgctgcgacggcttggatttggttctgggttcgcagtctgcctcttgtgatgcatcaccatcgccggtggagggccgacgacgatgggatcaagggattactatgagatcctcaacgtcgaccggagcgccatcgatgacgacctccgcagggcctaccggcggctggccatgcggtggcaccccgataagaaccccgccggcaaggcagatgccgagacccggttcaaggagatcaccgaggcgtacaacgtgctcagcgacgcagacaagatggcggtgtacgaccagtacggtgaggaaggcctcccgagagatgtgccgcaacccggctgcggcggaggcaccgacgacatct

SEQ ID NO: 15988 - DNA, 355 bp, Zea mays
  Clone ID: cC-zmpo148042h03a1
aaaaaccgcctccgaaaatggggtgtatggggaacattttgcttgttttccactctttgcaattcggcatacatgattagaattgcctcctaaaccccaacaaaaggattacatatactagaattcagaagtcttagtagtatatatggttagcggtgcatgctctctcatgcaatatatataaacttaattagcttgctgctgcaggtccatagcccaccgcgccggatgaatcgaagggaattcaaagtctagtagaattggacgttggaagtgtatacggcatcgggtctccagttcggcgggatgacttctttggcgatgaccttcttgccggactcgccggacgcgtggg

SEQ ID NO: 15989 - DNA, 361 bp, Zea mays
  Clone ID: cC-zmpo148042h03b1
ccgcccacgcgtccggcgagtccggcaagaaggtcatcgccaattacgtcttcccgccgaactggagaccctatgccgtgtgcacttccaacgtccaattctactagactttgaattcccttcgattcatccggcgcggtgggctatggacctgcagcagcaagctaattaagtttatatatattgcatgagagagcatgcaccgctaaccatatatactactgagacttctgaattctagtatatgtaatccttttgtttgggtttaggaggcaattctaatcatgtatgccgaattccaaagagtggaaaacaagcaaaatgttaaatatacatgccattttcggaggcaatttttttc

SEQ ID NO: 15990 - DNA, 442 bp, Zea mays
  Clone ID: cC-zmpo148042h04a1
agctcgcctatatatatatggggagcagggcatcttatcagtaaagagattagagattcctgtctctcgcttttgcttcgtactcaaatagatatatcgtgtggcatgcgtcgctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccacctcctcccccattttcgggtaccagtagacgacccgggaggagtccccccaggcccggcccaggtagatctggccccccttgacgccgccgatgctgcatttcttgaacgagaagc

SEQ ID NO: 15991 - DNA, 612 bp, Zea mays
  Clone ID: cC-zmpo148042h04b1
ccggtggtccaccatggcgcagcgagcggtggccacgatgacgatctattttgcccctcctcctcctcgccctggggggcgggctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacctcacggcgtacggcgtggtgttccggacgacccgcccgttgccaagcccggcgccaaggcggccaagcggtggcggtg

SEQ ID NO: 15992 - DNA, 252 bp, Zea mays
  Clone ID: cC-zmpo148042h05a1
aaaacagaaaatatattcggggtataggggggtcaagattatcatagatactggaactgatatttcgactcgttttgcataatagatgatacatggaatgtaagagaaaggcataaaccagtgatggcatatacatttctacattattaaccttgagatgttattggagataatcatggtaataactatcactggggcatggtctgtagattttactgaagggagtgacaacactcgagtacctactgtggc

SEQ ID NO: 15993 - DNA, 261 bp, Zea mays
  Clone ID: cC-zmpo148042h05b1
ccggccacagtaggtactcgagtgttgtcactcccttcagtaaattctttttaccatgccccagtgatagttattggcaggggtatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatatattttctgatttagcctc

SEQ ID NO: 15994 - DNA, 415 bp, Zea mays
  Clone ID: cC-zmpo148042h06a1
ggatgtagtccgcatccaccctaaaagggatagggggacaaattatagcacattctgtaggtgtacgatacagtaacacagcagcagaacatcaaacccatcttctgccaggctctgagcaaacgccaaagcctccaacgtggcacctacgtaccgtaccccagtcacccaccccacaccctacctcgctcgcagtcgcagcttccgctgtacgcacactactgcgcggtgcacgcaccgacgacacggcggcgcagcttatgtatgagtaagtatagggactcgccatacaggtagtcatcgcagcgtgccaccccgtctagcgatcgaacacagtcgacggggaacgccggccggtccggtcagttggtgagcgcgacggcggccttatgcaccaggggctgggtggcgtgcg

SEQ ID NO: 15995 - DNA, 526 bp, Zea mays
  Clone ID: cC-zmpo148042h06b1
gcgtggagatgcgcgaccagcgagcagccgcaggacgcgcatttccttcccgaggcgctggtgcagcaggtgggggcgggggcgcggtaggccggcgtgggcctggccggcgagaacgcgctgccgcgctacgacgacacggcgcacgaccaggtggtggccacggccgccgacagggccgccgaggaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccctcgtgcacgaggccgccgtcgcgctcaccaactgaccggaccggccggcgttccccgtcgactgtgttcgatcgctagacggggtggcacgctgcgatgactacctgtatggcgagtccctatacttactcatacataagctgcgccgccgtgtcggtcgtgcgtgca

SEQ ID NO: 15996 - DNA, 330 bp, Zea mays
  unsure at all n locations
  Clone ID: cC-zmpo148042h07a1
aaaaaaaacgggcaagatgcctttttattattacccattcaatcgacgaaaaacacacatttgcgtgacattacatttggagttccatcgacggtatatttggaaaaaaacaattagcttaaaaaatgccacattaataggaatacaatatatacttccctccatatcaaatggttatcgcatgcgtggccagccggtgacaacatacgtataaactcgctcaacgcctgaacttaacgccacgttaccccggcgcatgcatacatgcatgcatgcatggttcattcatttcaaggggcttcncttcaaaaaggaggaggggtgcatgac

SEQ ID NO: 15997 - DNA, 620 bp, Zea mays
  Clone ID: cC-zmpo148042h07b1
cgcgaagaagatccaggacgacttctgctcgacgctgtgcgattgcttgaaggggacggacctggtcgtgtgcgggggggggtgctcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttttccaaatataccgtcgatggaactccaaatgtaatgtcacgcaaatgtgtgtttctcatcgattgaatgggtaataataaaaaggcatgctggcagt

SEQ ID NO: 15998 - DNA, 438 bp, Zea mays
  Clone ID: cC-zmpo148042h08a1
gcctggaaccaagcggcattggggaaggacacatttcatgttgatttgatccccccaacttagcgcggatagtatagggcatatcaaaacttcaggtcaagctgaacatggaaacaaaaaagatgccaatatggcacacacaagtggccagcatctatcataattttactcaggtcattaacagcaggtacatgtaagtctgaatggatggagtacaacgtgccaaaaatactcaacgcgagcaccaaacatcgttcctgccataaaaactctcacttgccactgttcatcataaaagtgatgttgtcacctttgaagattatccggcccaatgtcttcctattgtttttcttgacgttgatttcctcatcatcttcgaggaccacattcatgtactcatcgaatccgatgatgcgaccctcaatccggaggtccttc

SEQ ID NO: 15999 - DNA, 627 bp, Zea mays
  unsure at all n locations
  Clone ID: cC-zmpo148042h08b1
tccgctccctcactgccccctggcagacgagacgcgtggtagctttggttttggcctcgccgcgcacgcctcctgaggctgggggacgttcgaggaggaggaggggaggctcccgccgccgccgccgcagccatggcgtccaccaaggtgcagcgtatcatgacccagcccatcaacctcatcttccgtttcctccagagcaaagcgcgcatccagatctggctcttcgagcagaaggacctccggattgagggtcgcatcatcggattcgatgagtacatgaacttggtcctcgaagatgctgaggaaatcaacgtcaagaaaaacactaggaagacactgggccggatactcctcaaaggtgacaacataactttgatgatgaacagtggcaagtgaaagttcttatggcaggaacgatgtttggtgctcgcgttgagtatttctggcacgttgtactccatccattcagacttacatgtacctgctgttaatgacctgagtaaaattatgctagatgctggccacttgtgtgtgccatattggcatcttttctgtttccatgttcagcttgacctgaagtttgctctgccctctactcttcgngctaacttggcgggatcaaat

SEQ ID NO: 16000 - DNA, 439 bp, Zea mays
  Clone ID: cC-zmpo148042h09a1
caataggaatttgagaggaattatgtaaagaccagttcattacttcattttataggaaaaatacagaaacgggaaaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtattatttacatgccctgttcaagcaggtagtcgcccaacctttccaccaccatgttgcactgcccaggcgtcatcggctcgtcgtagatgccaaccacgagtgcctgccc

SEQ ID NO: 16001 - DNA, 642 bp, Zea mays
  Clone ID: cC-zmpo148042h09b1
ccacgcgtccgcgagcgatctcctctccctctccctctccgatccattcttttgctctttcgaagtaaacatgtctgaccgggcggggaggtggtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaagggccttcttcccgcgtatttgctttggctcttttccccacgccataagatatctagcaattggtgactcgccttaat

SEQ ID NO: 16002 - DNA, 445 bp, Zea mays
  Clone ID: cC-zmpo148042h10a1
ccctcccccccctttttttgaaaaaaacaaaacttggaaaggatccaaacaaaagggaagcaaaaaaacaaagtttaacccccctccaaaggaaaaaaaaaacaaggggattccccaacccttttaattaagggaaaaaagggacccaaaaaaaaaaggcccaatgggtttttaaaaaaaaaacacccccccccctataaatgcccccaaccattgaactctcttcccccctttattttttcccgggccccgggaaaaccccccccctcccccttctttaatattttttccaaaaaaaaaggccaccgcgccccctaaagcggcccccacccggtacccaacaaaataaaaaccccttttagggcccaaaacccaaaacctccccataaaaccccccattggccccccattcggaaaaaagaacataaaacaaacttctttattc

SEQ ID NO: 16003 - DNA, 517 bp, Zea mays
  Clone ID: cC-zmpo148042h10b1
ccggacgggagcacagagctggctagccagccagccagcagctttctatctcgccgcgcccgtccttcttcctcgggtgcggtccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagactaagcgggagagagagtgacatggctgcgcgcattccgatgcgtgggcatgtttttgattcgacacaccttttgtcctctttttctttgttccctctttctccttaatttaacgaattgatgcatgccgctgatgttcttccccctgagagagggattaacacttgtatcatcgc

SEQ ID NO: 16004 - DNA, 419 bp, Zea mays
  Clone ID: cC-zmpo148042h11a1
ggtggtgtccttggccgtttgttttccgctcccctcggagcttcccttgggtggcggcggttggacttcttgggaacggcggggaggtcctggcatgtgcccgaggcgtcgtcgccggccgacttgtcctgcttcttgcggttctttcgggtgcccttcttgctcttctccttagtcttctcctcgccctcgccgccggtggcgtccatggatgaggtgccggagccccgagagcggtgccgtctcgaccggcgggtggcgggggacggtggggagtctcccccgccgacgtcgacgcctgcctcgcttttcctgtccctgaaggaggtttttccgacccttgctccatccatgactattttttgagaagcccaaggatttgcagcagccgtgcccccactctcactcctaaaagaaga

SEQ ID NO: 16005 - DNA, 589 bp, Zea mays
  unsure at all n locations
  Clone ID: cC-zmpo148042h11b1
ccggggcacaaagatgaagaaggggatcctgaagccgttccgttatattttaaccatcatggatggtaaggagggggaagggcaaattgggttcccgacggatgtaaaacacgtggcacatattggttgggatggtcctggctccacgaacaacaacaacaataacaacagcaacaacaatagtggcggagcacctagctggatgaaggattaccactcggcaccgcttgactcgtcctcttttaggagtgagagtgggggcacggctgctgcaaatccctgggcttctcaagagatagtcatggatggagcaagcgtcggagaaacctccttcagggacacgaaaagcgaggcaggcgtcgacgtcggcgggggcgactccccaccgtcccccgccacccgccggtcgagacggcaccgctctcggngctccggcacctcatccatggacgccanccgcggcgagggcgaggagaagactaaggagaagagcatgaagggcacccgaaagaaccgcaagagcaggacatgtccgtccgcgacgacgcctcgggcacatgccaggacctccccgccgttccaagaagtc

SEQ ID NO: 16006 - DNA, 320 bp, Zea mays
  Clone ID: cC-zmpo148042h12a1
gatccaggtgacatcttgatggattgaaaataattgaaactctcacgacaacgaaacttgcaatccatcctccatcatctcactctcaggtggacgatcaaacacggcagggcacaccaaagttacagcacactatatatcgcgaatgcatgcagcatgcatgagctaatccatctcaggccgacgtctccggcgccgccggctcctacgtgggcacgccgttctgccccatcagcttggtcatggccttctcgcacaggttcgggtgcgccgtgaaggagcacgtatccttgacgttgatcgtggccaccgcgccccac

SEQ ID NO: 16007 - DNA, 465 bp, Zea mays
  Clone ID: cC-zmpo148042h12b1
ctccgagatcgcgagcggccgcccgtccgtccccttccgctgcattctcgtatggcatctctcgcaagaggatcgacggggcgggcgcctctgccgctgctctccgcggcctcgtggtcgtcctcgccgtcctctccgtctccacgtggggcgcggtggccacgatcaacgtcaaggatacgtgctccttcacggcgcacccgaacctgtgcgagaaggccatgaccaagctgatggggcagaacggcgtgcccacgtcggcgccggcggcgccggagacgtcggcctgagatcgattagctcatgcatgctgcatgcattcgcgatatctagtgtgctgtaactttggtgtgccctgccgtgtttgatcgtccacctgagagtgagatgatggaggatcgattgcaagtttcgttgtcgtgagagtttcatttatttttaataaatcaagatctcacctggatc

SEQ ID NO: 16008 - DNA, 452 bp, Zea mays
  Clone ID: cC-zmpo148043a01a1
gtcgttgtacttatagcgtgcgctttgtcacatcttgggcatgggcatgggcatgggcatggttccatcaacgtcggggccgctgttgtacgcgtcgcaacgccgcctgacctcgccgtcggcgccggtcttgacgccgaacaagctgagcttctccatggcgcggccgaagtcggtgaagaaggcagtggggttggacgcgtagagctgcaccaggggcttggtgcgggggtccgtccacagctcctcgtcggtgctgagcagtccgaggccgcgctccaggttgacgaagtacatgttgtcgaacttgccgggagtcatgatgtcgttgaacgcggcgatggtggggtccttgaggtagtccttgcacacgttctgcagccccctggcgtaagacgggttcatgctggggttcaaacggttcggcttcccgccctggctggggaagttgt

SEQ ID NO: 16009 - DNA, 506 bp, Zea mays
  Clone ID: cC-zmpo148043a01b1
ccacgcgtccgcccaggcgtccggctgtccggcgcccacactctgggcttctcccactgcaaggagttcgccgagggcctggtcaacttccgcagccagggcgggaagccggagccgttcgaccccagcatgaacccgtcctacgccaaggggctgcaggacgtgtgcaaggactacctcaaggaccccaccatcgccgcgttcaacgacatcatgactcccggcaagttcgacaacatgtactttgtcaacctggagcgcggccttggactgctcagcaccgactaggagctgtggacggacccccgcaccaagcccctggtgcagctctacgcgttcaaccccactgccttcttcaccgacttcggccgcgccatggagaagctcagcttgttcggcgtcaagaccggcgccgacggcgaggtcaggcggcgttgcgactcgtacaacagcggccccgacgttggcggcgccatgcctatggctatgcccatgcccaagatgtg

SEQ ID NO: 16010 - DNA, 442 bp, Zea mays
  unsure at all n locations
  Clone ID: cC-zmpo148043a02a1
ggggtnggttaaaaaataaaaaaatcctgtctcctccttttgcttaggcctcaaaaaaagatgtggtggggagtgcgtcctttcttgggcgggggctggatccacctgtccccggggacttacggggtgcccaccaaggggttggcctgcccctcggggggggccaacgcccaccccaccttttttttttttttgggggctgcgccggggccaaaacacttgcaccccccgtaataaaggccctttctctcccgcttggagatttgccggccgtcccaccccacggggaccccctcctcccccatattcgggtaccagaggacgatcccggaggagtccccccaggcgcggcccaagttgaacgggccacctcttgcccccccgatgctggattttttgaacaagaaacccgtgtccaagggcccctcaatggacttggaac

SEQ ID NO: 16011 - DNA, 506 bp, Zea mays
  Clone ID: cC-zmpo148043a02b1
ccacgcgtccgcccacgcgtccggctccccgtccttcggtaggtttcattttttcggtggtccaccatggcgcagggagcgggggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgtttccggtcggaccccaagaagcccgccgtcgtggtctggaacg

SEQ ID NO: 16012 - DNA, 480 bp, Zea mays
  Clone ID: cC-zmpo148043a03a1
ggctcaacacaagtgaagaagaaatggttacttggataacatagtggacaacagagcaattagttccgaggctttgaatatgtgcatcttctttttcctttaggacctttacacagtatacacagacacgttctttggtgtgtcgcactttcaactcccctgttttttacatggcgagccggcgaatgcatggtctgcttctggtcgtcggccgtcctcgctggtggcttgatctaacagggcttgccgggcgtgcaagcgagggaaccggcgtatcgcgtgagcctggtgacgtaagacccgttcctgggcttgatgaggtccttcttgttgaactgcctgttgatctggccgccggtgacggtgaactatgcgccttccatgaaaaggttcttcttggagtgccacacccagttttttcacaccgactccggcgtgtcatgctgcttggtgacctgctttacggcaaggttgggcggc

SEQ ID NO: 16013 - DNA, 600 bp, Zea mays
  Clone ID: cC-zmpo148043a03b1
tccggccggaccacttcggctggcgcaccgtctccgacggcgacggctttaccgtcttcggctccaccaacgtgtggcgggaccgggtctccctctccaactgccaggacggcctcatcgacgtcatcgccaagtccaccggcgtcaccatctccaactgccacctcaccaaccacaacgatgtcatgctcttcagctccagcgacaagcatcccgaggaccagatcatgcagatcactgtcgccttcaaccacttcggcagaggcctcgtgcagaggatgccaaggtgccgctggggcttcttccacgtggtcaacaacgactacacgcactggctcatgtacgccatcggcggcagcaaggcccccaccatcatcagccagggcaaccgctacatcgcgccgcccaaccttgccgcgaagcaggtcaccaagcagcatgacacgccggagtcggtgtggaagaactgggtgtggcactccgagaacgacctcttcatggaaggcgcctacttcaccgtcaccggcggtcagatcaacaggcagttcaacaagaaggaccttatcaagcccaggaacgggtcctacgtaccaggcttac

SEQ ID NO: 16014 - DNA, 504 bp, Zea mays
  Clone ID: cC-zmpo148043a04a1
ggattaacaaatatatacttggataacagggggggcaacagaacaattagttccgaggctttgaatatgtgcatcttctctttcctttaggacctttacacagtatacacagacacgttctctggtgtgtcgcactttcaactcccctgtttcttacatggcgagccggcgaatgcatggtctgcttctggtcgtcggccgtcctcgctggtggcttgatctaacagggcttgccgggcgtgcaggcgagggagccggcgtagcgcgtgagcctggtgacgtaagacccgttcctgggcttgatgaggtccttcttgttgaactgcctgttgatctggccgccggtgacggtgaagtacgcgccttccatgaagaggtcgttctcggagtgccacacccagttcttccacaccgacttcggcgtgtcatgctgcttggtgacctgcttcacggcaaggttgggcggcgcgatgtatcggttgccctggctgatgatggtggggg

SEQ ID NO: 16015 - DNA, 519 bp, Zea mays
  Clone ID: cC-zmpo148043a04b1
gtccgcccacgcgtccgcccacgcgtccgcccacgcgtccgccgtgcagtccacatatccgtcgagaaggaggacattggggggaggggggagatgatggggacgacgacgaggaagtctaagttcagcgggccgtgcagggcgacgaacccgatcgaccggtgctggcggtgccggcaggactgggcgacggaccggaagcgcctggcgcggtgcgccaaggggttcgggcgcaacaccaccggcgggctggccggcaagttctacgtggtgacggacggcaccgacgacgacgtggtgaacccgcgccccggcacgctccggtggggcgtcatccagatcgagccgctgtggatcaccttcgccaagaccatgatcatcacgcttaaggaggagctcatcatccgcggcgacaagaccattgacggccgcggcgtgcaggtgcgcatcaccaacggcgcgcagctcacgttgcagttcgttaacaacgttattattcacaacattcacattaacgac

SEQ ID NO: 16016 - DNA, 411 bp, Zea mays
  Clone ID: cC-zmpo148043a06a1
aaaaggcaatgaaaggcgcgctacggggtttcatgacatactattgaataaatagtgcaggtcaggaacaaatacatagagttactcaatatatataactcataatttcaatgaattcttaattaaatgaaaaatgaatgcaagcattccctgcatgcgatggcacctcacgctggggttgcatgcgtggttcatatcatgtttgcaagagccatgcagttgctggccatctggttgagctccttgtcaaacttccccatggggttggggacccccgcctgggtgaaggggcggtcgcacaaatctaaatcctggacggcgagctgcagcatgatcttggcggtgccggtgtccttgaacgtgatggcccgctgcgccgcgccgatggtgtcctgcgtgttcatgtacatg

SEQ ID NO: 16017 - DNA, 549 bp, Zea mays
  Clone ID: cC-zmpo148043a06b1
acggttcgtcctcctcgccgtcgtggcgctgctgtccgccggtctatctttttcaggcgctgggtaagggtagggggggcgggggacactgtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcgcggcgcagcgggccatcacgtttaaggacaccggcaccgccaagatcatgctgcagctcgccgtccaggacttcgactcgtgcgaccgtcccttcacccaggccggcgttcccaaccccatggggaagtttgacaaggagctcaaccagatggccagcaactgcatggctcttgcaaacatgatatgaacca

SEQ ID NO: 16018 - DNA, 425 bp, Zea mays
  Clone ID: cC-zmpo148043a07a1
ccaagacaaatgtatgcatatatggcgagggggttcgcttgcacttgtcatatatacaggtcaatgccagcaaaaatctacagcgaacaggacgtgacagaaaaagaaacaaagtcacgtacggagtacacggctctgcgctctgctatactacatttcccaatgattttgtgccaatggctctcattgaagactactggatgtctgtgataaatcccattaacaccctgatcataggaagccaggtgttggctcgtcttcgaggtcatcgaactcccacccactgatctcgtcggccttgtattcctggtcgaacttggccagctccgattcggactctgatggcagtcgtgtcctgagctgagccgcgataggagagtcgcttctcgaatggctaggtgacgcggacaccttcaaggaagggg

SEQ ID NO: 16019 - DNA, 639 bp, Zea mays
  unsure at all n locations
  Clone ID: cC-zmpo148043a07b1
cgcctccgcgacgggcaacgaccggggcgtgaggcgatgtcgtggctccgcatttcggtgcaccgcgccgtggaggcgagcggggggcacagctccctccttacccgcaccgtccgcacctcccttgacaccgtcgtccaccatgccggccaggctgttcgcgggcggcgccaggctcatcaccgggagccggagttacaagagcgcgaaggtggcagcgaagaggctggaagaggaggcgctctcctgcaaaggggacgaacgggtgcagctgctgcgccggtggctcgtcgcgctcaaggagacccagcgcgcgaccacggcggtccgggagccgcaatttggggacaatccggaccagactgcgcccctgctggatttgtacatcgattacgacagcggtgcggagccgatgaactttttccatgtcttcctctacagtcaagccctcgagtgtgttgttctctccttgattagggaagccccaactgaggaagaagtntcactggtctcagaagtttttggaatgtgccttttcggaaggaaggatgtgcacaatgcactcttaagtagtgtaaaggacctgggcaggttattctcaagttatagtgacgaagtgttggcaaaacgtgacgagct

SEQ ID NO: 16020 - DNA, 489 bp, Zea mays
  Clone ID: cC-zmpo148043a08a1
ccagggacagaaacttggattgaggaagggttcctggttacaaatttgtaaagctggatacgctttcaatgtcattcacatcaacagatcagtagcgcgaggacaagatcattgccttgcccttcaaatttcaccgcctcattccgtcctccatgcctgaaggaagaagcagaagtcagtcccgtcaccctggatggcgttccctccgctgtcctcttggatctccggcggtgcgccgggcttgaagacaaagactgcctgcgtgcccggcccggcgaaaagccagtcgtgcacgtcccagatgacctgcaccggctcctcgtcgacgagcagcgtctcattgccccggaacttccactgaaggctcttgacatgcagcagcacggagccgtccaccgtgatccacatctccgggtccctgctggagcccgcggcggcgagcgcgtacttgatgaccatctcatgctccttgctcctcctggcgtcaag

SEQ ID NO: 16021 - DNA, 207 bp, Zea mays
  Clone ID: cC-zmpo148043a08b1
gattattgatgttcctctatgttttttttcatatatgccgcgcgcgcggaccatgaatcacttaggacctatttgacattcacatctacaaccaacacgtgcacctgatctaccggacatctaatatcgacgatgagagattgaaccacaccattgaccgacagagagagacctggcaatgcgactcttacactccaccagacggcc

SEQ ID NO: 16022 - DNA, 500 bp, Zea mays
  unsure at all n locations
  Clone ID: cC-zmpo148043a09a1
gtatatccttcagtatagnagggtaataaacggggaacgggtacatcattacacatcaaacaaaaaatatatatagtgccggtagaagacatctaacaggttgcaactgcgattctgtcctgagtttccatgatacatccggagctcctagtcagttcgcggttgacattcaaggtaggcctcaagccttgctcgcaatgttgctggacagccagtccaggccttcatacagaccctcgccagttgtggcacaagtgctctggatgtaccaatgtcgctggcgcagggagtgtaatccaagcttgtcagtaatctcagcagcattcatggcattgggaagatcttgcttgttggcaaaaacaagcagcacagcatcacgtagctcatcctcgttcagcatcctgtggagctcatctctggcttcaacaacacggacacggtcattgctgtccacaacaaagataagaccctgggtgttctggagtaatgcctccaaagag

SEQ ID NO: 16023 - DNA, 614 bp, Zea mays
  Clone ID: cC-zmpo148043a09b1
ccgatctcccctccttccctttctggtctccccccgctccttgccttcatccccaattcctccttcgatctcgctgcagggcacgcatgtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatctttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctg

SEQ ID NO: 16024 - DNA, 417 bp, Zea mays
  Clone ID: cC-zmpo148043a10a1
agttctatatgttgtaataatatattacacacacgggcataggtgccgcccatccaaatccgatgtatataggaagaggagtatgtgcccgaccgggccgctgtctactagcacggctggccgacgatgcacttgagtggtccggcgaagcgcgtgagctgaccgacgtatcggccgtgcttggccgggatgaagtcgaacctgtcgtacttgcgctcgttctggccgccggactcgttgaagaaggcgccgttcatcatgacgtcgccctgcgacttccacacccactccttgtagtccttgtacggcgtgtactcccgcttggtcacctccttggcgttggggtcgtcgggggcgatgaagcggttgccctggctgatgatggtggggttcatgttgccgccgatggcgtacatg

SEQ ID NO: 16025 - DNA, 306 bp, Zea mays
  unsure at all n locations
  Clone ID: cC-zmpo148043a11a1
nnttctctttccaaaatttttttttttacaccacccacacaacccnnngggaccggatttattttaattatctttttcccccaaaaaaaaaaaaaacatttttataaaatacaatccataacccccaacatttcactaaaaaaaaaaaaaaattttccccctttcaaacaaacaaaaaaaaaggaaaaacaaactcctttaacntaaaaacaaacacacaaatatatttccctttcctaaaacccctttttctacccnaaaaaacaaaaaaaccccacccccccccccaaaacccttgaaataact

SEQ ID NO: 16026 - DNA, 559 bp, Zea mays
  unsure at all n locations
  Clone ID: cC-zmpo148043a11b1
cgccatcttgggcgggcgccgcgcgtcaagggccaaccaaagcttgttatggttgccgtccggtccgacagggtccaggacccgcaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttcccctgcgtcatggtggaggtcgcggtgctcgccacggtgcgcgcgcccgcggcgctgtgccgcaaggccgcccgcgtgcgcaagggccgcangcgctttgcctccgcgggccaggccacggagatataccagctcctcgtggacgacaccggcg

SEQ ID NO: 16027 - DNA, 437 bp, Zea mays
  Clone ID: cC-zmpo148043a12a1
caatggcaaaataatactaatacggggggggaaactgtactcatatacataaatctctttactagtttacaaagaatgtcatcctggacagacttaacgcaaggcaggggaaaaaaaggaaaactttgcagtcttgtacaacacttgatatcataagacgtcacattccagttgaagatgttcttcctattctttgagcaccaagttttggttgcgctggctttgttcctcggcccctacctgacgaggctaagggtctggctttggttgctggtggaggcgctgcgatggcaccccataagtcgtcactatttcgctacagctggctttaaaggctttccaaaatattttggaggtgccgctattgaaccccacaagtcattctcatcattatgtgaatgtgatggcttgatgtctgcaaattttactgcactttt

SEQ ID NO: 16028 - DNA, 519 bp, Zea mays
  Clone ID: cC-zmpo148043a12b1
gcgtccgctcgcatcctgcctaacattgttgtgctcacattttacctttatagtgatgtccgaaccaaggcttgtcaggctaccgatcagttcttgcaaatagcaaaacaacaccatgaaaagcttaatacgggagacaacagtgtggctgaaagtactggtgttaagttaaagcctggaaatgcaggtttacttgggtgggccatgagttctgttacacaaaagggtaaaccttctgaccatgccccaatatctactgcaaatgccaataattctcaagcatcaacaacctcgactgccactccagacactcaggcttccacactagcgtatgcaccatccacatccacctcgcttgatcaagctgcatcagcatcagcaaggtcgtcagtagatgggtggggtgagcttgaggatggtaatatccatgaggcgaatagtagcgataaagatggatgggatgatgtagacccatttgaggacaagccatccccatctcttctatccaacatacaggct

SEQ ID NO: 16029 - DNA, 459 bp, Zea mays
  Clone ID: cC-zmpo148043b01a1
cttattgatatttgcagcggcagcttcccttaggagggagggccaatatagtataactttggtgaacaatgcaaggagaaagaacattctctgttgaacagaaaaaaacgctcccaatgcaatgcaatggagagcgaatacatgcatgttacagcaagcaatcagccggcgagggtgaatcgtggcgcaaaccagacccaggaatgcgcaagctcccacgttcgagctaggcggcctatttggcgacgagcttgcgcgcacgctggtttgctcccttcaccctggagttgagctccttcacgtcgccttgcagatgatccagcgctttgttttgcctgtcaagctcggagcccatgtcgacggccatgcccttgagctggcccagcacgccgctgaagtcgtcgagggcgtcgtcctgcttcttcttttcgatctggactttgtccatggcgtctgagg

SEQ ID NO: 16030 - DNA, 430 bp, Zea mays
  Clone ID: cC-zmpo148043b01b1
gcccacgcgtgcgggcacatctcttgcctcctctttcgcgctgtctgtagattttgggcaggaggaggccgcaccagggctagggtggggatcggagcgcgggcgacaagatgccacgcggcggcaagcccgcggcttcttcgaagccgaaccccgttcgactcggactcggacttggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagactacggacgcgctcgccggctgcctgctcatcgtcgaggacatcaagcaggacgccagcgacacgctgatcacgctgcacaagcagggggagc

SEQ ID NO: 16031 - DNA, 439 bp, Zea mays
  Clone ID: cC-zmpo148043b02a1
acaccaaaacgaggagccggggcgggggcgtttccatccatccattatatatatatgatcgccagcaggcagcaggctaattcttcttcgttctggacaccacacacacacagcttccctctattccattcttccattagccatccagtaaacaaggggggcgcatcgcaatggcaagagctagctaggagattgatccggcctagttctgttcagcatgaggaaggtgtgcgccaacccacacagagaggtcggccttgacacaatgctacaggtgcccgtccagggccagctccaccacgatccatcgtcggcatcctggggcacacggacgcgccggcgactcaccctcaaggcgtgggtgccgtcgccaattgaccaccgccaccggactgccagttcgcggccttctccagcggacttgcaattcatgctcggg

SEQ ID NO: 16032 - DNA, 525 bp, Zea mays
  Clone ID: cC-zmpo148043b02b1
ccacgcgtccggcccccgcgaagcgtgggcctgctgccagggctattggttccaggcgactctgccgtcgctcggggagggcatcttggtgccgccggccaccaccatctccacgcaccacacctccggccccttctgccacagcacgaggccgccggcgatctcggcgccgccgtggaccacgcccaccattcccgtcctgcaggctctctgcccctgcttggtcgtcgacgacgacgacctcgttctcatcagcaccttccccaccgcgtacatgctcgtcgccgcgctcagtgcccgctcgcccccagacgccgcgacgtactgctccacgatgtacttcgccttggacacctcctgtgggaaaaaaaataaaaattcaaaatgcctcttttattagccacgccgcgatcacagggtcgacagtacatgttaggctgtgcttaacgttagttacgtacaaggggctctttcttgatgtcctctacggccaccatgggcttcctcgcctgcactggctgcggc

SEQ ID NO: 16033 - DNA, 523 bp, Zea mays
  Clone ID: cC-zmpo148043b03a1
ataagcattagaaaaaatataatgtcattcagggaatggtttcatgttattatcgttacatagccaagaagaaacatagtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcagaatcgtcgccggacgatggtgctggggcgctggaggtgccatcagaagatgggcctggtgcggcggaggactcagacgacgacgatggcgctggtgcgctagagggaccggatgaggccgccgccggcggagcatcagcagccgacgcgctggcaccagcaccggacgccggcgcgtcgtcaccagacgggccgctggcgctcgcagggccctcggaggcgccggcgggggcattggcggagcccctcgaaggcgccgtcgcgccgtatgagggcgctcccgcgttggagggtggcagggc

SEQ ID NO: 16034 - DNA, 523 bp, Zea mays
  Clone ID: cC-zmpo148043b03b1
gtccggagagaaacgcgagcaaccagcgatcgccccatggccgccatggtttgttccgtctccctcgtcgtggcgccccgggtcctggtctccctcctcgtctccgccgcggccagcgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaaggggtccgggatggccaccttcgtgcaccgcaagtacagcgacaaggaggacagcgacatgttcaggtgctacgacagctgctccgacgacgtggaggaggccgttgcccacctcaacggcctcgtccgggagcccaccgacgccaagttcctcgagctcaagtcgtggctctcctccacgctcggcggcacctccacctgcgaggacgcctgcaaggacctgccccagaccagcgaaaggacgacgtcgtcacttc

SEQ ID NO: 16035 - DNA, 447 bp, Zea mays
  unsure at all n locations
  Clone ID: cC-zmpo148043b04a1
gctcagaatatgtgcatcttcngggtcgggtaggacctttacacagtatacacacacacgttctctggtgtgtcgcactttcaactcccctgtttcttacatggcgagccggcgaatgcatgcaggtctgcctctggtcgtcggccgtcctcgctggtggcttgatctaacagggcttgccgggcgtgcaggcgagggagccggcgtagcgcgtgagcctggtgacgtaggacccgttcctgggcttgatgaggtccttcttgttgaactgtctgttgatctggccgccggtgacggtgaaatatgcgcccttcatgaagaggtctttctcggagtgccacacccagttcttccacacggactccggcgtgtcatgctgcttggtgacctgcttcgcggcaaggttgggcggcgcgatgtatcggatgccctggctgatgatggtgg

SEQ ID NO: 16036 - DNA, 533 bp, Zea mays
  Clone ID: cC-zmpo148043b04b1
cccgaccgggctctttcgtcctgtacttggtcttcttcttcctgtccttatgccttgtcggaggccaatatcggcgacgtggatgggtactggcagcagcgcaagctcatggccgacgccgcggctgaggccacgtacaagcatgacccggtcgaggtcgccaaccaacttaaccgtgcagtccacagatccgtcgagaaggaggacattggcacgaggcgggagatgatggggacgacgactaggaagtctaagttcagcgggccgtgcagggcgacgaacccgatcgaccggtgctggcggtgccggcaggactgggcgacggaccggaagcgcctggcgcggtgcgccaaggggttcgggcgcaacaccaccggcgggctggccggcaagttctacgtggtgacggacggcaccgacgacgacgtggtgaacccgcgccccggcacgctccggtggggcgtcatccagatcgagccgctgtggatcaccttcgccaagaccatgatcatcacgctcaaggaggagctcat

SEQ ID NO: 16037 - DNA, 462 bp, Zea mays
  Clone ID: cC-zmpo148043b05a1
acccacaacatgatctgagggcgtatgggcaagaacagatgaaccccaacggacaacaaacgcacgcacccatagatttcagcatccacgtcccaatccacacacacaccccttaccggccagtcgggtgaacgagctgcgagaacaccacgctgttggcgatgtcctcctcgtccatgtcctcgctgatcagctcgagcgccgcagccgaggcagccatgctgtcggccatagacacggtgccactgtcgctcgagctgcctcttccaccctccggctttccgccgttcttgaaggtgtcctgcatctgcaacgcgaactcgaggttccacagcacgtcgcccatggacgggcggtccactccatggtcacacaggcactttttcgccgtcttggcgtacttctttaggcagtccggcgctatcttgcccttcacaccgggtcgattatgttcttcaacgt

SEQ ID NO: 16038 - DNA, 575 bp, Zea mays
  Clone ID: cC-zmpo148043b05b1
tcccgcggccatatgcgtcgtggcttaccactcgaagaagaggcgggctttgttttacagcgtgtcgcattcatcgggggggctgggcgtctacggtggcaactcgcacacaaacgccagcaagtcgtccggcggcaagagcgcggcgctcaacccgaacatcacggccatgtgccggcacttctcgttccaggagatcaaggcggcgaccaagaacttcgacgagtcgctggtgatcggcgtgggcgggttcggcaaggtgtacaggggcatcgtctacggggacaccaaggtggcgatcaagcggagcaacccgtcgtccgagcagggcgtgctggagttccagaccgagatcgagatgctctccaagcttcgccacaagcacctcgtgtcgctcatcggctgctgcgaggacgacggcgagatggtcctcgtgtacgactacatggcgcacggcacgctgcgggagcacctgttcaagagcgggaagccggcgctgccgtggcggcagcgcctcgagatcaccatcggcgccgcgcggggcctgcactaccctcacaccggcgccaagtaca

SEQ ID NO: 16039 - DNA, 401 bp, Zea mays
  Clone ID: cC-zmpo148043b06a1
ggggataattaaacccacccaaaacattgattgacaatgattaaaatagcccagtttgatacatttttttatcaggtggcatcatcatcatatacctaatttacaggttgacattacataccatggttatgggacacacacacaggacagggcattttcattaccactagaccagggatgggaaggacgatactaaaaaattttttaattaaagacccaaacccaggactgttttgacaaaatgcgggaccaccatgccagttgccacacagtacgacaattaggtcaattaggccccccaaacggggatcccctgcattatgcacttgaactcgttgaaatccacccggcccttttttttggggtcgacgttgaaaattattttccggacgttggccatt

SEQ ID NO: 16040 - DNA, 563 bp, Zea mays
  unsure at all n locations
  Clone ID: cC-zmpo148043b06b1
cggcgccgaggaggacgagcaggagatgcgggaggcgttcaatgtcttttacgtcgatggcgacggcttcatcggggccggggagctgcaggaggtgctcaagaagctcggcctccccgaggccagcagcatggccaacgtccgggagatgatctgcaacgtcgaccgcgacagcgacggccgcgtcgacttcaacgagttcaagtgcatgatgcaggggatcaccgtctggggcgcctgactgacctcatcgtcgtactgtgtggcaactggcatggtggtcccgcatttcgtcgagacagtcctgcgtctgcgtctctaattgaagaattctttagtatcgtccttcacatcactggtctagtggtgatgagaatgccctgtcctgtgtgtgtgtcacataaccatggtatgcaatgtcatactgtaaattangtatatgatgatgatgacagctgataagaaaatgtatcacactgggctattctaatcattgtcaatcaatgtcttgggtcggcttagttatcaaacaactaaactcccctcactttttcttcctacat

SEQ ID NO: 16041 - DNA, 515 bp, Zea mays
  unsure at all n locations
  Clone ID: cC-zmpo148043b07a1
tttattattttatttattttttttatttattttatttttatttngggttggttttatttttatttttttttatttcccttatctttttttttatttatattttatttttctttattaatattcaagaaccaaaaaaaaaatggcttaaaaattttctcccccaaaaaaaaaaaaaaaattccccttttaaaaaaaaaaaaaaaaaaaacccccccttttattaaaaaaaacacgagccaaaaaaaaaaaaaggtaaattaaaaaaaaaaaaaatttaccaaaaaattctcaaaaaaaaaaaaattttccccgcaaaaaataaaaattattttttctaacaaaacctcttaaaaaaaaaaacccaaaaaaatttttaaaacccttaaaaaaaaaaaacacccccattttaaaaaaaaccacaccctggcacaaaaaaacaaaaaaatttttacaatgtgtcttccccttctccccgccccacaaaaaaataaaaaaaaacccccctccccttgtta

SEQ ID NO: 16042 - DNA, 545 bp, Zea mays
  unsure at all n locations
  Clone ID: cC-zmpo148043b07b1
gaaccgaagaggagatggcgtcggcgctgtcctccctgcgcttttgctttagcctctcggtggtgggcatctgcgccggggcggccgtgctctgcgaggccatgtcctggctcctcatctaccgcaccgccacctacaactccctccgcgccttcatcgagcgccactcccgcaagctagacgccatgaagtccggctccacctccgcctcctccggcaccgccgcctcctccgcgcagcccgcatcgtcgcgggctaagaagatggaccgcgtcgagaccagcctcaaggacgctgcgcgggagctctcgctcgccaagctcaagtcgggcgccgtcgtcgctgtcatgctcttcgtcgtcttcggcctgctcaactccctcttcgagggccgcaccgtcgccaagctgcccttcgcgcccatcccgctcgtccagcggatgagccaccgcggactgcccgggaacgatcccaccgactgctccatggttntcctctacttcctctgctccatgagcatccgaaccaacctgcagaaactgctt

SEQ ID NO: 16043 - DNA, 390 bp, Zea mays
  Clone ID: cC-zmpo148043b08a1
aaccaccacgggatagggtcacatcacatccatgatccagcagactcggacaataacagtcgatcattacagtagcagcacacacgacacctgaacctcacaagtcacaacacggaggatcgagcagttcagtccatacgcgcatcgtcattacgtcttcactgactgactccgactccgagtacatacaactagtgcagttccagattatttatgcaataacagtttcgaattttaggatcttttgtaataaggttataaacttataatggagggtagatggatcttgctgtctctagtctcagatggcgaggacgaggcccggcagcgacttgtgcgcgctgtcggcgcggcggctctgccacaggcacttggaccctgcagctgcag

SEQ ID NO: 16044 - DNA, 617 bp, Zea mays
  Clone ID: cC-zmpo148043b08b1
acgcctcgatccatcgggggagaggatgggagagcctacgcggcaggatttggtgtaggcggcgctcgccggggagtcgggggaggagcgcaaccgcttcctggtgctgcggctgtacgaggcgctcggctcctgcgacgcgcgccgggcgcggaagctgctggcgcccgacctcgagtggtggttccacggcccccccacgcgccagcacatgatgcgcctcctcaccggcgcggaccaccagcgccacatgagcggcggcggcggcggcgggttcgccttctccccgcgctccgtcgacgccttcgggtccaccgtcgtcgcggagggcggcgctgacgacgcgcgccagctctactgggtgcacgcctggaccgtggggcccgacggggtcattacccagctcagggagtacttcaacaccgacctcaccgtcaccctcctcgccggcactgcctccgccaagaaagctgctccgcctaagaagcagcaggacgctgcctcttcttctacctcctcctcctcacccccctcggctgcgtcgtcgtctgcagctgcaggggccaagtgcctgtggcaaagccgtcgcgccgacagcgcgcacaagtcgctgccgg

SEQ ID NO: 16045 - DNA, 296 bp, Zea mays
  Clone ID: cC-zmpo148043b09a1
aggaaatatcatatatattccatggcagggttacagatcgacttgacgcgaacacatgaattttaaatagtaatgtctacgtaataataataattaaataacacaacccgttaccatgcatgcatagatattcatatcagaccagtagtactatatgggaacagcgttgcaagtgacgtcgtccatgcatgcatagatgttcaacagtccatgcatgccaatgccatgcgcgcgtacgtccgttcgttcgcttattgcaagtagtatgcgaggaagtataataagagttgtggggg

SEQ ID NO: 16046 - DNA, 431 bp, Zea mays
  unsure at all n locations
  Clone ID: cC-zmpo148043b09b1
cgcccacgcgtgcgcgagaggtgaaccancagcctccaataaaagccatcacattcaaataaaaccgagagacctcaggggctagcaagccgaccgccgacgtaccaccgcgccaacccgagagaaagatggagatgatcaagaggatccttatcgtcgcgctcctcgtagtcgccgtctcggccaccgcagtgctggccttcaccgaggccgccgccgccggcgccccatccgccttcgagtcgtcggcgttcgccgaagcccccgttggcgccgtcggcgccggtgccggcaccggtaccgacgtggggcctcttgtcagtggcgcctttcccgctctatcctccgggcccgccgcgttctttttatttttcctcgtctactaccttcattaatctgacttactgacggactctctcatagttttgtca

SEQ ID NO: 16047 - DNA, 381 bp, Zea mays
  Clone ID: cC-zmpo148043b10a1
agaaggagccggtattaaagggggccagggttcaccctatacgcaatggtacaaaaaaataaagtattgacaacttatattccagtaacatctcctataacttcccccatcaagaactggcagaaatatacatccaggcagaggggtcagtagcagatgactcctatatcagtgtcggaaggatgccgatcttcttgatgacatggaacctgaccttgatgtgatcagcgcatcagcaaatttatggatctcaacatcctcaggtatggccttgctactatcaaggccaatgctgggaccgaatgcatttacctttttctttctagaagatacactcttcaccacagaatggtcacttcttttacctacaatttctgtgcc

SEQ ID NO: 16048 - DNA, 635 bp, Zea mays
  Clone ID: cC-zmpo148043b10b1
aagaagaagttcttctctaagcttcggaaactggtgctgggttttggtttttgagaaccgtgaaatttctactcgggagaggagagtgtctatttcaagttgttccttcgatgacttcactggaagggattcacatgatagctattcttcgttcatggcagaaccaaacatgcctgatagtcgacggcatggtgatcatggctttggtacacattcttctttggacagcgcaaaatctagtcctcttggcacagaaattgtaggtgaaagaagtgaccattctgtggtgaagagtgtatcttctagagaggaaaaggtaaatgcattcggtcccagcattggccttgatagtagcaaggccatacctgaggatgttgagatccataaatttgctgatgcgctgatcacatcaaggtcaggttccatgtcatcaagaagatcggcatccttccgacactgatataagagtcatctgctactgacccctctgcctggatgtatatttctgccagttcttgatggggggagttataggagatgttactggaatataagttgtccatacttttattttttgtaccattgcgtatgggtgtagtttacttacctttataccaacttctactacctgggct

SEQ ID NO: 16049 - DNA, 341 bp, Zea mays
  Clone ID: cC-zmpo148043b11a1
gatagaattgttgaatggatccaaacaaatggggggcgggggaaatgatacaagtgttaatccctctctcaggggaagaacatcagcggcatgcatcaattcgttaaattaaggagaaagagggaacaaagaaaaagaggacaaaaggtgtgtctaatcaaaaaacatgcccacgcatcggaatgcgcgcagccatgtcactctctctccccttcgtctcttcctcggcctccgggcgccccggccggctcactgaatgttgtaggcgaaaaaggaggcgacggcggcccctatggcggtgcccacggcgggtccgaccgctgaagatccccttgtggggg

SEQ ID NO: 16050 - DNA, 546 bp, Zea mays
  unsure at all n locations
  Clone ID: cC-zmpo148043b11b1
ccgcgagcacagagctagctggccagccagccagcagccagcttgctctccgctctccgtccttcttcctcgcctccggtcgattcggtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagactaaggggagagagagtgacatggctgcgcgcattccgatgcgtgggcatgttttttgattcnacacaccttttgtcctctttttctttgttccctctttctccttaatttaacgaattgatgcatgccgctgatgttcttcccctgagagagggattaacacttgtatcatttcatcgcttgccatttgtttgaatccattctacatttcattc

SEQ ID NO: 16051 - DNA, 381 bp, Zea mays
  Clone ID: cC-zmpo148043b12a1
tctttttttttcggtttttttttttcaccacagggctcctctatttggggggggggtcgtgttctgagaacacaacctaaagatagccctacatctctccgatccttttcggggaaaggaaattaccaacccgactggatttcctgtccaggggagttagcattattaaataactgcacaccgttgttaccaacaatagaaccggggacatgtgcccgaggaacctccatcctgaggacaagccgtgtgaattaaccagaaatgttgcgcccgtattgacgaccttaatcttaatgcctccacgaacagtacctactccaggaccacccaaagaactcgattcttccaagtcattagataaccaactttgctggaaaggac

SEQ ID NO: 16052 - DNA, 585 bp, Zea mays
  Clone ID: cC-zmpo148043b12b1
cggctaatgccagcgtcattttcgggtgcggtgctcaacaagtgtgtggttttgggaagttcaaaccaagccctgggcggagttcttggttttggtgaggcaaatacatcaatgctatcacaactaactaccgctggtaaagtgaagaagatatttgcccattgtttggataccataaaaggaggtggaattttttctattggggatgtggtgcatccaaaagtaaaaacaacgccattggtagccgacaaaccatcacattccattttgaggatgatcttgcactacatgtgtatccccatgagtactttttcgcaaatgggaatgacgtatactgcgtgggattccaaaatggtgcatcacagtcaaaggatggaaaggacattgtgcttatgggagatcttgtcctttccaacaagttggttatctatgacttggaaaatcgagtcattgggtggactgactacaactgttcgttgagcattaaaattaaggacgacaaaaccggcgcaacatctactgttaattcacatgacttgttctcaagatggaagtttcactggcacatgtccccggttctattgt

SEQ ID NO: 16053 - DNA, 487 bp, Zea mays
  Clone ID: cC-zmpo148043c01a1
aagagttggggggggttcgtaaacttgtacattgcaatgtcctctgtggcatgaaatttagatcatgtatatattttgaatggaattatagatccacactagtagaatgaataagaaagttcgcagattgccagaggcctaaaaaaagactggcgagagtgagaaagagagaggtgaccaagagtgagtgatggatgcaagtaggttcagacgcaggcgagctccttcgccatgccaatggacttgccgatggcgttcttgcaaacggacatggtcttgttgtcggacctgttgtacttgatgtcgacgttgatgagctgcacgccctggcagggcaggttgttggcgcagttgagcgtgatggcctccggcgtgttggaagtgccgtggttgttcttgaagacgacgtcgttgacggccaccttggaggcgccggacttgaacagatgttgttggggcaagacttctggtctatgatgatggggta

SEQ ID NO: 16054 - DNA, 533 bp, Zea mays
  Clone ID: cC-zmpo148043c01b1
gtccgggcgacctaacgcgtacaagaggaactggatcgagatccagaatttcgttttacctgtccatcaacggccacggggccatggaggggcagggagccctggtgtggaacaagaacgagtgccagcgttcctacaactgcaaaatcctccccaacagcctggtgctggacttcgtgacgaacgcccagatccgcggcatcacgctgctgaacagcaagttcttccacatgaacatcttcgggagcaagaacgtggtgatcgacaaggtgacgatcaaggcccccggcaacagccccaacacggacggcatccacatcggcgactcgagcaacgtgaccatcagcggcaccaccatcgccgtcggcgacgactgcgtctccatcggccccgggagcaagaccatccgcgtgaagggcgtcaagtgcggcccgggccacggcatcagcgtcggcagcctggggcggtacaaggacgagaaggacgtggaggacgtgaaagtgaccgggtgcacccttgtcggcaccaccaac

SEQ ID NO: 16055 - DNA, 449 bp, Zea mays
  Clone ID: cC-zmpo148043c02a1
ggaagcaaccgggggcagtcaatggccatctccctcatttcatgagcaacagaataaatgcaggtcagggacaattacacagagtttgctcaacgtaactcgtaatttcaatgaattcttaaatgaaaaccaagtgctcatcatgtccaagcattccctgcttgcggcgcgccgccacctcatgctggagtgtaagaacatgccaaacagtcgtccccggccgcatatgattcatatcatgtttgcaagcgtcatgcagttgttggccatctggctgagctccttatcgaacttacccatggggttggggacaccggcatgggtgaacggacggtcacacgagtcgaagtcctggacagcgagctgcaacatgatcttcgcggtgcccgtgtccttgaacgcgaaggcttgctgtgccgcgcccatggcgtcctgcgtgttcatgtaca

SEQ ID NO: 16056 - DNA, 510 bp, Zea mays
  Clone ID: cC-zmpo148043c02b1
ctatggggcaagcctacccacggcttgtcctcctcgccctcgtttctttgtagtctgccggcctcttcccgcaggggttaggtaacggcaagggcaaggtgcatggcggcggtgccgtcaacccgctggttgccggcatctgctctcgcgccccattcccagaggtttgcacggccacagccgggcgccatgcatccaagtacccggtcatcgacaatttggccgtgctgaacatgcaggtggccgcgttcgccaagcgcacagcgcaggcgcggaagcacgtcgcggtggcggcccgcactattccaccgccgcaggcacaggccctcaggacctgcgacacgatgtacatgaacacgcaagacgccatcggcgcggcacagcgagccatcgcgttcaaggacacgggcaccgcgaagatcatgctgcagctcgctgtccaagacttcgactcgtgtgaccgtccgttcacccatgccggtgtccccaaccccatgggtaagttcgata

SEQ ID NO: 16057 - DNA, 531 bp, Zea mays
  Clone ID: cC-zmpo148043c03a1
ctctccactagtaggagtaccagggcacggtttccctaataagtacagtgtgctcgtcgtagccagacgaacaattcagcattcgatcacggatgacatgacgccgcgcgccattcaccggaggcaaattattgggagcctgatgaggccaatcaaactgcattagcagcggcgccggcggcggcattggaggatgacctcgtcaggccattcccgacgttgcaccccgcaccatctacagcgacaccagcggcagcgtcttgcatggaggatgctgccgccgtcggcagcgccatcttggtgtcggcggcctcctccttctcctgcgtctccctgtgcttgccccagaggacggagtagaggcctgccacgatgagcgcggcgccgaggacgcccccgaggtagatcttctcggagaggatgagcgagcccatggcggcgacgatgatcatcatgagcgggctgaacgccgaggcgaacaccggcccggccttttggatcaccaggccctgcacgtagtacgcgatgctc

SEQ ID NO: 16058 - DNA, 463 bp, Zea mays
  Clone ID: cC-zmpo148043c03b1
cgcgttcggcgcgatgagcaacatcctgccggccatgacttttgttttggcagtgatcttcaggatggaggggctggggatggataaggtgaggtgccaggccaaggtcctcgggacggtggtgaccgtggccggcgcgatgctgatgacgctctacaagggcccgctgatgcagctggcgcggacgaccagcaggcacgcgtcggcgtcggcgtcggcgtcgcccgccgcggagatcaccatcagcggcagggactggttcctcggctcggtgttcgtcgtcgtcgccacgctcgcctgggcctccctcttcgtcctgcaggcgcacaccatcaagcagtactcggcgcagctgtcgctcaccacgctcgtctgcttcgtcggcacgctgcaggccgtcgtggtcaccttcgtcatggagcgccgcaccttcgtctggaccatcgggtttcgacatgaacct

SEQ ID NO: 16059 - DNA, 492 bp, Zea mays
  Clone ID: cC-zmpo148043c04a1
aagttgtcatttgaatttgcacattgagggacatgtttttaactccggcaccgtatcggagtgcatgagcgaaagaatgaatatgcatgcatgatgcatgttatcatccgtatggctgcttgctggcatgcaggttgaagaagaggagggaaagtggctacttagaagttcttggacgcctggtacgtgacgccgaacttccagtcagcggggagaacgtgccatgaggtggccttgcggtggtcgctggtcatcacccggaacgtcagtgactcgcaggtgaggtcctccccgggctgccacacttgcccccagttgcgcttcatctccgtccacttaacgcgcttgctccccttcaccgacaccgccgtgatgtcgccggcgccgcctacgttggtgatcgtcaccatgttgaagtacttgttcccggtgatggtgtaccggatgccaccctgcttcgtgcacgccaccctgcggtaggagatgggcacg

SEQ ID NO: 16060 - DNA, 536 bp, Zea mays
  unsure at all n locations
  Clone ID: cC-zmpo148043c04b1
ggatgccggcgccacagcctgtcctgctgtcgctgctggtcgtttgtgctagcggtggccgccgatgtcgccaaggccggggacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtgcccgcccaacgaccagcagtccgcggacagcggcgggtggtgcaacccgccgcgggagcacttcgacctcagcatgcccgcgtttctccagatcgcacaggagaaggccggcatcgtgcccatctcctaccgcanggtggcgtgcac

SEQ ID NO: 16061 - DNA, 505 bp, Zea mays
  Clone ID: cC-zmpo148043c05a1
cataatggtagatcttcctttggggtggggttaccaacccactaacaggtaatcattcctacaaacaatctctctcataactagtcttctttaccaaattcaccaaagcaatcccaattgtgggttacccaaacaatcctagcctaagccttaactcctacctcttttaacccatggctctctcttaccagcaacgcaagcccatccttcacctcaacgctcttctccgcgaccgctgcggcagccttctccacctcttgcttcctatacatccaggcctctgagggaggcgtcgtgatcaccctgacatcagtgccaccagcattgatctcaagcacctcaggcagcccgttcccacatccccttgacagccccacatccaccctcaccgtctgtgcgctacacactgcattgatccccactgtctgaattgtgtgccccatcaccattctcttggccccggggatcatcccaagcaccccctccagcctcttgcagtcacaat

SEQ ID NO: 16062 - DNA, 589 bp, Zea mays
  Clone ID: cC-zmpo148043c05b1
cacgcgtccgtccacgcgtccgctcgaggccaacgtcgagtttgttcttgagcggatcaatgcggaggtcagggggtgggtccgtgttgggggtggagacaatgccagggcgcccgagtatgtgcgaggccgggacgccgtggtctggctgaggaggttctccgacggcttcgattgtgactgcaagaggctggagggggtgcttgggatgatccccggggccaagtagaatggtgatggggcacacaattcagacagtggggatcaatgcagtgtgtagcgcacaggcggtgagggtggatgtggggctgtcaaggggatgtgggaacgggctgcctgaggtgcttgagatcaatgctggtggcactgatgtcagggtgatcacgacgcctccctcagaggcctggatgtataggaagcaagaggtggagaaggctgccgcatcggtcgcggataatagcgttgaggtgaaggatgggcttgcgttgctggtatgagagagccatgggttataagaggtaggagttaaagcttatgctaggattggttggggtaaaccaccaatgggaattgctttggtgaatttggt

SEQ ID NO: 16063 - DNA, 441 bp, Zea mays
  Clone ID: cC-zmpo148043c06a1
attattatatatctatgcttgggggaatgatatattgtagtgatgataattttgaaggtatactgagatcaattaattgtacaagatccatgcttggctcaaaactggaagaagctagctggaaatcatgagttcagttggtggtgctcttcttcttcttcttgttcttcttcttgaggtccgtggcatagtagttgcatgtgatgaagacgcctcccttgaagcactctgctcgtgcgcatcccaccttggtgctcctcttgccgaccatgaacgcgaagtggccgcactccttgtacgccctgccgcctgtgcactgctccgtgttcctgtcgtagatggactcctccttgccccaccagaagacggcctccttggcggtggcgttccagtcgtcgtggctcctgaacaggctctcgccgtacttgtggccgctgtgga

SEQ ID NO: 16064 - DNA, 526 bp, Zea mays
  Clone ID: cC-zmpo148043c06b1
gacgacgttggcaagagaggagggccggcgtcggcgtgcctagtttgattttgaaccatagctagccagcatggggcccgggagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcacgagatggagaaggcggtcgcggcggagaaggctgcccatcaggagctgctcaagtacgccaaggagaagggcatcgtgtcaccgaccaacggcacggggtggtacaagggcatcgcccgggagtttcgtggacgcccacaacgagctccgcgcgcgctacggcgtgccgcccatgaagtgggacaagaagctggcgcggcaagcgcggcgctggtccaaccgcatgcgcaaggactg

SEQ ID NO: 16065 - DNA, 495 bp, Zea mays
  Clone ID: cC-zmpo148043c08a1
gtcgtcgctgtccttcttgttttcgtttacagtctcgaaggcgccgacgagcgcggggaccttgctccgacgcttctccagcagcttcgtgcgcgcctcctcgatcacgtcgttgctccgactccgctcgcgcctccaacgccgtcctcacacggctgccctggaacctccgcattgcctcctccttctcgtcctcctccgcctcctgcttcttgatcgcctccttcacaaccgtcacgaacttgtccgccaccacgtcttccactgctgctacggcaacgatggcctccggcgccggcgccggcgacagagccgcttctttcttgggcgattccacctcctcctcgtccttcgaggttaaggcggcggcgatgacgataggcttcggcgccggcgacagagccgcttctttcttgggcgactccacctcctcctcctcctccttcgaagatgcggctgtggcgatgacgatagccttcggcaccggcgacagag

SEQ ID NO: 16066 - DNA, 630 bp, Zea mays
  Clone ID: cC-zmpo148043c08b1
gcccacgcgtccgcccacgcgtccgcccacgcgtccggccatgggctttgttcaggacgagccgcggcagcagcgccaggatggctatcaccaccccgagatcgtccccgagaagatcatacacgaggacgcgttgccggtcgttgctgcggagaaggagactgccgccgccgccgcaacctcgaaggaggaggaggaggtggagtcgcccaagaaaggagcggctctgtcgccggtgccggaggctatcgtcatcgccacagccgcaacctcgaaggaggaggaggaggaggtggagtcgcccaagaaagaagcggctctgtcgccggcgccggagcctatcgtcatcgccgccgccttaacctcgaaggacgaggaggaggtggaatcgcccaagaaagaagcggctctgtcgccggcgccggcgccggaggccatcgttgccgtagcagcagtggaagacgtggtggcggacaagttcgtgacggttgtgaaggaggcgatcaagaagcatgaggcggaggaagacgagaaggaggaggcaatgcggaggttccagggcagccgtgtgaggaccgcgttggaggcgcgagcggagtccgagcaacgacgtgatcgaggaggcgcgca

SEQ ID NO: 16067 - DNA, 437 bp, Zea mays
  Clone ID: cC-zmpo148043c10a1
ggatgtatctttcttttcgcgctgcgttactttaaagaaacggatattcttttgtgatcagtcgtgcctccacatgcacgtcacaaggcataaattcaagcaaaagaagaaaaagaggaagattctttggtaccgccggcggtttgaacaccctgctgacctggctctctttctccagccgcctctccttccttttttctgaccggaggtgctggtcgtcttcaaccttcgatgcacatatgtggtgcagtgcagtgcagtgcatgctctttgtcacctcacctgcgcagactacccttaaggcaacacgcactcaatctcctgcggtgctgcctccccatgtccaactctaacagtaacagaactaaggctcttgtatatactcttagaagagatatgtgcatgttccggtgctcctgcctcactgatctgcagct

SEQ ID NO: 16068 - DNA, 560 bp, Zea mays
  Clone ID: cC-zmpo148043c10b1
tccgccacgcgtccgcggacgcgtgggcggagctgtcaggagccatagttttcatgccggacctccagctgctccacctgggggcggggttcttcgactccatgggcgagcgcgagagcgccctgcgggactgcgaggccgcgctctgcctggacccgacccacgccgacacattggagctgtacagcaaagcctccaccaccaaggccgaaccccagagctaggcagccagccggccggcaggccgccgctctcctcgtcgtcgattcagctgcggtttttgcgaggcaggatgatgagacgatctcttctctactctcatggggtggaagctgcagatcagtgaggcaggagcaccggaacatgcacatatctcttctaagagtatatacaagagccttagttctgttactgttagagttggacatggggaggcagcaccgcaggagattgagtgcgtgttgccttaagggtagactgcgcaggtgaggtgacaaagagcatgcactgcactgcactgcaccacatatgtgcatcgaaggttgaagacgaccagcacc

SEQ ID NO: 16069 - DNA, 312 bp, Zea mays
  Clone ID: cC-zmpo148043c12a1
aaataaaaaaaaggaaacgggccagggtatatatttatgcacgtacatatacattacataaataacaattttggatgagggacttatttatatagacatgctttctttatttatataccattaatgatcatgttcttcaactcctactcgaggggttatgcattcatgcatgatgaacttttgagcccctttgattctttgtttttgggtattatttctcggaagcgaaccataaaaaagagagagagagaatattccatgaggggacacacaaggtttgttttataaggaaacgcgagaaaaactcccctc

SEQ ID NO: 16070 - DNA, 617 bp, Zea mays
  Clone ID: cC-zmpo148043c12b1
cttaacggcgtgtcgcacgtggacccggaaacccccgtgaagttcgtttagtacttcaacgccagcgacgggggggtcgagtacaacctcatcggggacgtgccgccctccaacacggcccccaccaagatggcacccaacgtcatcagcgccgagttccgcacgttcattgaggtggtcttcgagaaccccgagaagagcatcgacaccatccacatcgacggctacgccttcttcgccgtcggcatggggcccggcaaatggacggcagcgtcgcggagtacgtacaacctcctggacacggtgagccggcacacgatccaggtgtacccaaggtcgtggacggcggtgatgatgacgttcgacaacgcgggcatgtggagcgtccgctccaacatctgggagaggcagtacctcggcgagcagctgtacgtgagcgtcatctcgccggagcggtcgctcagggacgagtacaacatgccggagaccagcctccgctgcggcaaggtcgtcggcctgccgatgccaccgtcctaccgcgccgtctagagcgtcgaccgatcgcgcacggtgctgtacacaactaaaggagagcgagagggggacttttctcgcgt

SEQ ID NO: 16071 - DNA, 387 bp, Zea mays
  Clone ID: cC-zmpo148043d02a1
ggcaaacccaaagacttgggggggaaaaaaaagggggaaaaaaaatttttattttaacccccattacaaagattttttttgaaaaccccaatacaaggatttgagagggcctgcctttcaaaaatacatttttccatttatttggtccccttaaataccctttttttgaatttgtttttttgaggttggattgggtggccaaaccaccaggaaaaaacggggcctttttttttttatcccgcgggggggtaaaaagggggtaaaataacccccaaaacctttcctaaaaggagggcgttttcgggcattttttattcttttcacataaatcccccccgggaaaaaacctttatttaaaactgcctccccggggaatcccccccccaa

SEQ ID NO: 16072 - DNA, 485 bp, Zea mays
  Clone ID: cC-zmpo148043d03a1
gttctgcattttttttatcaaatatagggaaagggagtagtcaaaatagcataaaccaaccaacaaactaaaccatggtacgtacatgttagtgccacgtcatatcgacaacgcagcctgccgatcatatatcatcttccttagatgtcagtgtatcctgcccgattgctgctgcggcagcagccccgggatgaatggcacgccgagctgtgggagccagtgctggccctggatgaagctctcgacggtgtacttctgcagcgcgtgctggtaggtgatgttcttgatacccctccacttgacgcgtctggtcatgttggcgccgggcccgtggttttccacctcggcgtagtagcaggtgctgaggccgaagtcgccgagccacggcagccagccctgcgggtcgatgaacccgccgatcttcgactggatgtagagcgtgcgcgagtgctccttccacgggcggcccaggaaggttctgaacc

SEQ ID NO: 16073 - DNA, 511 bp, Zea mays
  Clone ID: cC-zmpo148043d03b1
gtccgcccacgcgtccgaaaacatagagtgtcgacttttctattggtgttattgttggcactaaatacctaccacattggggtcagggtacatatactgtgtttgtgtgttgtatgccgtatgcgtgtgtgagcttgcgcaaattggacatctaggccgtgcgtaccctgcgatgaaaggcgccgtcatcggcgcatcgaccgtcctggtcgtggcggtggtggccaccatctgcgtcgtttccttcaaaggcagcggcgatggcggtagggccgaggagggcgagatgtccacgtcggtgaagtccatcaagtccttctgccagcccgtggactacagggagacgtgcgagaaggcgctggaggcggcggccgggaacgccaccagccccacggagctggccaaggccatcttaaggtgacgtccgaccggatcgcgaaggccgtgcgcgagtccgccctgctcaacgagctcaagcacgaccgccgcacgtcgggcgcgctcgacaact

SEQ ID NO: 16074 - DNA, 448 bp, Zea mays
  Clone ID: cC-zmpo148043d04a1
gacgggggggataggtggtgagataaagttatatatataactcccattacaatgatttttttgagaaccccagtacagtgatttgagagggcatgcatctcaagattacatatatccattcatttgttccccttcactacgcttctttcgtatttgttcttttgagtttggattggatggtcagaccacgaggagaaaacgaggcctttgtcgttttaacgcgcgggggcgtaagacggcggcagcggcagccccactaccttgccgcaacggagggcgttgtcgggcatgttgtactcgtcgcgcagtgatcgcgccggcgagacgacgctgatgtagaactgctccccgagggagtaccgctcccagatgttggaatgcacgctccacatgcccgcgttgttgaacgttagcatgattgccgtccatgaccgcgggtacacctgga

SEQ ID NO: 16075 - DNA, 567 bp, Zea mays
  Clone ID: cC-zmpo148043d04b1
gcatgcagcggtcggcgggcggctacggttttcattttcgtggtcagccgcctcctcatcggggtggggttcgaccagcccccgccggagaacgaccacgtggtgctcatcggagactggtacaccaaggaccacgaggtgctagcccgccagatcgacgccggcaagggcgtgggccgccccgcgggcgtgctcatcaacggcaagggcggcaaggacctggaggccgcgcctgccttcaccttcgaggccggcaagacgtaccgcctccgcgtctgcaacaccgggatcaaggcgtcgctcaacttccgcatccagggccactacatgaagctggtcgagctggagggctcccacaccctgcagaacacgtacgactcgctcgacgtccacgtcggccactgcctctccgtgctcgtcgacgccgaccagaagcccggcgactactacatggtggccttcacgcggttcatccacgacgcccagtccgcgtccgccgtcatccgctacgccggctccagcgttccgccggcgccgaacatgaccgagccaccggcccgctgggcc

SEQ ID NO: 16076 - DNA, 334 bp, Zea mays
  unsure at all n locations
  Clone ID: cC-zmpo148043d05a1
attattatatttttttatcttcctttttttggggnttggtttattaccccaaaacttttttaccttataaaaaagttttgcacattgggctaaaaaaaatcctataaagggaaaaacaatttcttctccatttgcatgtttcttttttcgggcattatgttacatgggcccacactccttacattacctatgctggtatacccttacccacaaacgtacatgcgcttatccgatatcatttaattcagggccctaaaacattgcatggggcgaacaacttggcactgtttttcctgggctgcctgggggcaattccgacccctgggccgaccct

SEQ ID NO: 16077 - DNA, 219 bp, Zea mays
  Clone ID: cC-zmpo148043d05b1
cacgcgttcgaatcgcgacgagggaggccaggagaagcagtgttaagctgatcgcaccatgcaatgctctaggggcctggattgaatgctatcggataagcgcatgtacctttgtgcgtaagggtataacagcataggtaatgtaacgagtgtgtgcacatgtaacatgatgaccgagaagagaaaccatgcaaatggagaaggaattgtttctggctt

SEQ ID NO: 16078 - DNA, 526 bp, Zea mays
  unsure at all n locations
  Clone ID: cC-zmpo148043d06a1
gcaagttgcctcatcaggcatctcattaaaggtggggaggtcgaacatgtgtccaaaatgacaagtgagaagcattaggtagcaacaatagacattacagtcttgatgaataggagaaagcggctgccgacagaccggcagaaaactttgttcatgctaatgaagaaacagcaacaaaaggagaaagaaacggggcgggaggctggcgataatggctcctctcggcttgcatctcttgggcccaaagaattagaagcatttcctgtgcacgatggacgggccagactcgtcgtactcagccttggcaatccacatctgctggaaggtgctgagcgatgccaggatggatcctccaatccagacactgtactttctttctggaggagcaaccaccttgatcttcatgctgctaggagccagggcggngatttccttgctcatcctgtcagcaatgccagggaacatagtggtaccaccggagaggacgatgttgccatacagatcccttctaatatccacgtcgcac

SEQ ID NO: 16079 - DNA, 498 bp, Zea mays
  Clone ID: cC-zmpo148043d06b1
gtccgagggacacactgcctgcgatccgcatgcggcaagatctttccttattctccaaacatgagaggagcagggggggagagatctggcaccgccactgatgcggcaggagaggaggagaaacatgagaggagcgtcggcctgatggccggcctcatggacaaggccaagggctttgtggcggagaaggtgatgcaaatccccaagcccgaggctgccctggatcacgtctccttccggagcatcagccgcgagggcgtcgagctgcatagccacgtcgacatcagcaacccctactctcaccgcatccccatctgcgagatcacctacacgttcaagagcgccggcaaggtgatagcgtctggcacaatgcccgaccccgggtggatcgcggcgagcggcagcaccaagctagacctgccggtgaaggtgccgtacgacttcatcgtgtcgctgatgaaggatctcggaggggactgggacatctactacatgatg

SEQ ID NO: 16080 - DNA, 467 bp, Zea mays
  Clone ID: cC-zmpo148043d08a1
attgacatgacaccttgcatgcgagaagggggagatattcgctgactttacgtcaactgcatatatcatgtacaatttaactcctccttggcaggaaccatcaaggttggttacatctacagttacaggcttgctcctactttctcaacaaccaccatatcacatacaagagatggttcgtctctttcagcacttcttttagagttccatctgcttcagtagtctgcaaatgtcgatgaggaactcaagtgcaagagatggaaaattttggtctgctgttgagcccgatcagaagtgaagagcatgggtatttcctgcaacggcatccatcttcagatagatgggattgtgggcactcactggaagcacccttcttagtctgctgcatgagaagacctcacgatgacctaacagtgtggactcggggcaaaaccatttttcttagcgagttacaactctttgcaact

SEQ ID NO: 16081 - DNA, 622 bp, Zea mays
  Clone ID: cC-zmpo148043d08b1
ccgggaggagaaggctgcaatgcagatggaggctctgcagtacctgattatgattgaacagcaggctgaccacgaccaccgggcgagtcaggacctgcacgatttgcttacggagagggagaaagagttgcttgacttggacgctgagctcgcgcactgcaggaggctcctgcagaacgatccgttcaacggcgacggacgtaataatggcgctgacacagtgaacacaacgattgacggcagaaatccggcggcgatcgaatgcttggatggcgcggaccttgtggggagcgccatgtcgcttttcgaagacgagaaggcgttcattttggagtccttgagcagactggaggaaaaccttggcattttcacaaacaggcttgcttccggtgacgccagaggtagtcaagaagacgtgctgtttgaagagcatgagcatacaacagctgatgggtctccttccaacggtgacaagttgagcggcgtagcgaatcttaaggctgggatttctctgctcaatataagactgagggcacttgaagacgaccaggagtttctcagcaggtgttgagttcccttcaatgccgtagtgatggactgcagtgtatacaggagataagcg

SEQ ID NO: 16082 - DNA, 516 bp, Zea mays
  Clone ID: cC-zmpo148043d09a1
agcgcaacttttcgaagtttttctttcttttgggcggcgggcagattaggaataaattacttgatcgagcatgaaacatatcacatttcggcacgaaatcttaacaccatcgtgaccgtcgcaggaggagccgaggccctcgatcaacacgccgtcgtcgtgccagacagctcggccgtcgatcgatccgcatgcagacaagcacgtgcgcgcccgtcgtcgtaccacgcgcagcgtcgttacatcttgggtatggtggcggcgacggcggggccgctgttgtaggcgtcgcaacgccgtctgaccttgccgtcggcgccggtcttgacgccgaacaagctgagcttctccatggcgcggccgaagtcgtcgaagaaggctgtggcgttggatgcataaagctgcaccaggggctttgtgcgtgggttcgtccacagctcctcgtcggtgctgaacaggccgaggccgcgctcgagggtgacgaagtacatggttgtcaacttgccgggcgttatg

SEQ ID NO: 16083 - DNA, 611 bp, Zea mays
  unsure at all n locations
  Clone ID: cC-zmpo148043d09b1
ccgcacgcttccaaaagttaggaggggaacccatcagccaagagctactttaactcacagcgatgcacaagcacgagatggcaggggccatgcgcctgtccctcctcctcgtcgtcgtggccgccctctcggcgcgcaccgcggcgcagctgccgctggcgggcggcggcggcggcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgtccacccagttccagaagtcggagcacgacgcggagatcaaccactccctccccggggacgccttcgacgccgtggtgcgcgccaagctggccctggagctggagtgccccggngtggtgtcctgcgccgacatcctcgcactggcgtcgggcgtgctgattaccatgaccggcgggccccggtacccggttccgctggggcgcagggactcgctgtcgtcgtcgcccacggcgctcgacgtggagctgtcgcacgccaacttcacc

SEQ ID NO: 16084 - DNA, 310 bp, Zea mays
  Clone ID: cC-zmpo148043d10a1
aaagcatatataactcccattagggggagggttttttaaaccccattacagggatttgagagggcatctcaagattacatcaatagatatatccgtgcgttctcatttggctcacccccacccaacgtcccttctcccttccctaggcttccttcgtctttgttctttttgatgattttatttcgccgagcagcacaggaatggattagttagactggatggtcagaacacgaggtgaaaacggcgccttcgtcgtctttagcgcgcgggggcgtaagatggcggcagcggcagccccacgaccttgccg

SEQ ID NO: 16085 - DNA, 317 bp, Zea mays
  Clone ID: cC-zmpo148043d10b1
ggaaggtcgtggggctgccgctgccgccatcctacgcccccgttcgcttaagacgacgaaggcgccgttttcacgtgggggtctgaccatccagtctaactaatccattcctgtgctgctcggcgaaataaaatcatcaaaaagaacaaagacgaaggaagcctagggaagggagaagggacgttgggtgggggtgagccaaatgagaacgcacggatatatctattgatgtaatcttgagatgccctctcaaatcactgtaatggggtttaaaaaacaatcattgtaatgggagttatatatacttttatcttaac

SEQ ID NO: 16086 - DNA, 374 bp, Zea mays
  Clone ID: cC-zmpo148043d11a1
acatccttcaaccatatcggggggagggggtgagcctactgtaccttatgggggcattacaataataaggctgttgtttctattttacagataaactaagtgttatatatgatggtactgaattctacattgagcatagaatgatcataaattgatatgatcaaaatggcattaaaaaccgacgagattggtgcggtggaggccgttttccagtggcatttggcattggctggacaagggaacaggacctcatccttctaccttcttcaatttcacaacagaagagttgtgtttttttgagcgcaaaaagcccttatacaatttacaggagacttgtatggttcctgtgattacaaaggctcttttgttacaat

SEQ ID NO: 16087 - DNA, 553 bp, Zea mays
  Clone ID: cC-zmpo148043d11b1
tccgggcggacatgtacccggaggccgtggagcgggtgatcctcgtgtatcctgtcgtgtgcctggaggagggggacctgggcgggggcctgttccccgtccccgacgtcgctgaggcggccgatctgctcgtcccccgccggccggcggaggtgcgccagctactcaagctcaccttacgccggccgccgcccatcatgccctcctgcttacttaaggattacatcaatgtgatgggctcacaccaccttgaggagaaggtctagcttttacacgctcttatcaacgataggaaactgtcagatcttccaaagataaaccatccaacgctgatcatttcgggggagcaggatcaggttttcccaatggagctggcgcataggttggagaggcatcttggggagagttctagattagtagtcgtaaaaaacgctgggcacgcgggcaatctagagaagttcaaggaagtgtgcaagaacatcattgactattttcacgaaccggattaaagtgattgaaactggggggaaaggaagtgaaaccacaatgagac

SEQ ID NO: 16088 - DNA, 486 bp, Zea mays
  Clone ID: cC-zmpo148043d12a1
gacaatacgctctcacaccatgcattaagcaatgggggatgggatcattgtccaaaggacttttcgagtttcaccaggagaaacagccaaaggaatgcaaatggtgaaggtacaaatgtcagccctcctgttctccgacccctctgtttgcaagtctcagtcattgtacatacacacaaacatgtgtgcgcgcgcgcgcgagcgtgtgtgccacctcactatatatgatgtgatgtatgccatgccatgcggcctttagaacttgaaaccaagtatgtgcggcgcgccggtgtacttgagccacatggcgccgtcgatgaacggcccggcggtgaacggctcggcctccttccgttcgatgacgtggaagccgggcccattgaccctcttgctggtgcccgccccgggcccgcggttgttgtactccgcgtattataacgtcttgagggccaaaatccccgtccagggcatgtaccccttggcttg

SEQ ID NO: 16089 - DNA, 619 bp, Zea mays
  Clone ID: cC-zmpo148043d12b1
gcccacgcgtccgcgacgcgttccaggacacgctgtacgtgcacgttcggtggcagttcttccgcaactgcgtggtcggcggcgccatcgacttcatcttcggcaactcggcggcggtgttccagaactgcctcatcatcacgcggcggcccatggacaaccagcagaactcggtgacggcgcacgggcgcaccgaccccaacatgaagtccgggctcgtcatccagaactgccgcctggtgcccgaccagaagctgttcccggaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgccgggccgttcatcgacggcgccatgtggctcaagtacactcgcgcgccgcacatacttggtttcaagttctaaggccgcatggcatggcatacatcacatcatatata

SEQ ID NO: 16090 - DNA, 456 bp, Zea mays
  Clone ID: cC-zmpo148043e02a1
aagccaaaggcggtttccttctcggacccggccgggacgggctggtctggggttgatggtagcgacagccaggaggctggcgcggaggaggcggcggtagaggaggaggtggtgaggctgtcgccggagctggcgatgcacggcgccatcgagccggtggcgctgccgtcgtcgacgtcgaggcggcggctgtccatcagcgtgagcaagaagctgagcctgaatatcccggacaagctgcggctgagccggcgggagcacaaggaccaccaccatcacaaggtggagtctgaggacacgctgtggaagaagggcatcatcctcggggagaagtgcatgatcccgggggagcgggaggcggagtgcgctgaccccgacgacgacatcgccgtcgtcagctttcgccggtccagctacttccggcccgtgttgcggtcgagctcgttcgccatgcac

SEQ ID NO: 16091 - DNA, 507 bp, Zea mays
  Clone ID: cC-zmpo148043e02b1
gtccggttctagatcgcgagcgggccgccctttttttttttttttgatatttaaatttctttgtttccaaactggggcttgggtcggtgactgtccatgcatctagaccagaccacacgatgacacaagaaaattttagagcaaacatctgaatctgattatctgaatgcacttcacaccacactagcatagtagcatccttcgccggttttgacgcggtgacgcctacacgtacacctaatctcgggctgtcaagtatccgaggcgtgcaaggcgggcccgggggcgtcgtgctgcggctggtgcatggcgaacgagctcgaccgcgacacgggccgggagtagctggaccggcggaagctggcggcggcgatgtcgtcgtcggggtcagcgcactccgcctcccgctcccccgggatcctgcacttctccccgaggatgatgcccttcttcacagcgtgtgctccgactccaccttgtgaaggtggtggtccttgtgctcccgcc

SEQ ID NO: 16092 - DNA, 265 bp, Zea mays
  Clone ID: cC-zmpo148043e03a1
gggatcctatagggcaaccctcctttttctttctttactaatagcttttgaaaaaaaataatatcattctgggttcggggtttattttattatcccttcatacccaaaaaaaaacatattcaaaaataaacttatagcaacaatgcaattcaaaaaaagtatcccttttttacaaaaaaacgaatcttattttaagtgacacctataacccaaacccatttcatctatcaggctcaaactgacccaacgtcgtcagaataaaaat

SEQ ID NO: 16093 - DNA, 416 bp, Zea mays
  unsure at all n locations
  Clone ID: cC-zmpo148043e04a1
gttaataaaaataaaaaaaaagcnggggtnggagagcatatattagcagtacatctgcatgcatgcatatttaggcccatcaaaagaagcggatcgaacgtttgcttacgaggccaggcccattatcgctgccctcgaatgcagtgcatagacatacacaatacaaaaaacgcggaaggcagctaccatcttcaattcttgggcgagcgggcagggcagcaatggatgcaggcatgcacaggacggaggacgatcatggcgtctcggaggcgtccttgagatcgtacttctcgaggagggcgccgcactccttgagcgggtccttgcggaagaaggcgatggggttggcgtatcggacgccctgctgcttgatgccgatgttggaggtgagcgggactcgggcgcggtcgcggaac

SEQ ID NO: 16094 - DNA, 343 bp, Zea mays
  Clone ID: cC-zmpo148043e05a1
ataaagggaatgggttttttttattttttttttttttttttttttttttttatttttttttttttttttttaaataattaaaactatcatattaatttttcacaaaaaaaaacaataaaccctctaaaaaaaaaaaaaaaaaatttaaaaaaaaaaaaaaaacaaacaccaacaaatcagaaaaaaaaaaaaaaaaattttcccctcccaaaaaaaaaaaaaaaaaagaaaaactacttttttcctaataaaaaaaaaaaccacattcttttcttcttaaaaagaaacttttttttttccccaaaaaaaaaataaacacccccctcctctttttaaaaggaaa

SEQ ID NO: 16095 - DNA, 502 bp, Zea mays
  Clone ID: cC-zmpo148043e05b1
gggcgacccacccgtccggaagaaacttacgaggattcccctagtaacggcgatgcgtgggcttccttcgttttccgcgggaagaagagaggagggaggaaagggaaacatgattgtgtgttcgatactacgattacgaacttcgttttcccttcttttttgtttgtttggaaggggaaatacttctcttctattctacaacaatgtcacgtacatgcaatgtaataataaaaaatgtatgtgatatatttaacaatgtgattgatgattgataaaaaaaaaaaaaaaaaaaaaaaaaaaaaaaaaaaaaaaaaaaaaaaaaaaaaaaaaaaaaaaaaaaaaaaaaaaaaaaaaaaaaagataaaaatattaaaaaaaaaaaaactctctataaaatataaattaattataagggggcgccttttttaaaaaaactatttttcttgggcgggccttgaagatctatttttttttttggggcccccaaatatctattttgggg

SEQ ID NO: 16096 - DNA, 456 bp, Zea mays
  Clone ID: cC-zmpo148043e06a1
cttattaataaaagcatcgagtcacgaggacgggacaaacctttcgacaattcacacgaccaccaaacgaacgaacaaacaaacaattaaccaatcgcaaaccacgtaaataaaaaaaaacaattaattaatcggatgaaccaaacacgatgcattccaacgttgccgccccgcgcgtcgtcgctcattggaggtagtaggcgaggaaggaggcgacaagcgccccggcggcggtcacggtggcggcggcggcgccgattgcgctagggccagtcgcaccaccggccgtgccggtgggcgcctcggagggcgcctaggaggcgaccgaagccagcacggtggtggccgaggcggcggttaccagggcggagcataagaccttcttcatctccatggctggcgggtggatcacttcatcgctcctgaatataatggtccaaggaacctggcgttcga

SEQ ID NO: 16097 - DNA, 479 bp, Zea mays
  Clone ID: cC-zmpo148043e06b1
gtgcgataactaataacatctcctcgaacgccaggttccttggttcactttatccaggagcgacgaagtgatccgggcgggggccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgattaattaattgtttttttttatttacgtggtttgcgattggttaattgtttgtttgttcgttcgtttcgtggtcgtgtgaattgtctaagggtttgttctgtaatcgtgactcgatgctaatattattatg

SEQ ID NO: 16098 - DNA, 242 bp, Zea mays
  unsure at all n locations
  Clone ID: cC-zmpo148043e08a1
aacaccaaaaactcttttgtgggcncgggttcatttacaaattccttttttcccccatcatgttacaagggcacacacttatatcaatacctatgccgatatcccctcccgcacaaacctacatgcgctaatccgatagtattcaatttacgtcgtaaaaaaataatatggagcgatcgacttgacactggatttcctgccctcccttgtcgcgaaaacttttaatccaagaacagccccct

SEQ ID NO: 16099 - DNA, 441 bp, Zea mays
  Clone ID: cC-zmpo148043e08b1
ccgcaccaccacctgctccggtgagctcgccacctccaccagttttcctataccacctccacctgcaccatcaggcctgcccgtcggcacctgaggagttcatcttgccaccaatcatggcgcagcagtatgcgtcgccaccgccgcctttgttccaaggatactaagcggtgatcacagcgcgctctactgacgatgagagtaatcgcgacgagggaggccaggagaagcagtgacaagtcgatcgcaccatgcaatgctctagcgacctgaattgaatgctatcggataagcgcatgtacgtttgtgcgtaagggtataacagcataggtaatgtaacgagtgtgtgcacatgtaacatgatgaccgagaagagaaacatgcaaatggagaaggaaaaataaaatataaaattataaaaaaaatataatttataatttg

SEQ ID NO: 16100 - DNA, 325 bp, Zea mays
  unsure at all n locations
  Clone ID: cC-zmpo148043e10a1
ttttaatttatatttttttttccaaacccccacncacgcccgggaaaggaataatttaacaaaaaaaatttgaccctcatatttttaaaatgggatacccggccgaaaaatggttcccctatctgaccaggaacaaaaaattggccgaagaaccaaactttttggtcggtaattcaaaacatgcatgcatatcataggagggaccaaaattcgtgtgtgccgccactatttcatcactcatgcagtcaaaacagtgcttttccccgaggtcggcgcttgcgcttgtacacttgctccataaactggggcatcaggagacggggcc

SEQ ID NO: 16101 - DNA, 602 bp, Zea mays
  unsure at all n locations
  Clone ID: cC-zmpo148043e10b1
ccgccacagaccacaaaggaggggacacacacacacacacactttcttttcccgcccgccgcgacgcgccatggcgatgggtcgctccgtcgcgcacctcttctttcccatcctccttatctccaccgcgcccgccgtgcgggccatcaccgacgccgtcggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccgaggacatcgaggaagccgtggcgcacctcagcgccctctcccgcgacttctccgacgccaggttcctcgaggtcaagtcctggctcaccttcacgctcggcggcaccgtcacctgcgaggacgcctgcaaggacgcccccgtcagcgacatcaagaacgtctgcataaccaagagcttcgagtntgagaagctgctgcgcg

SEQ ID NO: 16102 - DNA, 534 bp, Zea mays
  Clone ID: cC-zmpo148043e12a1
aatatagaatataaaacgattgtgctggggctttcataatcatgcctcatgaaaatcgaggttacatcacatgttcgttctgtaaataaatagtacaagtttagccttttttcgccaacatcaaatactaatggtctaaagtctttatcacatgcccacttcggtttcgttgacatctttggacgaatactcaagtacctccccctcaatcttctcaaggaaacggtgcatgaccactagactctcgtcatcgagccttggaactgtgtggccctttggatgacggattacgaatgggtccacgcacgattctatcagcttttcaccatggactttcaggaagtcgttttcaccgatgaagtgaagcgaggggcatgcgatcttgttggcgtacgccttgctggccaccgtcggtgactggaacttggcgcccccgatgatgatgaggtacttgatcttcgggactctagtcagggccagcccttgtttttggagcccccgaagcgccccccacagaatggaaccctgggagaa

SEQ ID NO: 16103 - DNA, 614 bp, Zea mays
  unsure at all n locations
  Clone ID: cC-zmpo148043e12b1
ccgatttcgacaagtgcctggcctacatcgaagagctgatgattaaagtcggccccttcgacggactgatggggttctccgagggttccattctgtcggcggcgcttccggggctccaagaacaagggctggccctgactagagtcccgaagatcaagtacctcatcatcatcggtggcgccaagttccagtcaccgacggtggccagcaaggcgtacgccaacaagatcgcatgcccctcgcttcacttcatcggtgaaaacgacttcctgaaagtccatggtgaaaagctgatagaatcgtgcgtggacccattcgtaatccgtcatccaaagggccacacagttccaaggctcgatgacgagagtctagtggtcatgcaccgtttccttgagaagattgagggggaggtacttgagtattcgtccaaagatgtcaacgaaaccgaagtgggcatgtgataaagactttagaccattagtatttgatgttggcgaaaaaggctatacttgtactatttatttacagaacgaacatgtgatgtaacctcgattttcatgaggcatgattatgaaagntacagaataatcgtnttatattctatattacctnng

SEQ ID NO: 16104 - DNA, 431 bp, Zea mays
  Clone ID: cC-zmpo148043f01a1
ttttatattatatttcttttccaacccacctttttttgggaaaggtttttttttttttaaaacaaactcccttcatccatccaaacactaaaacattttttcccgaaccaaattgggaaaagacctctctaacacaaaaccaatttcggttaaaatcaaaactattacctccatcccccaagcggatggatcaaagaatccctcaaagcccccccccttaaacaattctaacttaaactgctcaaaaaaattggtaaaaaacccccccccccccaatccaatggcatggggacaactgttgacacccggatccccccccacaaaaccctttttctggaccctatccatttggagcaaaacctcaaaaaaccccttaacggctggtcaaccccacctcctttactctaaaaccaaaccccccctctaacggc

SEQ ID NO: 16105 - DNA, 516 bp, Zea mays
  Clone ID: cC-zmpo148043f01b1
acccgtgcgtaccctcgaagccgaaggcctcatgccttctcttccttctaggctttgaggaagtagctgtttcgcctgggggcggggccgccgtaatgctggacaacaatggcgcccacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccattgcttgacgatggaatgcaccactcccgtatcctccagtagcccttccactcgcaagaagcgcggggcgttcagcctcttcagggcgatgttcctgtccttcggccggagcgacgacagcatgaagaagacagacgacgacaccacgagccccaagaagagagccatcgcggctgctgatgacgattgcaagcctgccgatgacgagtcaacgtcgtggaagcgcctcgtggacggtatgcgcccgc

SEQ ID NO: 16106 - DNA, 411 bp, Zea mays
  Clone ID: cC-zmpo148043f02a1
aaaacaataaaccaggctcagcgggatggatcatttcatgactcacataactttccacaaaataaataattaaaccctcgcctaattcacttacttttaatcaaaaggaaaatagagagagagagagacaagaggtaacccctgaatttggttggtatttggagaataaattttataccctcaaattcagggtgttacaccgtctaacataatatagctctcggatgtctgtcgttttactgttgtgcgttaccaatggatatcatctaatgggcaatgcacggacgacagaaaaattataactacagacatgggtcagtcgacggagggtctacaaacatgcaaactccttgaggcaacccttggtgctgcccttggcgttcgtgcatatagccatggttttgttgttgg

SEQ ID NO: 16107 - DNA, 542 bp, Zea mays
  Clone ID: cC-zmpo148043f02b1
gtccggtgacggcgcccggggacagccccaacacggatggcatttcacatttgcgactcatccgggatcacgatcgggaagggggtcattggcgtcggcgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgt

SEQ ID NO: 16108 - DNA, 446 bp, Zea mays
  Clone ID: cC-zmpo148043f04a1
cccgggcaccggcacaagggtccggtaaatgatactgcttcggatagtttaaaaatcaaggccttccaactgcaacagtttgcaacccagcatgcttaaaggtatttgtacagttttctgaacacaatctccttcccactcaagagtcaagacgttcggctcaacttcaaacttttaaaacattgacaagaactgtacagggaaagaaatgttggctaggatctcatcaggaaaatatatacattcgctactttggaaaacagggcattgtagcaccagagttttggcatcctccactcgacatcaatatgtagattgagctacgaacagatttaattccttcagttcctcatgtcgttctgcgtcttcagcaatcctaaaatactgaaatttggtctgcacgccaaggccggtttgcaatgattgctcatgagccggagcgggag

SEQ ID NO: 16109 - DNA, 587 bp, Zea mays
  Clone ID: cC-zmpo148043f04b1
gtccgcgtttttgtttgtttcattacatccacgaacaagggcagtttggtttcgaccggccggttggtgccattggggtgcgggtctcctcgccgcttctgacgcgtgcgtagccagcgttcaggtgccgtgctgatccgccgacgatgccgggcaaccaccaggagggccaagggccgccgggcgccagcgtgtgcttgtggctggtgacggtgctgctcctcctctccctgctcggcggcggcgcgtgcctcgcggcctacatcctgctgccgccgcacgaggcgccggcctggctcgccgccgtcggcctggcgctcgtcgcgcttccgtgggcgttttggatcgtcacgtgcgcgtaccggtgcgccaaggtgcgggccaacgagagcagaacgatggccgtggcgccggcctctggcagcatgtgctcccgctccggctcatgagcaatcactgcaagacgccttggcgtgcagaccaaatttcagtattttaggattgctgaagacgcagaacgacatgaggaactgaaggaattaaatctgttcgtagcttaatctacatattgatgtccaggggaggat

SEQ ID NO: 16110 - DNA, 413 bp, Zea mays
  unsure at all n locations
  Clone ID: cC-zmpo148043f05a1
acaacaggaaatggtttttttttaaatattttttatcccatttcccccattcattaactaaaccctacatntaacaccaaaaaaacaataaaaaaaccacctaaacattaaaaaaacaaaaaaaaaataaaaacaaaaaaaaaaaaaaaaacaccttaaataatatataataaccgaggaaaatattaacacaaaaaaaaacatacattcattgaaaaaatatacggattctattaaaatttacctatcacctaaaaaacaaaaaaatgggtaaaagggcgggcgaaaaaaaataaaaaactccaacccaacctaaaaaaaaaaaaaaccaaaaacaaaatctaaaaacaataaaccaaatccccaaccaaaagaaatctccctcccacaaaaaaaatactcaaaaaataaaa

SEQ ID NO: 16111 - DNA, 398 bp, Zea mays
  unsure at all n locations
  Clone ID: cC-zmpo148043f06a1
ataaaggggttgggttttttttttccaaacccaagagttttttccaacacaaccttgcattgttacaaccgatccccaatgaaaaaagctgcaccctaaagctgcacacccactaacacttcctgccaacccggaaattgacccccccggcttccctggggagcaactcggagaactggccccccttggcctggaagaggacaaccctgccgaacttgccctcgttctggcccccggactggttaaaaaaggcccctttgaggaacagggggtccggggacttccacacccagtttttgtacccgctgaactgggggaccccccggtgggacaccttcttaaacctgctgncatacacggcccgaaaacggttgccctggttgaaaaagggggggttc

SEQ ID NO: 16112 - DNA, 583 bp, Zea mays
  unsure at all n locations
  Clone ID: cC-zmpo148043f06b1
gtccggtggacggctccaccgccatcaccgtctccaacggccatttcactttgcacgaccacgttatgctgttcggggccggggacgcctcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgtcgcgtcngaggaagtgctagtgcgtgtgcagctttaggctgcagctttcatcattggcgatcgatcgtacaatgcaa

SEQ ID NO: 16113 - DNA, 380 bp, Zea mays
  unsure at all n locations
  Clone ID: cC-zmpo148043f07a1
ctcggggttngggttttttttttttttttttttttggaaaaaaccccccccccccatgcattaaacaagggcgcaacaaaatattgtccaaagggcttttggggtttcaccaggaaaaaccccccaaggaatgcaaatggggaagggacaaagggccccccccctgttttccgacccctttggttgcaaggttcaatcattggccaaccccacaaacatgggtgccccccccccccaacctgggggcccccccactatatataaagggaggggtgccctgccatgccgcctttaaaacttgaaaccaatttttggcggggccccgggtttctttaaccaaaagggcccttaaaaaaaccgccccgggggaaaaggtttgg

SEQ ID NO: 16114 - DNA, 643 bp, Zea mays
  Clone ID: cC-zmpo148043f07b1
ccgcaaaaatggcaaaggctctcctaggtggcctatcggcgattctcgtcttggcggtggtcgtcggtgtggtcggcacgggcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccgccgacgacctgaggggcatgctcgagatggccggcggcgacatcaaggtgctgttcagccggtccgacgacctcgagacctggctcacgggcgtcatgacgttcatggacacctgcgtcgacggcttcgtcgacgagaagctcaaggccgacatgcactccgtgctgcgcaacgccaccgagctcagcaacaacgcgctggccatcaccaacagcctccgcgggatcctgaagaagatgacctcggcatgttc

SEQ ID NO: 16115 - DNA, 499 bp, Zea mays
  unsure at all n locations
  Clone ID: cC-zmpo148043f08a1
acaagaaaacaatacttggaaggggtgggggtgtttaacatacaaccaacaaaagctagacaacatcatctggttctttaccagctaagctagtaataataggactcaacatgacacatacttcaaattgttcaacatgcaaccaacataaacgatccttcattccatactcctacatttatttgactaccagctaagctagtaataataggagctgtcgctagagtaatcacgtccgtcgtcgtagccgacgtagccgtcattattgtttggtgatttgtagtcaattggaagcacatcatctggatctgcagcgtcctcatcatgacatgggtctatggttcacagctcccacttggtttccagtgctagctgatcaaaggtccttggtgaggtccttgaactcaactaaggcccaagtaaattcattgaactctggtgagttaaatggttggaaggcaccgtgcatgacatctacaatgtcngcacaacgctacag

SEQ ID NO: 16116 - DNA, 634 bp, Zea mays
  Clone ID: cC-zmpo148043f08b1
ccggttcaggcaccgcagcagtccctcgccggagactcgccttcaccttacgactttgacatcagctgccttgggtcaggattggtgccgaaaaaaggaagcgcaaccgtcgcacgtatcttcatcgtcgttgatccggtcgtccgctctagatccgacccgagcaagaccatggattcggagaacgaaatgcttcgaaaagccctggctaatttggtgagagctgtagcgttgtgccgacattgtagatgtcatgcacggtgccttccaaccatttaactcaccagagttcaatgaatttaactgggccttagttgagatcgaggacctcaccaaggacctttgatcagctagcactggaaaccaagtgggagctgtgaaccatagacccatgtcatgatgaggacgctgcagatccagatgatgtgcttccaattgactacaaatcaccaaacaatgatgacggctacgtcggctacgacgacggacgtgattactctagcgacagctcctattattactagcttagctggtagtcaaataaatgtaagagtatggaatgaaggatcgtttatgttggttgcatgttgaacaatttgaatatgtgtcatgttgagtcctattatactagctt

SEQ ID NO: 16117 - DNA, 507 bp, Zea mays
  Clone ID: cC-zmpo148043f09a1
gattgtaaaaatatttttttccttatggggtgggggtatatttttacacttaaatctaccacatgaatcttgatagatcgaaagagaaagataataacgattaaagatatgttttacaacacagcttgctgatgttggtagataacaacattgttttttttatgagaaaaataaagggtgtaattgggagtgtcttgacatatgcacaatgcacctgaacctgagtcaattgaccgcccctgatacatttccttgccaaaatgtggcgacctatacacaaaacatggaaaactgggtacagttctcgtgttctctgttttagtcgagtttgcaggcagtagacacatcactcaatcaacatcttgttgttctttgacggctgcagcagcaagtggaccattgttactaccaagctttagtgacgcgtccctgaacatcttgcggctgagggtgttgaacaccgctctcgagtactgccgcgacgttttccttcgtccacttcagctt

SEQ ID NO: 16118 - DNA, 555 bp, Zea mays
  Clone ID: cC-zmpo148043f09b1
gggaagggcctggccgcggaggccatcgccgaggagctgtttcggctataccagctcggcgaggagctggggggcggggggttctgtgtgacgcggcggtgcacggacacgtccacgggcgaggtgctcgcgtgcaagtccatcagcaagcggaagctgcgcagcagcgtcgacatcgaggacgtccggcgtgaggtggccatcatgaggtcgctgcccgagcaccccaacgtcgtacgcttgcgagaggcgttcgaggacgccgacaccgtgcacctcgtcatggaggtctgcgagggcggcgagctttttgaccgcattgtctcccgcgggcactacaccgagcgtgcagcagcctgcgtcatgcgcaccatcatggaagtcgttctgcattgccacaagcatggcgtcattcaccgggacctcaagcctgagaactttctgtatgccaacacatctgagaactcggctttcaaggtcatcgactttggtctctctgtgtgctttcaaccaggtgacaggttcagtgagaacgttggatccccctactatatg

SEQ ID NO: 16119 - DNA, 384 bp, Zea mays
  Clone ID: cC-zmpo148043f10a1
gaccacaaatcaacattaacaggggggggggggattacagatatacactagcatactgaataagttccaagattgtgaggcgtcggtctaataataattacatcggttggttttgtgatgatccaaagaagaaagaaaatacaaaccagcggattatatattcggtggagacttgagagtacgtgagaaagagagaggttaccaagagtgattatatatataatatatgcatgttagtcaattggttcagatgcaggcgagctcctttgccaagccgatggacttgccgatggcgttcttgcagacggccatggttttgttgccggatccattgtacttgatgtcgacgttgacgagctgcaccccctggcatggcaggttgtt

SEQ ID NO: 16120 - DNA, 613 bp, Zea mays
  Clone ID: cC-zmpo148043f10b1
ccgcccacgcgtccgcccacgcgtccgcccacgcgtccgggccttcattttcctgtacgagggcatcaccatggagaatggctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataatccgctggtttgtattttctttcttctttggatcatcacaaaaccaaccgatgtaattattattagaccgacgcctcacaatcttggaacttattcattatgctagtgtatatctgtaatcccattccataatgttaatgttgatttgtggtc

SEQ ID NO: 16121 - DNA, 326 bp, Zea mays
  unsure at all n locations
  Clone ID: cC-zmpo148043f11a1
ggtcaaataatattaattggggggnggggtatttttttaatttttatttttcccttttactatttttaaaataatttttttttttttaaaaaaaaaacccccgggaggtttaaaaaaaaaaccccccggggggaaaaaggggaaaaaaaaaaggttgtctatttataaaaggaaacgaactttcttccccaaaaaaaacaagttaccaaaaaggggggatatattcttttgccccaacattaaaaggccaataccaaaaatgaggtgacaaaaaatcttaagggggggctccccatttaacataaaaaattccctcccgggggttt

SEQ ID NO: 16122 - DNA, 605 bp, Zea mays
  Clone ID: cC-zmpo148043f11b1
ccgcaacaattaagcctccccgaccgccacatctattaggtgcttccatttgtgcctgtgcaacgaagcctaagaggctgggggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaggagatatagatggagaaggagaagccatcgctaagctaattgactgcatgtcaattggctgatgcctgatgatcaatgtgcaagaaagagatcgaccactaattggcatacatgtttaagttcggagagagactcggtcaccttgtaaacaaa

SEQ ID NO: 16123 - DNA, 388 bp, Zea mays
  Clone ID: cC-zmpo148043f12a1
ataattcgatagcaatatactggttttggcgggtgggggtgttcacaaagtgtgacgcacaaatactcccaccacaaagatatacaatacaagcatacgagcagcaatctggatgcctcattcaacagcaacagcacacaacccaggtagcacagcctgtggcttccccctgcccctggtgaaacccctggtgccatcatgcatgcgggggcctggtggaagcttgttggccccaataggcaactgcggatgcggctcaagcttggtttatatgttatgcggtgtatttccaacaaagtgaaggctgtcacggatcccaccaaggcggttgttgccatggctattgtactgcggctggttgatctggtggtgcctggttattgagatg

SEQ ID NO: 16124 - DNA, 620 bp, Zea mays
  Clone ID: cC-zmpo148043f12b1
ccgcgaagcccttgtacccctcgccgccgctgctgctagggattttcttttcgcgcgcgcctacaacgagagcgggcaggagtagcggccgttatcttgtcgctccggatccgttcgtgtacccaagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggagttcgtgccgcgggggccgccgccaccggcaccggcggttgtgctgccgcctccgccgcaggtgatccgcatgttcgccgcgcctcccccgccgtcgcgtgggggcttcttcgccgcaccgcagccccggccgttcgagtactatgcgcctatcggtgaacgcagcggatttgctgccaaggagcaacaggcgccggagctggaagcggagatgctcccgcccgccgcggtgaagacggagccggtggtggatgggctcgacgactaggtggtgcacaagatcaccaagcaggtggaatactattttagtgacatcaaccttgctactacagaacatctgatgagatttattac

SEQ ID NO: 16125 - DNA, 525 bp, Zea mays
  Clone ID: cC-zmpo148043g02a1
gtggcatgaaatttagatcatgtatagggttgggatggaattatagatccacactagtagaatgaataagaaagttcgcagattgccagaggcctaaaaaaagactggcgagagtgagaaagagagaggtgacgaagagtgagtgatggatgcaagtaggttcagacgcaggcgagctccttcgccatgccaatggacttgccgatggcgttcttgcagacggacatggtcttgttgtcggacctgttgtacttgatgtcgacgttgatgagctgcacgccctggcagggcaggttgttggcgcagttgagcgtgatggcctccggcgtgttggaggtgccgtggatgttcttgaagacgacgtcgttgacggccaccttggaggcgccggactagacgcagatgttgttggggcagtacttctggtctatgatgatggggtaggagacgttgtccatggtgacgttctggtacaggaacttggtggccttgagcgacgacttggagtcctcgtacgacttgatg

SEQ ID NO: 16126 - DNA, 548 bp, Zea mays
  unsure at all n locations
  Clone ID: cC-zmpo148043g02b1
cccgtccgacgctgctgaacagcaagttcttccacatgaacatcttttggagtttagaacgtggtgatcgacaaggtgaggatggaggcccccggcaacagccccaacacggacggcatccacatcggcgactcgagcaacgtgaccatcagcggcaccaccatcgccgtcggcgacgactgcgtctccatcggccccgggagcaagaccatccgcgtgaagggcgtcaagtgcggcccgggccacggcatcagcgtcggcagcctggggcggtacaaggacgagaaggacgtggaggacgtgaaggtgacggggtgcacgctcgccggcaccaccaacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgcctccaaagtggccgtcaacgacgtcgtcttcaagaacatncacggcacctccaacacgcc

SEQ ID NO: 16127 - DNA, 334 bp, Zea mays
  Clone ID: cC-zmpo148043g04a1
atacaatatcggtatataatcgctggaagggggaacgccgggtttcctcgacctagctcgcttcggtctgaaggatttgtttggtccacccatttcttcttaatggaaaacttgtgccctggtacatgttcgtgtagaaaagaatacacacatacaccggttgggtacgtaatccacacatactagcacctttgtggtgattcgaaggcaggacaggaaccccttgctcttgcattggcgaatatgcgcgccgcgccgccgcgccaccacactagctaggcagatcttcgcaggtacgccatgacgccgatcccacgcgtccgcggacgcgtgg

SEQ ID NO: 16128 - DNA, 341 bp, Zea mays
  Clone ID: cC-zmpo148043g04b1
gtccgccacgcgtccgcggacgcgtgggatcggcgtcatggcgttccttttaagatctgcctagctagtgtgggggcgcgggggcgcggcgcgcatattcgccaatgcaagagcaaggggttcctgtcctgccttcgaatcaccacagaggtgctagtatgtgtggattacgtacccaaccggtgtatgtgtgtattcttttctacacgaacatgtaccagggcacaagttttccattaagaagaaatgggtggaccaaacaaatccttcagaccgaagcgagctaggtcgaggaaacccggcgttcggcattgatagcgattatataccgatattgtttg

SEQ ID NO: 16129 - DNA, 408 bp, Zea mays
  unsure at all n locations
  Clone ID: cC-zmpo148043g05a1
tttttntttattattttttttttttttttttttttttggggtggggttttttttttttttttttttttctttttctcaagttggcccagttttaaatggggggaaaaatttatttaaaaaaaaatttttttttctaaactgggaacaacaacaggaaaacctttttgtcccaaaaagggggggggaaacatttttttcctaaaacggggaaaaaaaaaaaatagggggggcaaaacatttttgttttaaaaaaaataaaggattttaccccacccggtctgggaaaattggaatataaaacctccccaaaggggcagggggttgggccaacacaaatttttctattaaatccggaaggcctgccaatgtatatttggagctcttccaaaggagcccccttgggggtat

SEQ ID NO: 16130 - DNA, 607 bp, Zea mays
  Clone ID: cC-zmpo148043g05b1
gtccgccacgcgtccggttttatccggaacattcgttcgcgccgtctgttccaccgtccgaactccgacgtggggggcggggcgccgcccgctcggcggcggcaacgctccggccagctcggcctcctcgacgctgttcgccgatggggacgacgacggtgaggtcgacgccggcggttgccgtccgtccatgcgtttgggatcctcagggatgtttgtcgtcgctgatgcccgcctcgagccaagctacaactgcgtgtcaggagctacaaccaagcatataagagaacatccatattccatagtaaacataatcgactgacatcgaagaaagaaaggtactccattgtagtcagcgacatcccgtccaagggcaatggggcctacactggaatcaccggcggtgtttgcaccagcagcgtgggtttcccatcttcagggatattcgtcaagaataccggatccgatgggatgatctgcgttggcgtcatcgactgaccttgttgtgcccgaggactatagatgatgtttgcaatgccaccaacggcgcttctgtcgagcagctccaagtatacagtggcaggcattccggatctgattggatgat

SEQ ID NO: 16131 - DNA, 455 bp, Zea mays
  Clone ID: cC-zmpo148043g06a1
gcaaatccacatcagcggggatggtggtgtgaaaacaaatcgattcatacaccaaatatctgaattgcttaaaacaataggtcccggaaggtggggagcttgatctcgccctcggtggtgagcgggatagtaaaggcgccaatggcggggaggtcgacagtgagccccacctccatcatgtagtcgatgtcccagtcccctccgagatccttcatcagcgacacgatgaagtcgtacggcaccttcaccggcaggtctagcttggtgctgccgctcgccgcgatccacccggggtcgggcatcgtgcccgacgctatcaccttgccggcgctcttgaacgtgtaggtgatcttccaaatggggatgcggtgagagtaggggttgctgatgtctacgtggctatgcaactcgaccccctcgcggctgatgcttcggaaggagacttgatccaaggc

SEQ ID NO: 16132 - DNA, 515 bp, Zea mays
  Clone ID: cC-zmpo148043g06b1
gtgcgcagggacacactgcctgcgatccgcatgcggcaagatctttccttattctccaaacatgagaggagcagggggggagagatctggcaccgccactgatgcggcaggagaggaggagaaacatgagaggagcgtccgcctgatggccggtctcatggacaaggccaagggctttgtggcggagaaggtgatgcaaatccccaagcccgaggctgccctggatcacgtctccttccggagcatcagccgcgagggcgtcgagctgcatagccacgtcgacatcagcaacccctactctcaccgcatccccatctgcgagatcacctacacgttcaagagcgccggcaaggtgatagcgtctggcacaatgcccgaccccgggtggatcgcggcgagcggcagcaccaagctagacctgccggtgaaggtgccgtacgacttcatcgtgtcgctgatgaaggatctcggaggggactgggacattgactacatgatggtggaggggctcactg

SEQ ID NO: 16133 - DNA, 403 bp, Zea mays
  Clone ID: cC-zmpo148043g07a1
gggccgggtaaatttaatttaatttggctttcttatatataatggggaatacaaatataataacaagcctcgatcgatcttttgatcgaggggacaccattacaaatccattgagatcggggtgttgtccaactttgggggcaggcacccccagggtgcatacccaatgcaatgcatgcatggataggcaaattattttggagccttaacttgttcatgggatgtcaagtttgttatccttggaagggtccctaggccccttcttagcagggatctccttgcaccttttcatgcagtcctccatgctcatggggagtgggcccgtgaccttttcacacccggccttgcaatccatgggggtcgccggaggggcggcctccaaccccagcgtgatgagaaacat

SEQ ID NO: 16134 - DNA, 499 bp, Zea mays
  Clone ID: cC-zmpo148043g07b1
gacccacgcgtccgccgacgatggcgtcgaataagacggtcctcatcgtcgcggttatgtttctcatcacgctcgtgctggaggggggccgggcggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccactcgatcgagagatcgatcgatgcttgttattatatttgtattccacattatatataagaaatacaaattaaattaaatttaaaaaaaaaaaaaaaaaaaaaaatataaaataaaatataaaaaataaaa

SEQ ID NO: 16135 - DNA, 490 bp, Zea mays
  unsure at all n locations
  Clone ID: cC-zmpo148043g08b1
gcgccgacgatggcgtcnaataaaacggtcctcatcgtcgcgtttatgtttctcatcacgctcgtgctggaggcggcccggtcggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccactctatcgagagatcgatcgatgcttgttattatatttgtattccacattatatataagaaatacaaattaaattaaattttacaaaaacaaaatccttccaacggtgacaacatatactgtataacatatg

SEQ ID NO: 16136 - DNA, 455 bp, Zea mays
  Clone ID: cC-zmpo148043g09a1
aatcaaatcgtttcagttatatggcgggggaccccataaagttacaagagcaaacgaagtgagcaaagcaaagcaacacttgcgttattggtccctcccgaccagacgagcaattaccgcacagccaactacgtgcccaccctcgacgacacggtccctggtgaactcagtagaagatcatggtagcgacagcagcggcgacaccagcgatggcagctccgcttccaagggtagcagcaccggaggcatcagcagccgccggtccctcagcaggcccatcagcggcaggggacgccacctcggcggtggatgccgacggcgaagggctcaactcctcgtccgtggaagaagacggtgtataggcggcggtggtcggcgcggcagctggaccatactttctagacgacgacgacgatggggcaacggcagcggcgggggtggaggcggcttgaggt

SEQ ID NO: 16137 - DNA, 638 bp, Zea mays
  Clone ID: cC-zmpo148043g09b1
acgcgtccgcggacgcgtccgcccacgcgtccggtcgctgccctcagcgttgcttatgcaccggcagagtcaccgaaggcgggcgggcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaggagttgagcccttcgccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccagggaccgtgtcgtcgagggtgggcacgtagttggctgtgcggtaattgctcgtctggtcgggagggaccaataacgcaagtgttgctttgctttgctcacttcgtttgctcttgtaactttatggggtcaaccgttatataactgaaacgatttga

SEQ ID NO: 16138 - DNA, 430 bp, Zea mays
  Clone ID: cC-zmpo148043g10a1
aaaaaaaatgcctccaagagggcgggccatatttaaccttttgcttgttttccactctttggaattcgatcatgaacccgaacaaaaggattacatatactagaatttggaagtctcaatagtatataaggttagcggtgcatgctgccaacttaattagcttgctgctgaaggtccataacccgctgtgccggatgaatcgaagggaattcaaagtctactagaattggacgttggaagtgtacacggcatcgggtctccaattcgccgggatgacctttttggcgatgacctttttgccggactctctggtgaggcggatggagaaggggcccttgagcgccttggcagtgtccatcctccagatggcgccccaagagagctttatgggcttccacttaaccgacaacttgttctggattccataaca

SEQ ID NO: 16139 - DNA, 612 bp, Zea mays
  Clone ID: cC-zmpo148043g10b1
ccgggcatttcgaataacacaggtgagcgcgacgatgggatctttcgtttataacatcatggtcgtgggcgccggcctgggggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaacctcaactacctggccgtgctggtgaagtatgtggc

SEQ ID NO: 16140 - DNA, 359 bp, Zea mays
  Clone ID: cC-zmpo148043g12a1
cctcaggcgctcaagcatcccgggagtggctatacatgggatgaaaatatgcacaatcacaatacaaaaccatgtacgccttcagcttcagctcggggtacactctcccagcaccgcatcagggccgcactgctcgcacgcgttgccagcagtaacacttacacacacacacacacctaacatttgtacagggtggagcgccccaacttgcccagctcttttggctctctcacattagaatagctggaagaagaggcttgttgaaccgccacccaacgaccctaggtctgctggcttcaccagtgccctgcacagcgggcaaatccgctccctctcgaaccattcggacacacaatctt

SEQ ID NO: 16141 - DNA, 482 bp, Zea mays
  Clone ID: cC-zmpo148043g12b1
tggcacgcaatattcatcatcttggtgaatgatacatttgttctccaaactgctatggttgtcaaagggccggtgttgatgtactacaagaacagcatacgccgtagctatcgtaggcagggtcagatgctgacgattgtggaatattatttactttttgtaccgcgcattattgcctacacctgtgtggtaccgttttttcctgaacaaggagtatggaagcttattttcgtctctaaccactggcttgtatctcactttcaagttgacatcagtcgtggaaaaggttcaatcatttttgacggcattgagagcgatatcttataaagacttccattgtggctcatatgcaacaagcgagcacgtggctgttgctggagatttgtgcgcgatatgccaagagaagatgcacgttcccatccttttgcgctgcacacatgttttctgtgaagattgtgtgtccgaatggatcgagagggagc

SEQ ID NO: 16142 - DNA, 441 bp, Zea mays
  Clone ID: cC-zmpo148043h01a1
ggagccgcacaggctcacggggggggggactgtaactcgaaaccatagttcacttcagtagtacatttgtagacgaaaagaagaaaaaaaatcacacatgatctctctcacgtaaacttcagcaagagatgactttgaaggctttctccccaccacccacaccctacaggctgcgtcacgcacatttacctcccctcggccttgatcagctgagagaagacgcggctcatggacacatcggagaggtcgtggtcaggctcgtttgacgctccggcttctgccatcgtcacgctgatgctctcgagggccccgacgttctggacctgtgacgggagttccacgatacggttcatgctgttcacatccgagaccgtcgaatcggcgtcctgaagctgcagaacgtactccaggttccagaggacgtttcccatcgacggccgc

SEQ ID NO: 16143 - DNA, 519 bp, Zea mays
  unsure at all n locations
  Clone ID: cC-zmpo148043h01b1
cgtgcgcatcgatcagaggatcgcgggcacaatcaggccggactttttttttaagtttggcgagaccgtggagaagggcggggcagactacggcgtggagcggccgtcgatgggagacgtcctctggaacctggagtacgttctgcagcttcaggacgccgattcgacggtctcggatgtgaacagcatgaaccgtatcgtggaactcccgtcacaggtccagaacgtcggggccctcgagagcatcagcgtgacgatggcagaagccggagcgtcaaacgagcctgaccacgacctctccgatgtgtccatgagccgcgtcttctctcagctgatcaaggccgaggggaggtaaatgtgcgtgacgcatcctgtacggtgtgggtggtggngaaggatagccttcaaagtcatctcttgctgaagtttacgtgagagagatcatgtgtgattttttttctttttttcgtctacaaatgtactacctgagtgaactatggtttcgagttacagttttaa

SEQ ID NO: 16144 - DNA, 496 bp, Zea mays
  Clone ID: cC-zmpo148043h02a1
aaaaaaattgcctccgaagggggcgggtatatttaacattttgcttgttttccactctttggaattcggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctattaaaattggacgttggaagtgtagacggcatcgggtctccaattcggcgggatgacgtctttggcgatgaccttcttgccggactccctggtgaggcggatggaaaaagggcccttgagcgccttggcaagtgtccatcctccagatggcgccccaagagagctttatgggcttccactcagccgacaacttgtcctggatttccatcagcacgatgtcgccgtcgtccgccacatact

SEQ ID NO: 16145 - DNA, 506 bp, Zea mays
  Clone ID: cC-zmpo148043h02b1
ccgtgcgcccacgcgtccgcggaggcgtgggcacagagcgacattttgatttacacagttgagcgcgacgatgggggggctgggtaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctaccaggtgagatgcaaggaaaaacctgagtgctcgggcaatccagtcacggtgtacatcactgacatgaactacgagcctatcgctccctaccacttcgacttgagcggcaagggccttcggcttcctggcaaaacccgggctc

SEQ ID NO: 16146 - DNA, 495 bp, Zea mays
  Clone ID: cC-zmpo148043h03a1
ggtgcaaaagagcaaaaggttatggggggacccgacaatattgcgttcggttagaaaactagaaaagctcgatcaggtttccgccttccctaccgtctaacggcgcagcgacgaaggggttccagtgattagagacgtgacccccgccgtggtaggcgacaacgccagcgcttggtctctcctcgtcgaatgtcacccattccgttgttgccatcaccaccgcagtgttcgtcgacgttgaccccgcgtccttcacgtccgccgccgcctctgcctctgcctctgcctccgcctgcgcctcctcaccgctttcgttctggatgtcactctcactcatgaggatccgctcgaggtcccggacgtcgtcgtctttcaagcgaactaatgatgtcgggagcttgcgcgcgttggccacgccgagctcgcggcacaggtcgaagtaggacgagagctgagcgctctgctcctgcgcccgccagagcacctttacccctg

SEQ ID NO: 16147 - DNA, 531 bp, Zea mays
  Clone ID: cC-zmpo148043h03b1
cgtgcgcgtgctcgaccgcatggacccctccgtggcacggcctttttgcctgtgacgacgcaggcgcgaggcgcggggggggggggccatgacgtcgtccgtgcggcagtggtggcgccgcgccgccgctgcgctcaaggacaggaggagcctgctcctggcgcgcctgcgcccgcgccgggccgggtcgtcgtcgtggcaccaccgggagctggaggcggccgtgatccgcgcgacgagccacgaggaccggtggatggactaccggagcgccgcgcgggtgttcgcgtgggcgcgctcgtcgcccacgttcattcggcccgtcatgtgggcgctggcgcgccgcgcgcggcggacgcggtgctgggtcgtggcgctcaagtcgctcatgatcgcgcacggcattcttctccgctcgggccgcgcgccgtgcgccggccgcgtacccttcgagctcgctgactttcgagaaccggccctcgtcggcggcggccaggtcccctggcctgcttcgcctttgtgcgcgcttac

SEQ ID NO: 16148 - DNA, 523 bp, Zea mays
  Clone ID: cC-zmpo148043h04a1
atacaaactgggtttatcgatgcggggacgggtacatttcttcctgatccatattgggtagagtcgtctctgacacgaatgcaatttcggttaagatcagaacgattacatacatgccgcaagcggatggatcaatggatcactcggaggcacggccgttgaacgattctgacttgaactgctcatagaacttggtgatgaactcctccgcctgcatgtcgatggcgtgtgggcaactgctgtcaccgtcatcgccaccctcagcaccctcttcctggtcgctgtccatctggggcagatcctcagcggacgcgtagcggctggtcatgcccacctccttgatctcgaagccgaaccgtgcctgcgacggcggcgggaggatcacgtcatggtacacatcggcgtggcccatcggcggtggcggcggtggcggcgggtaatactccagctgcccgcggaggcggagcgggcgcataccgtccacgaggcgcttccacgacgttgactcgtcatcggcaggctt

SEQ ID NO: 16149 - DNA, 443 bp, Zea mays
  Clone ID: cC-zmpo148043h04b1
tcgccacgcgtccggcgaaggcctctgccttctcttccttcctgtatggaggaagtagctgtttcgccggggaggggtgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagccccaagaagagagccattgcggctgctgatga

SEQ ID NO: 16150 - DNA, 457 bp, Zea mays
  Clone ID: cC-zmpo148043h06a1
gtgaaataaatggtgagataagggatggatataactcccattacaatgatttttttgagaaccccagtacagtgatttgagagggcatgcatctcaagattacatatatccattcatttgttccccttcactacgcttctttcgtatttgttcttttgagtttggattggatggtcagaccacgaggagaaaacgaggccttcgtcgtcttagcgcgcgggggcgtaggacggcggcagcggtagccccacgaccttgccgcagcggagggcgttgtcgggcatgttgtactcgtcgcgcagtgatcgcgccggcgagacgacgctgatgtagaactgctccccgaggtagtaccgctcccagatgttggaatgcacgctccacatgcccgcgttgtcgaacgtcagcatgattgccgtccatgaccgcgggtacacctggatcgtgtgccggctca

SEQ ID NO: 16151 - DNA, 498 bp, Zea mays; identical to SEQ ID NO: 16079
  Clone ID: cC-zmpo148043h06b1

SEQ ID NO: 16152 - DNA, 527 bp, Zea mays
  Clone ID: cC-zmpo148043h07a1
tgttcccgttcctttcgcttttagtacctgaccagcctgaccagggggtgggggcacggggacccggcgcagcggccgtcgttcgcgtccgtctgccgcgtcctccgctacgtgaagcggttcgtggtcatgaacgtgaaccccgcccccgcggagcagccagacgcggtggtgccgccgcccgtgccggcggtggactacctcgacatcgaggcgagcctgcagaggaggttcccggcgtggcagcccgggtctgggaacgcggcgccgcgggtctccgacgtgccgttccagatgttcgcgtacagggtggcggagaaggagaggagccgggcggccatcctgcacatcggcggcggcaagggcgcctccgactccagcagcgacggaaactcgctgtgcggggacgagagcggcggcacggtgctgtctgaagccgaggctctgaccgtgtcgagccgcggcgccaccaccacgcggtcgctgccggaaccggctggcaacaggaaagtggatgggagcagggt

SEQ ID NO: 16153 - DNA, 520 bp, Zea mays
  Clone ID: cC-zmpo148043h07b1
ccgccgccctttttttttttgtttcttttttttttttttttttttttcttttaatcatttcattcgtttgtaaggggctagcgcacaaaaatgtttatcagaatacaacagcgaaaattcctgcactgcacccaccgccgggagccaaaaaaagattcctgcattctcaggctacttcggagtctgaagcgtgtccatcgccggaaccgcgccgccgtggtgacgcgaccgcggcagatttcaggtagccgtccgacttgatcctctgcgtccgcctaatggtctgcggcggactcaccacgcccgtggatttggacttttccatcgacttgtgcggcggccctgcacctgcacctgctagcctggaggcgaccctgctgccatccaccttcctgttgccagcgcggtccggcagcgaccgcgtggtggtggcgccgcggctcgacacggtcagagccttggtttcagacagcgccgtgccgccgctctcgtccccgcacagcgagtttccgtccctgct

SEQ ID NO: 16154 - DNA, 561 bp, Zea mays
  Clone ID: cC-zmpo148043h08a1
tttttttttttttttttttttttttttttttttttttgggaaagggtttttttttttttttttttttttttttttttttttttatttttaatttaattttttttttttttttatactttattttttttttctttttcttttacgaacccccaaaaaaaaaacacctctccacgttttccttactttaaaaaaaaatataataaacacataaaaaggaaacaaaaaacgactaatttttctaaaaaaaaaaacccccaacttaaaaaaaaaaggggcagatccccctaccttattttatcaaaaaaaaaacgaaaaaaaaaaaattttttcttcaaaaccaaatattaaaaaaaacaccccgggtgtatcattcactaaaataatctttaaaaaaaaaaaaaaaattttgtctttttctaaaattacctaacatggaaaaaaaaaaacccccaacaacttggtttttttaacccccccccaaaacagaaaaaattttttaaaactaaaaaaaaaacacaggccaaaaaaataacaaccccctcacccccccttttattttat

SEQ ID NO: 16155 - DNA, 601 bp, Zea mays
  Clone ID: cC-zmpo148043h08b1
ccgctgaacacgaacagcggcggcggcgtcacccctgaccacgaatcgtttcggatcctgaacacgaacagcgggggcggcggcacccctgaccgcgaatcgccacggatgctgaacacgaacagcggcgtcacctctgaccacgaatcgccgcggatgctgaacacaaacagcggcggcacccctgaccacgaaccgccgcggatgctgaacacaaacagcggcgtcgaaattgctagtgaatcccccaggatgctgagcacaaacaccggcggcaacacaaatgagtcgccccggggctacaaggatgatggttcttcgccagaaacgacgagggacggttgacggttcatctctgatttgccatttggattttgttgaatgtaaaacctgattcacctgatcagcgtgaaaataaagaaccattattgatcaggtatttttctttcagatgttaagattcctgatcaatgaccagatattcttcctttccagatgactgattgctgcgattcagtcccattgtggttttcttgactattgtgctcttcagcacaacatctgattcactggcattttctagagaacaaataggatcggc

SEQ ID NO: 16156 - DNA, 458 bp, Zea mays
  Clone ID: cC-zmpo148043h09a1
ggaacagggcatgggttgtattgatccacaagatacaaatccaacaacattgcctgctcaaaggccggcaatctcaaacatagtagcttataaaaaaagcactcaaggaaaggaatacataaaatggggacgaagggggcccttgagcttaaaagcacttccggggaacaatcgctggtcctgactcatcgtactcagcctttgagatccacatctgttggaaggtgctcagggaggcaaggatggaccctcctatccagacactgtatttcctctcgggtggagccaccaccttgattttcatgctgctcggggcaagggcggtgatctccttgctcatacggtcagcgatgccagggaacatggttgtgccaccactgagaacaatgttaccatacaagtccttcctgatatccacgttgcatttcatgatggagttgtaggtggtcttatggatg

SEQ ID NO: 16157 - DNA, 625 bp, Zea mays
  unsure at all n locations
  Clone ID: cC-zmpo148043h09b1
ccaccgtcggggctcttgactatatcggagctggagaacgccaagttcagttatctgggagaagagctacgagctggctggggccaggtgatcaccattggggcggagaggttccgatgccccgaggtcctcttccagccttccttcattggtatggaagctcctggcatccatgagaccacctacaactccatcatgaaatgcgacgtggatatcaggaaggacttgtatggtaacattgttctcagtggtggcacaaccatgttccctggcatcgctgaccgtatgagcaaggagatcaccgcccttgccccgagcagcatgaaaatcaaggtggtggctccacccgagaggaaatacagtgtctggataggagggtccatccttgcctccctgagcaccttccaacagatgtggatctcaaaggctgagtacgatgagtcaggaccagcgattgttcaccggaagtgcttctaagctcaagggcccncttcgtccccattctatgtattcctttccttgagtgcttttcttataagctactatgtttgagattgcccgcctttgagcangcaatgttgttggatctgtatcttgtggatcactacaatgcatgcgttgcttc

SEQ ID NO: 16158 - DNA, 452 bp, Zea mays
  unsure at all n locations
  Clone ID: cC-zmpo148043h10a1
ccagcactcagaatttggtacaggggcnggggtacatttttgttttcctttcctttctcacctacatatttgtaatccaggtgaagaggatttgtggtttagtgccagccagtctgcgacgactgcggtcggtcgtcgacgacgtgctattacatatcgatcgtcgtcgtcgatgtgctattactgatcgtcgtcgtcgtccgagtccaactgtttgagcagcgaggcgcagatgggcagcggcacgtccttgaggtagccgagcgggttggcggggcgcaggttgtcgctgatgccgacgttcctggtgagcaggacgccggcgcggtccctgtccgcctgcacctggtcgcagtccttgcgcgggctctccaccaagaccacctngcaaatgtcctcctcgtggctgtccttgagctcgatcgtgtacgtgccgttcccgtcggtcaccc

SEQ ID NO: 16159 - DNA, 619 bp, Zea mays
  Clone ID: cC-zmpo148043h10b1
gtccgtaccctcgtcgtcgtctcactcaccccgccttcacgccttcttcatttaaataaggtcccgcccttttccggggttcggaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcagggacgtgccgctgcccatctgcgcctcgctgctcaaacagttggacttcgacgacgacgacgatcagttatagcaca

SEQ ID NO: 16160 - DNA, 349 bp, Zea mays
  Clone ID: cC-zmpo148043h11a1
tttttttttttttttatatttttttcttttttttctcccccggcctgggttttttttttttttttttttgcaaaaaaaacctaaattcccccccaattttaaaccacacccccaccagttcccaataaaaacccccccccaccccccgaaggggcccccccccaaaaaaccatgaaaacaccccccgatctatttcaaaagcactgtacccaaaaaagaatttaactttacattaacggccccaaacaaaaactttatgcaaatggccccccccccctcccataaccccaacctggaaaaaaaaaacattcctaacccctccccaaaaaaaatcccttacccccccccc

SEQ ID NO: 16161 - DNA, 553 bp, Zea mays
  Clone ID: cC-zmpo148043h11b1
gtccgccagcttcatcctgggcgtcgccctctgcgccgtcgccattatagttcagcctcaactcgggcttcctcccggggctgaccgtcccggctggcctcgtcggcttctacctcgtccgggcgtggatccgtgccctcgactgctgcttccaggtgccacaccagctgccattcacgcgccaggagaacaccgtcatccagacgtgcgtggtagcctgctctgccatcacattcagcggagggtttggcacgtacgtgctcgccatgggcaagaacgcggccggaggagacgtcagggacggcaagaacatcgtggagccgagcattggccgaacggttgctttcctcttcctcgtcagtttctccggcatgttcatcctaatgccgttcaggaaggtcatgatcatccggcaccgcctcacgtaccctaacggaatggccacggcgcacctcatcaacagcttccacacccctcaaggagccagtaaggcaagacagcaagtggagatgctgtttaggtcactgggaggaaccatgctgtggaacatgtt

SEQ ID NO: 16162 - DNA, 459 bp, Zea mays
  Clone ID: cC-zmpo148044a02a1
gccgcgtactacgcgtcgctgttgtcgtttcaggcgcctcatgcagcgctgtgggcgcgcgttccgccgcagcatgtcacgcggccgtgtcttcaggacggtcaaggacctcgccgaggaacgggcggcggtgcttcccgccagcagcaaggtctccgacgcggcgtcggcggtgccgccgctgcctcctggtgtcgagaccgccagcagcaacggtgcccgcggcggcagcgtggaggtggaggataagcagcggcggcgccacgactactgccaccccgaggtcgttcccgagaagatcatacgggaggacgcgccgccagttgttgcggagaccgctgccgcccccaccaccacggaggtggaggtggagtcctccaagataggagcggcgccggtgccagagcccatcgtcgttgtcgccgcaatggaagacgtggtggcggacaatttcttggc

SEQ ID NO: 16163 - DNA, 563 bp, Zea mays
  unsure at all n locations
  Clone ID: cC-zmpo148044a02b1
gaccacgcgtccgatcgatctccccccagcggcgaggagagccggctttcactttaaggagaaatggcttccgcacacggggcggggggggtgtttttcatcctaaccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaaggggagcaacatcgccatccagctggatggcaacctgctgggatcaaacgacctggacaagtacacggcgagctggatcgaattgtctcacgttaacaacatcgggatcaccggctcgggcacgctggacggccaggggaccgtcgtttatagcangagcaagaccgacaacgtgaaggcgatgccccacacact

SEQ ID NO: 16164 - DNA, 490 bp, Zea mays
  Clone ID: cC-zmpo148044a03a1
gcacaatgcactttacagtgtattaccccaaactaccggggggggtcgatcgccatcatcaagacgcatgcttccatttgtatgaagcttgcaactaccgtacgctacttcagtccacgaaatttaactcactgcgctggcagtggcatggatactctccaccaaccactggaatggatacttatactagcctatgtacaacacggaccagtctgactcacttgtccttcatgaccaacctggggccgccgccgctggcaatgaagcgcagggcaagctcgtaggcggagaagatggcgccgttgacgacgaacgcgcgggcgactgctgtgccgaggcctctccacaacacggggaggccttccttccggacgcttctttggaagcagtcgacgaacccgcggtacctgggcgccgacgccgacaccgtgccctgcgcctggagccgctacttgaccacgttcagcgggtagcagcacacccagctggc

SEQ ID NO: 16165 - DNA, 535 bp, Zea mays
  Clone ID: cC-zmpo148044a03b1
gcagcagggggtggcggcgaggtggcattacagattggaattttggagggaggaggccaggtgagggaggagggagagggcacatcgtgggttgggtgatcacggcctgatggggtcgtggcgcaaggcctacggcgccctcaaggactccaccaaggtcggcctcgccaaggtcaacagcgaattcaaggaattggatattgcaattgtgaaggcaaccaaccatgttgaatgccctcccaaggaacggcacgtcagaaaaatactcttggcgacctcagcaaaccgccctcgcgcagacctctcgtactgcatatacgcattgtcaaggagattgtccaagacaaagaactggatagttgcgctcaagacattgatagtggtgcataggcttctgagggagggcgatcccatgttcaaagaagagttcctggcctactcatccagagggaacatcttgcacatagccaatttcaaggacgactcgagccagtcagcttgggattgctccgcatggattcgcgcctatggatgc

SEQ ID NO: 16166 - DNA, 432 bp, Zea mays
  Clone ID: cC-zmpo148044a04a1
gtcagaatataatgcaacatcttgcttgatgggaggcgtgagattccgtttaacttatggacaacaatgaacagcaaataaacaaccagccactaccgatcgacgaccggcgtgccagctgtgtgtcttcttcactctgcacacactgtacgagaccgagagcaggtctagcagctaggcttccctcagttgggatggtctgggttctctctgttccatgacaagtacgaggggtctccaagcgcccttggcttgatgacgtagaggatgacgaaggccagggcgagaaagaggcagacgccgccgatggcgacgtaggcgacgccgatgaagttgttcctgccgccgatccacgacgtggtggacagcaccagcgccttggtgcccccgaagctgtaccgtgtgtagttgttctggatcaccaccgggatc

SEQ ID NO: 16167 - DNA, 423 bp, Zea mays
  Clone ID: cC-zmpo148044a04b1
cgagcgacaaggctccggctcaccctccacccgtttacctttaagacccacacccgcccgggatcaggtgcaccccgatgatgagtaccgaaaactactcctaggcctcacggcggtccaagaaacccaagaattccaagatgacccagccagagctcacaacaagcaagccaatgttaactcctggaatagacatccgagctcactcgcacaacggcgacttcttcgtcccaaacagactaacatggctatccgcgtataataacatcgctgacgtgatagatcgatctaacgccgagcgtgtgtacgccaacaactaagtccgcttcattcagcacaccaaaaccgacaaggggcgcacaaaaaagatcaccgagccaaatccaatgaaagggccgacacacatatactaccagctcgaga

SEQ ID NO: 16168 - DNA, 272 bp, Zea mays
  Clone ID: cC-zmpo148044a05a1
aagttctctgttacatttttttatttcgggggcggggttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcaaacggggagcggcacgtccttgaagtatccgagcgggttggcggggcgcacgctgtcggagaatgccacgttcctggtgagca

SEQ ID NO: 16169 - DNA, 384 bp, Zea mays
  Clone ID: cC-zmpo148044a05b1
accgacagccaggggaggggggggaaaacacgcgcagagaccccccggcaacaaccgccacgagacccgcgccggcgaccacgaccggcggcggagacacacgccgaagcggcgaggcgacaggcgccgaggcagacgaccacaaccaccgcgaacacaggagcaccgggcggagcgcccggaggcccagcacgcgcccaaacgcgagcagcaccacaccgaacccgggggccgccagcgcgaagccagcgagggggcgcacagggcacacggcagcgcgggcgcggcaccagcggcgcaagccacgggaccggagcacggacaaccaagccaaaggacagcgcacgacggggacaccggcacagaggcgccgaccgccagccc

SEQ ID NO: 16170 - DNA, 521 bp, Zea mays
  Clone ID: cC-zmpo148044a06a1
acggccgtcctgcagcgcttttgtttccaaagtcggagaccttgaggtcggggcgggcgtcaaggaggaggttctcaggcttgaggtcgcggtggtacacgccgcggctgtggcagaactcgacggccgtcatcagctgctggaagtagcggcgcgccacgggctccgggaaccgcgtgctctgggcgaggcgcgcgaagagctccccgccgctggcgtattccatgacgaagtagatcttggaccgcgtggccatcatctcgtggaggcggacgacgttcgggtggcgcacgcgccgcatcacgtcgacctcggtcttcaccttctccgccatgccggagcggtgcacagcatccttgtccagcaccttgacggtcacagcctcgccggtggccaccttatgggccttgtacaccttagcgaagttgccgctgccgaggagttggcccagcctgtaccggcccatgaccaactgggagtcttggttcttcttcatggccatgggaagcaaaagatgttct

SEQ ID NO: 16171 - DNA, 362 bp, Zea mays
  unsure at all n locations
  Clone ID: cC-zmpo148044a06b1
agcccagccaactttccggctttaccaggccccacgaacacagggggagggggcgcngcttcccatgggcaggacaaaaaaccccgactcacagccgagccctggcgacggaaccaggcatgcgccaccaactcggcagcggcaacctcgctaaggcggacaacgcccatacggtggccaccggccaggctgcgagccgcaaggtgctggacaaggatgctgtgcaccgatccggcatggcggagaatgtgaacaccgatggcgacgtgatgcaggccgtgcaccaacacaacggcccctcgctgcacaagatgatggccatgcgggccaagatctacgtcgtcatgcaaaacgccagccgc

SEQ ID NO: 16172 - DNA, 333 bp, Zea mays
  Clone ID: cC-zmpo148044a07a1
gtagaaaatttattttttccccggacaaaccccggggagggccggggcctgaaacgggacaaaacatttttgccctcccccccctgctttccctcccgggtggggcacaatacaattttatttaccccggagctgccctgcactgcactgcactgcactgcacaaaaaactgctcgctggctttagaatgggctcccttgttttccacccaaaggaaaacccaacaagaacccgggctccctcccaaggcccaacccctgtttgtacagtcaatcggaggttttcgtttcgtcccgtcccgtcccgggcggtaattttcccaaggggaagggg

SEQ ID NO: 16173 - DNA, 346 bp, Zea mays
  unsure at all n locations
  Clone ID: cC-zmpo148044a07b1
acggggacaccccacgacacggcgtttcatgtgctgccggccaccaccgccacaaggggaggggancgangaaaggaaaacatgcaccaccnacccacccaaggaccccgaacagcgacacccagacaacgaggagcgcctggaaggcgaaagacgccacaggcaccgcacaccaaggacaccgacaggccacggaagaagaagaaaagggcgccacacatgccacaaagngaccgacgaacgatgccgccgacacactaacgagctcacccgccgggaccggccccgacgggacctaagcctacaaccgaacgcccacactgggggcgggacccggcaagcaact

SEQ ID NO: 16174 - DNA, 459 bp, Zea mays
  Clone ID: cC-zmpo148044a08a1
gcattgcaggattgttcatgttaattaagggcagggatacaccggtttacgtccattgatatgtaccgtagcattgcatattttggaggtctacgtcccgagcatagtgctcgccttcagtgaaaaccacggaaaaatccgttaaccaggtcggccaccggatgtttccggaacggtcgacgcggtcgtggatggggccggagccatggaagaagaacgggcgggcgctgcctctgcaggaaccatggaagctgtggctgatgcggctgctgctgctcctcctcctccagctccgggggctgctgctcctcctgctcctcctgcggctgctgctgcttctcctccttctcctgcccgttcaccaggcggcactgcttccttacctggcccttgccctcgccgatgagcacgtcaagcatcccgaccttctgcatcgcctgggaaaacttctgctgccac

SEQ ID NO: 16175 - DNA, 422 bp, Zea mays
  Clone ID: cC-zmpo148044a08b1
accacccgaggtgcggctttcactttgacgcaggagggcccccctcgggggggggggaacccacacacaactgctcgcagaacaaccccatccaccggcaccggcggcccagaggaccacacgcgggaaggacaggggcaccagggacgccaagacgcggaaggcccccgacagcggggcggccggcgctacggcacacaaacggggccacgcggcggaggccgggccgcagcagaaccggaacacggacgcggcccggtccaaggcgacaacgcccggggacgagaacaacaactagagcgaggccgccgccaacgagaaggccgcgggcgccgtcagcgcggagacgccggacaacaagccccacgctatggcggccgcgcacgaccgcgcgggggggccagacccgggccggggccccg

SEQ ID NO: 16176 - DNA, 490 bp, Zea mays
  Clone ID: cC-zmpo148044a09a1
agaccttgataccatgagggggtgcggttaactaacaacatgataacacattgaaaatcaaacagaaagaaaaagagggagagcaaggatgtatccatggatgaccacacattattatggattcatggttttaaagacattgctctcatttttcttccatgtcttgttccaaatttaaccgggccgacatgtgtggcctcagttggtggagtcatcatcgtcatcctcattgcctgacaggccttcgacaccctgggggccaggtgcagcagccggcccgctaggtccatcggccggcgcgtcagccacaggggcatcggcagactttgcctcggccatcggtgctacgaccatggcgacgaagaggagagcagcaatgacaaagacgacgctagcgcgagccatgggtacggtgtctagctttctagggttggttggtagctgcttaggcgagttcaacgcttggtgtctctgtgcggacgcgtgggtc

SEQ ID NO: 16177 - DNA, 476 bp, Zea mays
  unsure at all n locations
  Clone ID: cC-zmpo148044a09b1
cacagagacaccaggggttgaactcacctaatcaactaccaatctaccttagaaagctagacaccgaacccnggggtcgggctaactgtctctttgccattgctgctctcctcttcataaccatggtcatagcacccatggccgaagcaaacactgaccatgcccctgaggctgactcaccacacgatggacctacacagccgactgctgcacctggcccccaacgcgtcgaaggcctcacaggcaatgaagatgacaaacatgactacaccaactgaggccacacatgtcagcccgaataaatctggaacaagacatggaataaaaatgagaacaatgtctataaaaccatgaattcatactaatgtgtggtcatacatggatacatacttgctctccctctttattaaactaggggattgacaatgctgtatcatgctgttagttaactgtatcgactcatggtatcaaggtct

SEQ ID NO: 16178 - DNA, 451 bp, Zea mays
  Clone ID: cC-zmpo148044a10a1
ggggcgggcgatttttgcattaccattaattattacatggcaaacagcgcatacatgcttgctatttctgaaactgtttttttataatcacatcaacaccgatttccggtgattattcttcaagcaatgcatacatgtgaaaccaacatcgacttcctttttcaaatccatccaacaaaaatgaaaaccccaggccaacgaaaacaaaaaaaaaacctttttatcccgaaaattgcaaaacaacaatcttggcgagtactttataataaatgcccatggggttcggcggacattttttattataacctgcgcggggcatttgtgcctaccgtcctcggcgaggcaaaaacaaaccctgtcccttttgctgctgttgtggcctccaccataaccatgggcatggcctttcccgtgcttcttctcttttcttctcttaataactttcttcccc

SEQ ID NO: 16179 - DNA, 548 bp, Zea mays
  unsure at all n locations
  Clone ID: cC-zmpo148044a12a1
ctatctaatgggtattgattaatttccaaggggcgggttcaaacgaatagtgtctcccattctcccctctttacatatcgaaattaacagaaaagggagaaatggcaaagcaaataaaatgaatggatcaatcgacatgttcagacccaaattaaagtacttaaatatatatataaacggaatccaaccgaatacaggcaatggcagccagcagcctctccctccgatcctcctttaattttactgcaggtagtaggcgaagaaggagagcacggaggcgcccagcacggcgccgacggccgggaacgcggccgaggaggcgctggtgggggcgggcgccggggcctcggcggcgaggaccacggtggcggaggcggcggcggcgaggacggcgcangcgaccttcttcatctccatcgcgacttgatgtggtttgccggagccgaacggagcgtcgtcgggatccagacgaggaagaacgaagggcacgcaggcttattagcaagatggatcaacggatgatcacacttgctattattggttgcgcc

SEQ ID NO: 16180 - DNA, 532 bp, Zea mays
  Clone ID: cC-zmpo148044b01a1
gcaagatctgtttctcaggtcctcctccctctcacaggggccggtcaaggaaatgatacagcaggttaacagcattcctccagttgagaaacaacaaaacatgtatgttcacaagacagcaacaaaacatgtacagcagcagatgatctttgaagccctcacaacctacaaatgatctgtcgcttccattcgcgtacagttaacaattggagaaaaaaaatcctatgctttgaccacatccacatggagaaatttccattacgtgagactggcttacattacttgtacgtgtcgtcctgtgctataaatatattccccttgctcatgtgctggacaccatttcatttttcttctccaggatagaacccagcagctcgtcgatcttagcaaagacagcatccactgtggcatctccttgcactttaacaataatgttctcatatgttgatagcaacgactccatattttggtaataaggtctccagcctcaacttaacctttttttctgtatcgtcaaattttgtgtaagcct

SEQ ID NO: 16181 - DNA, 532 bp, Zea mays
  unsure at all n locations
  Clone ID: cC-zmpo148044b01b1
ccacgcgtccgcccacgcggccgaagtaatngggaataaatagcntttgaatttctgaagcgtgcatatatatattggggccaggataaaggtaatggagtcgtcacgcaagttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttacgccgccgctgcatctgcactaggcagtgctaaacaagatcgctcgatcgcttgccatgcatcgacaacctattcttaataacgttcattatctcgttcttatttatgacgaatgtcatgtatgttctggggactgtcatgtatattctgatgactgtcatgtaatcttgtacatgtatgctcaaggtccatatcttgttcatgtattaagcaggtattgaataactaaaatttattatttgttcatgt

SEQ ID NO: 16182 - DNA, 400 bp, Zea mays
  Clone ID: cC-zmpo148044b02a1
aaaaaaaactgccggcagggctttttattattacccattcaatccatgaaaaacacacatttgcgtgacattacatttggagttccatcgaccgtttatttggaaaaaaacaattagtttaaaaaatgccagattaataggaatacaatatatagttccgcccatatcaaatggttatcgcatgcgtggccagccggtgaccacgtacgtatagactcgctcagcgcctgagctgaacgccacgtcaccccggcgcatgcatacatgcatgcatgcatggttcattcatttcaaggggcttttctttaaaaaagaggaggggtgcaggacctcttgcagttctcgctgaggcgcgggttcttcttcttggcccaagtgacgcttcaagccttggtgacct

SEQ ID NO: 16183 - DNA, 535 bp, Zea mays
  Clone ID: cC-zmpo148044b02b1
ggaccacggggctcggcatcttcgccttcctcggttttccattttcggtcctatgcatcgttccgggggccgggggggcacatctggcggcggccaagggcggccggcaggggctgtgcacgggggtcctcaacaactccatcgtggagccacagatggtcatcgccattggctctgggccgagggacgagctgttcggcaagggcaacatcccggcgttcggccttgccgccgtcttcggcttcaccgctgccgtcgcagggatcatcatgctgccaaagcagcccaagaccagcttccggtccgtctccatgggaggaggccattgatgatcacaactctaggatgcatggtccactgtggttcacgattcttttaccttagggagttggacggacacatgtttgttctcaaggccgcttccgaggcctaaaccggcgggttatttctaggccggatcatgacgaacaatctgtttcgtgggttgaaaagataagtttacacaaaccacaacgtgccggctattaacttttgg

SEQ ID NO: 16184 - DNA, 524 bp, Zea mays
  unsure at all n locations
  Clone ID: cC-zmpo148044b03a1
attcaatccattcggaaagggtaacgacacgttctataacgtccatctgcagatgggtgttttagcccttccacagacagaacatacatcacccagagccaacaagaaatatatatacacaaagaaaatattatcatatttagcttagacctccggccaacgagggcgcacaaagatactgtacagttcttggtacggggaggagggcatcaattgatagatgataattgtgtgtcgctacggttgatctgacggttttagaaaactgtagcactccagctgcagcatttctcctccattaactgggtcaaattgacatctgtagaagctttcatccataccaacaactgacacggtattcttctcatgtccaaatgcaacaatgtactgctccccctcatggagcctgaactgagctactgaccactcagagtggaaatatttcggcaacacacccttaatgaacgaaagaggggggcttatatgcgaaactttangatctggagcaagtataggtttattat

SEQ ID NO: 16185 - DNA, 578 bp, Zea mays
  Clone ID: cC-zmpo148044b03b1
ccccacgcgtccggtgcttcgcgctgtcgcaggacgggaggtttattgctttttgctagcaccaagggaacacggggtagggtctacaatgcagctgaaggcaatctcttgcaggaagtaaggagaggtgctgattgagcagaaatatatagcttggctttctcgaataatttgcagtatttggctgtgtccagtgataaaggaacaatacatgtcttcaatctaaagataaatgtgggatcgactgcaaatgataaacctatacctgctccagatcctgaagtttcgcatataagcccccctctttcgttcattaagggtgtgttgccgaaatatttccactctgagtggtcagtagctcagttcaggctccatgaaggggagcagtacattgttgcatttggacatgagaagaataccgtgtcagctgttggtatggatggaagcttctacagatgtcaatttgacccaaataatggaggagaaatgctgcagctggagagctacacttttttaaaaccgtcagaacaaccgttgcgacacacaattatcatctatgaattggatgccctcctccc

SEQ ID NO: 16186 - DNA, 529 bp, Zea mays
  Clone ID: cC-zmpo148044b04a1
agaattaacattctctgctgaacagaaaaagcgcggccaatgcaatgcaatggagagcgaatacatgcatgttacagcaagcaatcagccggcgagggtgaatcgtggcgcaaaccagacccaggaatgcgcaagctcccacgttcgagctaggcggcctatttggcgacgagcttgcgcgcacgctggtttgctcccttcaccctggagttgagctcctccacgtcgccttgcagatgatccagcgcttcgttttgcctgtcaagctcggagcccatgtcgacggccatgcccttgagctggcccagcacgccgctgaggtcgtcgagggcgtcgtcctgcttctttttctcgatctggactttgtccatggcgtcggtggcctcagcgtagtggcgagggtcgcgcttccctcgcgggctcaggcccagcttgtccctctgctccatgcggctggccttcttcttgaggagtaatctcgtgacacctgcgcctgtcccttgatctgcctcgtcttcttgggctttca

SEQ ID NO: 16187 - DNA, 407 bp, Zea mays
  Clone ID: cC-zmpo148044b04b1
cttgggcgctgcccgcagaggagtttcaggtttaggccgaaccaaatatatctggggattgggtcgcgttcaacaacatgccacaccccggccagcccgcgggtgcttctaagccgaacccgctcgactcggacttggactcggagaccagcaatgagccggcgaacaagtccggcgcgtcgtcgtaccatgccccagccgacggccagaagcgggacaaggactggagccgggcatggggccggctgcagaaccacccgggagcggcgctggagtactacaccgggcacaagggcgcagatacaacacgcccgctcagcgggtgtctgcgccatcacaaagacagtaggcctgacgcccgcgacactctgatcacagtgagacaagcgggggagcaaaacagccgg

SEQ ID NO: 16188 - DNA, 446 bp, Zea mays
  unsure at all n locations
  Clone ID: cC-zmpo148044b05b1
ggaggctaggccttaggtgggcgcgngggcgcttctcctcccaagaaggccaaaacaaaccgtcccaccaccaacccaggcgactaccccccaacctaacccaacccggcattggtcttctttccctactctgtgtcagatggtcagagccgacccccccggagcccaaacgcgccggctttcctgaacccattccgcggtagatagatcgattggatggtcacaaccttggacgttaatcatatgaggccccaagagaagaaatctgcccgctgtgggtgaaccccatattccttttcgtcaccgatgccggctttttctcattaggggcctcaacgctgagccctaccacttcgacgccgactccaacgactcgggatcccccaaggacacccctgccgctccatttaaaggatgcaaccgcacgtgacagctgggttcctgga

SEQ ID NO: 16189 - DNA, 422 bp, Zea mays
  Clone ID: cC-zmpo148044b06a1
gggggggggtttttttttttttttttttttttcctttttcctaggggaaaaaagaaatggggaaccgggcccaaaaaaagggaacccaagggcccgggggcccccccctttttgggggaaaaaaaaaataacgggggcccaaaaaaaacggggccctctgcgctccccatttgtttaatggaaatccgaaagggggaggggaaaaacccccccatgggggaccggggggggggcccctgccggccccaaataaagccccccccccccccctttggggaggggcgggagcaataaaataatccaacccaaccaaatttttccccccctggggtttttccctccgggaggccggttttttttccgggggttctataattgttttcccccaaaaagggggcccccgggccccccaacaagggggg

SEQ ID NO: 16190 - DNA, 441 bp, Zea mays
  Clone ID: cC-zmpo148044b06b1
ggacgcgtgggcggacgcgtggggcgccggctccgacccttatcattttctcctccgcggacgcacccgcgggggagggggccgtcaaggcctccttcttcgcgtactacattcactgagccgccggacgaggagccggactgccggagggaagagaccaagggggggagagacttggctgcgctgcgctggtctgctgctcccgcgcattcccgatgcgtgggtgggtgtgctctgattgggcacggcagtggcacaccttcgacttccttttgtttgtttttttcctttcctctttctgattttcatttaactaattggtatcgctgatgtaccagtttaatttggtgccccgttatttgttctttccctcgagagagggatcgacacctgtaccattgcttgccatttgtctggaccagttcaacaattcaatttaac

SEQ ID NO: 16191 - DNA, 473 bp, Zea mays
  Clone ID: cC-zmpo148044b07a1
aagcagatcgatttctgcattacggttaggtattacatggcaaacagcgcatacatgctagctatctctgagactgttttttcatcatcacatcagcaccgatatccggtgagtatcctccaagcaatgcatacatgtgaatccaacatcgacttcgttcttcagatccatccagcaaagatgaaaaccacaggcaaacgaaaacaaaaaaagaacctttttatcccgaagattgcagaacaacaatcttggcgagtactgtataatatatgcgcatggtgttcggcggacagctcgtattataacctgcgcggtgcatttgtgcgtacggcgctcggcgaggcgagatcagtcgctgtcgctgctgctgctgctgtggccgtcaccatcaccatggtcatggccttccccgtgcttcttctctttcttcttcttcttatctttcttctccttatgggctttgtccttgtggt

SEQ ID NO: 16192 - DNA, 607 bp, Zea mays
  unsure at all n locations
  Clone ID: cC-zmpo148044b07b1
acaggggaggcggccaaggcgngcctttcacttttacccagcacggncaccgacgggggggngggggccaccacaaaaangcncgcggaggaagccaagccgcgggcactgccggcacagaggaccaccgcgaagaagaacaaggccacgaaggacgccaagacacggcaggcaatcaacagggtggtggccgccgctacggcagagaagcggtcccaggcggcggaggccgtgctgcagcagcagctgaacatggacgtgtccctgtccaaggcgacgtcttccggggacgagaacaactacatgagcgcggccgccgcctacgagaaggccgcgggcgccgtcatcgcggcgacgccggacaacaagctccgcgctatggcgttcgcgttcgacagcgcggcggcgcccgacccgggccggagccccgccgacgacaagcccttctgcgagacctacgccaagacggagaaggccttcagcggaaccatcgcctccggggacacgcccaagagcagctggggatcacggacgccgcgctcaagctgaggctcgcccccacgccaacaagaacaaggcctacccggagggggacaaggacaagaac

SEQ ID NO: 16193 - DNA, 502 bp, Zea mays
  Clone ID: cC-zmpo148044b08a1
caagataactccttgaatgtggggttgggtcctgcctacgtggtgtacgctttacaaaaagaagattcaagagagcagacagacagctctgcagtgttcctccctttcccgtggttagcttccccctacggtcatcatctatgcttcgtttcgtcgtctgccctgatcatttcggccttatgaggactgctatccttgtctgtagtatcctccttgggtttactctctcgacctgtggctgtggccttctgctcggctcccgtgccttggggagggtagtattgcggatcggcgaggaacgagagcgccgagacgacgtcgctgatccccggccggctggcagcgtcctcctgcaagcacatggacgcgacggcgagcgcctggaacagccccttcacggggtacctcttgcccagcaacgggtcggccagcttcatgaacctccgcctgtctcttagcagaggcgtttgcccaatgaacgaggacctgctcctcggacggc

SEQ ID NO: 16194 - DNA, 366 bp, Zea mays
  unsure at all n locations
  Clone ID: cC-zmpo148044b08b1
ggccacccccaagaccgcacttcgaaattcctcggccgccgccacacatggggacgcgggccacngccctgcanccagacccaggcgctcctgcacagaatataggggacggaggccactggggcaagggccactcaccaccaccaagagggacgctgacgacatggaggacgaacacgcccccacggccggccagggtgccaaaccaggcgactccgccagaagaaagggacggggaagacacccagaccatactagcgacagaaaaaaaagaaaccaatgaagcagggcgccagggccaacgctctagaagcaagggccttaaggcaagaccctatgaaccttaccagcatcacaaactaacaa

SEQ ID NO: 16195 - DNA, 410 bp, Zea mays
  Clone ID: cC-zmpo148044b09a1
aatatagctgttggatgtctatcaggttagggttgtgcgttacaaatggatagcaactaatggacaattcaaggacgagagaaaaattataactagagagatgggtcattcgactgagggtctagaagcatgcaagctccttgaggcaacccttggtgctgcccttggcgttcgtgcatatagccatggtcttgttgttggtgccactatactcgacgttgacgtcatccatggtgacgccggtgcatgggaccttggcagtgcagagcaggctaatggcctccggggtggaggaggcgccagtgatgttcttgaaggtgatgtccttgacggtgaccttggaggcgccgttggcagtacacaacttgttggggcagttctttatgtctatgaagatggggctggctgaa

SEQ ID NO: 16196 - DNA, 424 bp, Zea mays
  unsure at all n locations
  Clone ID: cC-zmpo148044b09b1
cgatcacacaaggtggcgtgcacaacaatgcgatgattttcttgttcctcctggtcctcttctgcatnggacatggggagaatgaatagtcaaagggcatcaatgcgaaagctgtccgggcctggtgggtccttcgacatcaccaagctgggcgccttcggcaatggcaagacacacagcacgaaggctgtgcaggaggcatgggcatctgtgtgcgggggtactgggaagcagacaattctgatacccaagggcgacttccttgtcggacaactcaacttcacaggcccttgctagggcgacgtgaccattcaggtggatggcattctgctggcgaccacggacctaatccagtacaaggaacatgggaattggatcgagattctgcgcggggttaacctggttatcaccagcaagggaaacc

SEQ ID NO: 16197 - DNA, 521 bp, Zea mays
  unsure at all n locations
  Clone ID: cC-zmpo148044b10a1
aaattgcctccgaaaatggcatgtatatgggacagtttgcttgttttccactctttggaattcggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctagtagaattggacgttggaagtgtagacggcatcgggtctccagttcggcgggatgacgtctttggcgatgaccttcttgccggactcgctggtgaggcggatggagaaggggcccttgagcgccttggcagtgtccatcctccagatggcgccccaagagagcttcatgggcttccactcagccgacaacttgtcctggatttccatcagcacgatgtcgccgtcgttcgccacatactttaccagcacggncaggtagttggggttgc

SEQ ID NO: 16198 - DNA, 531 bp, Zea mays
  Clone ID: cC-zmpo148044b11a1
ggtgggatattgccgcgctggccttattatagggtacagaaattccaaatttgcaatacatgtttggtacacagcaaatatgactcaaactaactgcaaaaggatggaaatatatataagttcaacatgaaccaataataactagttctaatacccaactcgaatggtagaagtttgagtgtcaacccaactatacactgttgctagcttaggccactgaggaaataacagaaaactcataaaacgtatcgttccaatgcaaacggtccattcaccgggtaaagactatggtgtgttcactggcgagaggcaatcaactcttcttcccgagagaagcatcagtgataacgccttctgatgctcagagtcccaaagatcatgagcaagcaagtgtcagagactgcaactaacaactgcatcccccagcctgagcctgagactgggacgagtttgcattgccggacctcaagttcacatcaaccatgtcttcctgcttcgctgatgagagcgtctccattccaagaagtgcag

SEQ ID NO: 16199 - DNA, 297 bp, Zea mays
  Clone ID: cC-zmpo148044b12a1
attcattatccgaacgggaccctaaaagttaggggggggggagtacatacatggaacggccctcaccatttttagttacatatatgtgttacttgcacgaccatgtatctgcttatataaatacgggacagaaaaatagcttcaacacttcgtggcacattttgtcctatgacacaaaaaattgctcttgttcacaccccttgtcacaacaagtgcattaaacttgttacattctttctgatggtaacatttattgcatccctgctacccttactaaccataccataacataatttt

SEQ ID NO: 16200 - DNA, 518 bp, Zea mays
  Clone ID: cC-zmpo148044c01a1
atcaaatccattagttacataacggggggcgccataatgttacaagagcaaacgaagtgagcaaagcaaagaaacacttggtccctccctccccaccaaacgagagcgattacagcacagccaattacgtgtccaccctaatgtctcaccgcgacacgaccatcgtcggtgagtttagtagaagaagatcatggtagcaacagcagcggcaacgccggcgatggcagctccactttcaagggcagcagcaccggcggagtcatcagcagccggtccctcaaccgcaggggacgccgcggcggtggatgctggcggggaagggctcaactcctcgtccgtggaagaagggggtgtagaggcggtggctggcgcggtagctggaccagacttcctagaccacgatgatggggcaacggcggcgacgggggtggacacggctctcggtgcttcaagcggggcagcagtttctttggcagcctcaagtgccttggcagcactgcctttctttggtgactctg

SEQ ID NO: 16201 - DNA, 523 bp, Zea mays
  Clone ID: cC-zmpo148044c01b1
taacccggccctgtcctttggtcaccatcacatccagccttccaacttaaatgtcgcgcgtcacagctggggggctggtttacatcctcgccggtgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttctttcacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattagggtggacacgtaattggct

SEQ ID NO: 16202 - DNA, 134 bp, Zea mays
  Clone ID: cC-zmpo148044c02b1
caagaggcagcgatccgtctgtcgtcctacggcttggcaagaagaaactgaagacaagcgtgaagaagagatccgtgaaccccatatggcaagaggagctaactctgaccgtcacagatcccagccaaccactt

SEQ ID NO: 16203 - DNA, 421 bp, Zea mays
  Clone ID: cC-zmpo148044c03a1
atgcatattatgtattttctgctgggggtgggggtgttgtaaaaccatggaactgaaaagtacgagcaagccataaaatacgaacgggccatcgtgtcatggtgctaccaggtagataaactctggagctatagcatggcaatctgcattgaacgataccatattctatctcccgttcaatgcgtgcgtgcgcgcgcaaacacgacgcatggtggccgggggccggcgggcagcggcgcccaacacgcaactaaggggcggagacgggggcggggcttggagcaggtgactcggacacggtattcttggccaccttacccttacccaccaccactgcttcgacgggcttgcgcgggatcatgttggaatcctcatgggttgccgctgatggcttgatcttgcgcttaccacccttgccgcg

SEQ ID NO: 16204 - DNA, 433 bp, Zea mays
  Clone ID: cC-zmpo148044c03b1
ccccggacgcgtgggcggacacatgggcggacccctggcctcgtttatactttcaaattaccgacatggctcccgggattgggtgattcttgtgttactcgccgtgtcctcacccacggctctggccacctccgatgtgatacagatgctggccgacaagcccacgtactccacgttcctgaagctcctgcatgacaccaaggtagtggacgaggcaaatcaactccggacggcaacgctactggccgatcctgacaaacttgccaagcctatggcctcgctgcccgcctataaagagcggacggccgaggagaaccacgttcttctcacatactacgaccccaataagctggaccagatgaagacacgcaccggcatactgcccacgctgctttacctcaccgacaagaaactcggcctcctcaactacacc

SEQ ID NO: 16205 - DNA, 445 bp, Zea mays
  Clone ID: cC-zmpo148044c04a1
ttggatgctatagaggggaggccctttttttttttttcttgttcacatatcaacattaacattatggaatgggggaggggtatactctatcataatgaataagttccaagattgtgaggcgttggtctaataataattacattggttggttttgggatgatccaaagaagaaagaaaatacaaaccagcggattatatattcggtggagacttgagagtacgtgagaaagagagaggttacaaagagtgattatatatataatatatgcatgttagtcaattggttcagatgcaggcgagcttctttgccaagccgttggacttgccgatggcgttcttgcagacggccatggtcttgttgccggatccattgtacttgatgtctacgttgacgagctgcacgccctggcatggcaggttgttggcgcatttgagcgtgatggcc

SEQ ID NO: 16206 - DNA, 595 bp, Zea mays
  Clone ID: cC-zmpo148044c04b1
gcgagcaacacgaccatcggcgacggcgacttttgcattttcatcggccccggagcaagaggtccgggccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggtacctccaacacgccggaggccatcacgctcaactgcgccaacaacctgccatgccagggcgtgcagctcgtcaacgtcgacatcaagtacaatggatccggcaacaagaccatggccggctgcaagaacgccattcgcaagtccatcggcttggcaaggagctcgcctgcatctgaaccaattgactaacatgcatatatatatatataat

SEQ ID NO: 16207 - DNA, 444 bp, Zea mays
  Clone ID: cC-zmpo148044c05a1
gaatgtagctacacatacgaatggacgaggagggggagctgtgtgtttacatacaaatatcaaaccgaggaaagcgaccatgttaaataaataaataaaatatcgcagagattttgcaacccctgcacgaaacgaaaccagtctccgctcctcagaaggaggcgaaggctcccgcggcgacagcggtggtggcgcatacgcgcgccgtggcgctggcgagtgcgacgggcgcgttgctggcggcggcgccgcccgcggttgcttcggcgccgggcggggcggggactttgtccctgggctcagtcatggtggctcccttgggcgcgccgacaggggcggcgtcctcgtcgtcgtcgacggcgttttctacagaggccggcttgtcgccgtctaaggaccccagcggggtatgctccacgggcggacgcgtgggccgactcctgg

SEQ ID NO: 16208 - DNA, 324 bp, Zea mays
  unsure at all n locations
  Clone ID: cC-zmpo148044c05b1
ccacggggcagacggcggcggagaccccgcacgggnacttttacatttacaagcccgacgccgacgacgacgccgagggcgacgacgaggacgccgcccccgacagcgcccccaacgcggccaccatgaccgagcccagggacgacgaccccgccccacccggcgccgaagcaaccgcgggcggcaccgcccccagcaacgcgcccagcgcactcgccagcgccgacgcgcgcgactgcgccgccgacagaagccccgcgggagcccgcgccaccgtcacaggagcggagaccggcatgcgcaccggcaggggcagcaaaaacc

SEQ ID NO: 16209 - DNA, 400 bp, Zea mays
  unsure at all n locations
  Clone ID: cC-zmpo148044c06b1
ggaggggaaaacacatgcactgggcncggggcaataccaacacgcgggacgggcacccacccacacgacgccgcgccgtaacacacacaacgacgcgcccgaggccactgcgacccgggcggcggccgcggccgacgaacaggcggcagacaaggcggcgggggaggagacgcctgccgcggccgacaggagcccaccaaggcgaatgcggcgggcgccccagaggcgggcgagagcgagcccgaacacaaggaggaggaagccgaggagaagacccccggcgaggaggagaagccggccgcaggcgccaaggcagaggggaaggacgccagcgccgcggagaccacgacgacggggggggcaaagaacaaggacccccaggaggccacgaaggaaaagc

SEQ ID NO: 16210 - DNA, 496 bp, Zea mays
  Clone ID: cC-zmpo148044c07a1
tttttttttttttttttttttttttttttttttaacccctaaagggggggggtttttggaaaaaaaattttataccctcaaattcagggtgttacaccgtcgaacataatatagctgtcggatgtctgtcgttttactgttgtgcgttaccaatggatagcatctaatgggcaatgccaggaccagagaaaaattattacttgagagatgggtcattcgatggagggtctataagcatgcaagctccttgaggcaacccttggtgctgcccttggcgttcgtgcatataaccatggtcttgttgttggggccgctatactcgacgttgacgtcatccatggtgaccccggtgcatgggaccttggcagtgcagaacatgctaacggcctccggggtggaggaggtgcccgtgatgttcttgaaggtgacatcctttgcggtgaccttggaggcgccgttggcactacacaacttgttggggcagtactttatgttt

SEQ ID NO: 16211 - DNA, 522 bp, Zea mays
  Clone ID: cC-zmpo148044c07b1
tggcgtgcacaaacaatgcgatgagagccttgttcctccttttccttttctgcatcgggcatggtgagaaggaggaggcgaaggtcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatttgctggcgaccacggacctaagccagtacaaggaccatggtaattggatcgagattctacgtgtggataacctggtcatcaccggcaagggaaaccttgacgggcagggcccaaccgtgtggagcaagaacttctgcaccaagaagtacgactgcaagatcccttccaacttgctggtgatggacttcgtgaacaaccgggaggtgt

SEQ ID NO: 16212 - DNA, 474 bp, Zea mays
  unsure at all n locations
  Clone ID: cC-zmpo148044c08a1
atcttgtattccttctcaagattgggggcggggctgtatactctgtatcagctgatgtgcacatgccaaaccctgtctgccaaataatcctctccgaaaacacaaacatgaggtgccgaataagatctacagtacatctcaagggacggtgcctacccatctaatttcccatttggcaagaaaaaaggcttctgaatcttgtcgaagcaaatcgagttccggccaataaagtgatctcccgccaattcgatctctcacgtcacgtgcagaggcaccaggtgcaccggcagaagctagggcaggagcaactgcagcaaccgcatcgtcaccactggcaccggtaccaccaggagcaatcgaaccagcagcagccgcagcagcagcacccggtgtcgctgttccgacgttccttcttcgtcgttatcttcatgaaggccgacacggngggctcgagctgctgctgctgcggcggcg

SEQ ID NO: 16213 - DNA, 455 bp, Zea mays
  Clone ID: cC-zmpo148044c08b1
cggacgcgtggggccccgtccccccggcccgcctcccctcgttttgtttctcctcctgttcttcaggacgtggggcatggtccccatcccgggtcgccgctcttctctccaccaagcacagcgctatgggacaatgccagggcggcaacgccgtcggaagagatggcagcgccggacgagccaaaggaggagggcatcgaactcgagccggccagaaagtcgacctcctcctcgtcatcggcgtcctcctcctcgtccgcgtcgtcggctgatatcccgtgccacatcgatgtcgtcgagctcgtcaacccgttggcagcggcgctgcccgaggacgaacacggcgcggtggtcaaaacggcccactcggcgacgctggaggacgaacgagccgctcccgccgtacacagcgccgaggccaaaccggcggacggcgcgatgactaaggatgtaca

SEQ ID NO: 16214 - DNA, 491 bp, Zea mays
  Clone ID: cC-zmpo148044c09a1
agttcatacattcacactagattgggcagggtaaatacatcagctgcaccaccctgatacactgcagccaagccttgctcaacccggccagaggacggattgcttacatcttactacaaggcatcggcccagatgcctgtgatcaaactggaacttttcaacaaattctaagggcctgtttggaaggcaggaaaaaatgtctgttcatgagcacagtggggaagccgcagtacactgggcatcagtaggatccttccgtagtgttgttctcttttcttttaatccagaacattgagcatcgtggaaggtctctagacaaagtagtcttgtcgcaccacagtgatgaaattgccagagagtaaatcatcctctttcagctttcctcctgtttcaccgctaccttggatatgccaatatattggggaaagaggagcatacagatctgaagtaagggttggatcatgttctcttgtagaatgcagtacaacagt

SEQ ID NO: 16215 - DNA, 455 bp, Zea mays
  Clone ID: cC-zmpo148044c09b1
gggtaaccaccatcccggacgcgtgggcggacgcgtgggcggacgcgtgggcggacttttggttaacaaggcattggatactttcaaggctgggggtgtttctcccatctactatgcgatgtttacatccctcacaattttggcaagtgccataatgttcaaggactggtctgggcagagtataagcagtattgcctctgagatttgtgggtttcttactgtgcttactggtactgttgtactgcattctacaagagaacatgatccaacccttacttcagatctgtatgctcctctttccccaatatattggcatatccaaggtaacggtgaaacaggaggaaagctgaaagaggatgatttactctctggcaatttcatcactgtggtgcgacaagacttacttgtctagaaacctttcacgatgctcaatgttctggattaaaagacaagag

SEQ ID NO: 16216 - DNA, 500 bp, Zea mays
  Clone ID: cC-zmpo148044c10a1
atgtgtaattgtgtatatatatacgggcggagcgccaccgtctcctccaccgtccaacggcacgtacggccgcgacgactacgtcaatgtatggtgtgcgatcggtggagccaggctgcgtgacctggcaggcaggcagaccagaccagaccagaccgaccggctcggcgacgacggcgcgccccggcagcagctagcgctgggctcagttcatgttgcgggcgcagcgcgtgatggcggagcaaccgcggcggtaggggttggcggccttctgcgcctcgcagttgctgtagtaggaccggccgcgcttgttgcacggcacctggtccgcgcgcagcgccgcgtagctgatgtaccggttggtcggctttcgctgcgccagcgtccgccgcaccgcgttgtcggagccgaggccgccgccgctcataccgagctcctccgccttgttcacgttgtactcgcccaccgggcccgagcacttttgcgggcccgcgccgctg

SEQ ID NO: 16217 - DNA, 355 bp, Zea mays
  Clone ID: cC-zmpo148044c11a1
ggggcgggtttttttttttgggggacattacctttggggttccctccacggtttatttggaaaaaaacaactttctttaaaaaatgccccattaataggaacccaacttataggtccccccataataaaagggtatcgcttgcggggcccccccgtgaccacctacctataaaccccctcagcgcctggggtgaaccccaccttaccccggggcatgcatacatgcatgcatgcatgggtcattcattccaaggggctttcttttaaaaaggggggggggggcaagaccccttggcgttctcggtgaggggcgggttttttttcttggcccaagggaccccgcaggccttgggga

SEQ ID NO: 16218 - DNA, 497 bp, Zea mays
  unsure at all n locations
  Clone ID: cC-zmpo148044c12a1
gccagcatgcctttttattattggccaggggatcgatgaaaaacacacatttgcgtgacattacatttggagttccatcgacggtatatttggaaaaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatgcatggttcattcatttcaaggggcttcgcttcaagaaggaggaggggtgcaggacctcttgcagttctcgctgaggcgcgggttcttcttcttggcgcaggtgacgctgcaggccttggtgacctcggncgccttcaccacgtacgccttgtcgcactccttctggcagacacttatggccggcgccctgatgcccttctgctcggtgcatttgcccttgcactgga

SEQ ID NO: 16219 - DNA, 220 bp, Zea mays
  Clone ID: cC-zmpo148044d02a1
cattacttcattttataggaaggagacggatacgggaaaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggccttt

SEQ ID NO: 16220 - DNA, 231 bp, Zea mays
  Clone ID: cC-zmpo148044d02b1
aggccttcctcccggcgtatttgctttggctcttctcctttatcgcctttagatatctagcaattggtgaggggcctagttagttcgctttgcttttgaggttgactcgaccattttgctgtagcgtgaattgcatggacatgcaacgctccaatggcctttggaatgtggaatttttttttcccgtttctgtatttttcctataaaatgaagtaatgaactggttcttat

SEQ ID NO: 16221 - DNA, 456 bp, Zea mays
  Clone ID: cC-zmpo148044d03a1
catcatatatattaatatcaggggcaagggcagttctcaacaatcccttgtactccatttttaaggaaaatatttccttatctatatataataaaaaaaattaaagccatacaaatgacgccccagacatgtctcttgcaccttgtcgtctcatgtagttagttcacacatgcacacgttcatacatagagtatgtacggagaagcaaatactcacgcgtgcacatgcaaaaaataaataaacaatttcacacacgcctgcaatgtacatgtagctgtttggttgcgcatgcgaccttatatattgttgttcaattcattcttggtcgaccatctctccatagagcttaatatccttggaatagaggaggaggcggagatgcgtatttgttggccatgataggtggaaggatgatgtctttgaatgaaggtggaagtagggcttttgccggtggtg

SEQ ID NO: 16222 - DNA, 419 bp, Zea mays
  unsure at all n locations
  Clone ID: cC-zmpo148044d03b1
caccgggaccagacaacacaccaccttcgacatttaagccaggaccnccaccngcgggggggaggggaccaccnccggcggngaagnccncaccaccgccgacaccaggcagcncaccaccaccgacaccgaagccaaggccgccaccngcacccgagagcacaccaccnccagaggggaaagcnncaccaccaccggcaccagacagcngaccaccaccgacgccaaagccagcaccaccaccgacgcccgggagcncaccaccnccaggagnaaagncngcgccaccaccaacaccagncagcgcaccaccaccagcaccgaagggaggaccnccaccaacacccgngagcncgccgccnccagaagggaagaccngaccaccaccaaccccaaggagcccaccaccaccagcgccg

SEQ ID NO: 16223 - DNA, 297 bp, Zea mays
  Clone ID: cC-zmpo148044d04b1
ggggggggcaagaaacaagaaaaaaaaaaaaaacacaaattaaaattttaaaaaaaaaaaaaaaaaaaaagggcccccgggaaaaataaaaaaacaaaaaaccccaacatcacatccccttccttaccacaacataccccaactacaaaaccgcctaaataaaatatactggccacggccttcacaattcccgacagaaaaaaccctctgcgcaccaaacttaactaccactccaaacatcccctcatgcccaaccgccttcaataccaaaaaatccccataaaaaatgccttccaa

SEQ ID NO: 16224 - DNA, 427 bp, Zea mays
  unsure at all n locations
  Clone ID: cC-zmpo148044d05a1
gggggnggggtttttttttttttttttttttttttttcccgccgaaaatttaaaacatgtttttttttgggagggaatttcccccccccccctcttaaaagaaaaaaaaagttcccaaattgcccgaggccaaaaaaaaaactggggagagggaaaaaaaaaggggggcccaaaaggggggggggggccccaatgggtttaaacccaggggaccccctttcccatgccaaagggcttgcccagggggtttttccaaaccgacatgggctggggggcggcccctttgtcctttaggtcccccctgaaaaccccccccccccgggggggccgggtgttggcccactaaaacctaagggcccccggcgggtgggggggcccccggatttttttaaaaacaaacctcgttacccccccccctgggggcccc

SEQ ID NO: 16225 - DNA, 326 bp, Zea mays
  unsure at all n locations
  Clone ID: cC-zmpo148044d05b1
aacagcaagttctgcttttatgaacaccagcgggagcaagggcgggngggggcgacaaggngacgancaaggcccccggcaacagccccaacacggacgggaggcacaccggcgacacgagcaacgggaccagcagcggcaccaccaacgccgacggcgacgaccgcgaccccaacggccccgggagcaagaccacccgcgngaagggcgccaagcgcggaccgggccacggcaccaccgacagcagcccggggcggcacaaggacgagaaggacgcggaggacgagaaggggacggggagcacgcncgccggcaccaccaacggc

SEQ ID NO: 16226 - DNA, 398 bp, Zea mays
  Clone ID: cC-zmpo148044d06a1
cttctccgggccgggttttttttttttttttttttctggcctccccttttttttttcctttttgggcccccccggccgacccttgggcccttattggggaaaagaccccgaattcccctcccccccatttttcctcccaaaaaaaaaccggcaaaaaaaaaaccccaaaaccccccccccccctaaccccatccgcccagggcccccccttttttaaaagggaaaaaaaaaaaaagggggggttggaattcccccccccaaaaggcctcccctcaaaaaccaccccccaaaagggggaacccccctggataaaaagccggaaaccccccaaaaagaaggcccccatttttatggcccccccccccgaggggccccgttcccccccaaaccgctccccc

SEQ ID NO: 16227 - DNA, 468 bp, Zea mays
  Clone ID: cC-zmpo148044d06b1
cccaggtcgcgatcgaggccgagatcttcgaggtgacaccggtttttcttttcgtcgaggtgaagaagtcggcgggcggcgcgctggagtatgagatgttctgcagcaagggcctaagaccttcactcagcgacatctgctggagcagccgatctgaggagaacatggctccttcagtggttcagccatcataattgaagccatcctcttagaccgactccagcactttatccatatggtctccccctcttagtcgattgttatttaagtgcaacctcttcggagatgcaattacaatccatcctctctttctttttccctttctcaaagagctaggaccttgctcgactgagcatcaggctgtagggctctttgtgatcatcttttgccagttttcttcttgtagcagaaattgttgggcatggaactcctgttcctttcaccaatagaagcacaatgatcagcact

SEQ ID NO: 16228 - DNA, 362 bp, Zea mays
  Clone ID: cC-zmpo148044d07a1
gagataaatttatatatatagggggggggtcactgattatttaaataaccgcagcacaccaattttagaaaacttgcagctgttgattacatataaacataaatatgctttctttcactacgcttccacaccataagttcttttgagttgctcccgtattctccaacctaaaaaagtaaacggggccatcgaaactttatcacgccccattcataggcgctggaatccatgatcacctcatccttgccagaactgaagtctgaacaagccatgacatacttggttttcaaaaattgaaaggaaaacacaaccccgttgttactctgtacaatgaggaatatcctctacccgaaggaggaatc

SEQ ID NO: 16229 - DNA, 389 bp, Zea mays
  Clone ID: cC-zmpo148044d07b1
ccccagagtctcagtggctgatgcaccattacatcaactacattatcttttaggatcccacactgccagccagggaacacgttctacttcccatgcatcatcctcctcacgaccgccactgacatcgcaactatcctcctgttcctccaccaagtgatgccagaaccacttgaccacccgcacctgaagcacgcccacatcctcctcaaccacaactgcttcaccaagaccaacgacgtcctactcactcagctcgacccacaattccgcgtcgaccccactcattccatgatcacatctactgacggcacctattgctacatagaccctcattacctacccacttgagtcctcaccacccactccgacctgttctttttcaccatcat

SEQ ID NO: 16230 - DNA, 337 bp, Zea mays
  Clone ID: cC-zmpo148044d08a1
ggaggggggtgggttggatttcatgctgcccccaactgttcattaataggcaacacatgaactaccctgactgacccaaaccccattaagtttacaatccgacattcacaagaggggaaaatgcgattgcttcgtgtcgcctgttcttccttccttcacctgctggctgcaacaggagggatgcttacccactgcagctgcaactgaatctccccgctctccacgttcctgaggcggaggatcatgtcctgcgcgaacttgccgttcctccaacacacgtggcttttgtcggcgaggcatttcgtggcgctcggccccacccacaggatgatggcgc

SEQ ID NO: 16231 - DNA, 550 bp, Zea mays
  Clone ID: cC-zmpo148044d08b1
gggttaaccacacgtccccccacgcgtccggaaagaagtcgcctaattctttcgatcgatttaggttctcttcttcgtcccacgctccggggtatggggatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactggctcgccgacgagagccacgtgtgctggaagaacggcaagttcgcgcaggacatgat

SEQ ID NO: 16232 - DNA, 500 bp, Zea mays
  Clone ID: cC-zmpo148044d09a1
cttcaataacaaggattcagggtgggaatgacttacaggaagaaacaccagaggctgggaagcaatagcagacaagaacacgttacatcaatgtaaacgtcggctttacatgtccaattattaaccagccagatttcaagtacaacaaatacaggtctttaaacagctgatccttaatgaaaaatgaagctttatccgtgcccccgtgacatgatggcattcagtgcctgcaacaggcccttaccaaacctcagggcggagctcaccagtagccgggggcatccatttcccagagttgtacacgctctcgccgaccttccaccctggaacgtctttcatgatcctcgcctcctcctcaagacacttcttccactctttgacaaatctttcatcctcttctgcttggagcatcggcagtatagcactgcgagcagcaattttttcttctttgagcgcccggcggaccttgttcccctggccgaccctgtacatgccatatg

SEQ ID NO: 16233 - DNA, 591 bp, Zea mays
  Clone ID: cC-zmpo148044d09b1
ggacgcgtgggccgccgggcggtttcacgcccgtgcgctttttccgttttatccccacctcggggcccagggggaccggggtcttcctcaccaccttcggtgctttcgcatatggcatgtaccaggtcggccaggggaacaaggtccgccgggcgctcaaagaagagaaaattgctgctcgcagtgctatactgccgatgctccaagcagaagaggatgaaagatttgtcaaagagtggaagaagtgtcttgaggaggaggcgaggatcatgaaagacgttccagggtggaaggtcggcgagagcgtgtacaactctgggaaatggatgcccccggctactggtgagctccgccctgaggtttggtaagggcctgttgcaggcactgaatgccatcatgtcacgggggcacggataaagcttcatttttcattaaggatcagctgtttaaagacctgtatttgttgtacttgaaatctggctggttaataattggacatgttaagccgacgtttacattgatgtaacgtgttcttgtctgctattgcttcccagcctctggtgtttcttcctgtaagtcattcccaacatg

SEQ ID NO: 16234 - DNA, 448 bp, Zea mays
  Clone ID: cC-zmpo148044d11a1
ggaaggaaggttctatagaacaagggaagggcaagcatcaacagcaacgatcgacggaatgggccacgagggtggtatgctagtgtaatagtataacatggcgacaacacgaaaggggacatcaaaactcatcggggtccctgcaaccaccaggcttcacatttaacagccttccctcacatgccatcagctggctcctcctcgtcctcatactcggcctcctcatcgtcatcagcagtcgcatcctggtactgctggtactccgatacgaggtcattcatattgctctcggcctcggtgaactccatcttgttcatgcccttgcccgtgtaccagtgcaagaaagccttccttctgaacatggcagagaactgctcgctcacccttcggaacattttctggatggaagttgagttgcccaccaaagtggacgccatggacaagcccc

SEQ ID NO: 16235 - DNA, 525 bp, Zea mays
  unsure at all n locations
  Clone ID: cC-zmpo148044e01a1
gttcanaaaaaaatattgagttagcgtaacggacttaatacatgaacaagataatgaaccttgagcatacatgaacaagatacatgacagtcatcagaatatacatgacagtcaccagaacatacatgacattcgtcataaataagaacgagataatgaacgttattaagaataggttgtcgatgcatggcaagcgatcgagcgatcttgtttagcactgcctagtgcagatgcagcggcggcggaaggtgctgcacctgccggccaagaagccctcaccgcggcacacattggcgcagttgtctgcgatcatgcatgccccaacaaatcgctcactgtacttctcgcattcccttgcctgtgccatatcggnggacacaatgagcaggagaagcaggatgacggccggctggaacctgcgtgacgactccattacctttatcttggcaggaatatatatatgcacgcttcaaggattcacgaactatttatttcaattattttcgacgcgtgggcggacgcctg

SEQ ID NO: 16236 - DNA, 524 bp, Zea mays
  unsure at all n locations
  Clone ID: cC-zmpo148044e01b1
cgggcgcccacgcgggcgaaagaattggcaataaatagttcttttatttttgaagcgtgcatatatatatnngggccggggtaaaggtaatggactcgtcactcacgttccagccggccgtcatcctgcttctcctgctcattgtgtccaccgatatggcacatgcaagggaatgccagaagtacagtgagcgatttgttggggcatgcatgatcgcagacaactgcgccaatgtgtgccgcggtgagggcttcttggccggcaggtgcagcacctttcgccgccgctgcatttgcactaggcagtgctaaacaagatcgctcgatcgctttccatgcatcgacaacctattcttaataaacgtcattatctcgttctttattatgacgaatgtcatgtatggtccggtgactgtcatgtatattctgatgactgccatgtatcttggtcatgtatgctcaaggtcaatatcttgttcatgtataaatatgttatgaataactcaatattattaatttgtcatg

SEQ ID NO: 16237 - DNA, 496 bp, Zea mays
  Clone ID: cC-zmpo148044e02a1
aaatagccgacacgttgtgtgggggggggaaacttttcctttacaacccagcgaaacagattgttcgtcatgatccggcctaaaaataaacccaccggtttaggcctcggaagcggccttgagaacaaacacctggccgtccaactcccaaaggtaaaagaatcgtgaaccacagtggaccatgcatcctagagttgtgatcatcaatggcctcctcccatggagacggaccggaagctggtcttgggctgctttggcagcatgatgatccctgcgacggcagcggtgaaggcgaagacggcggcaaggccgaacgccgggatgttgcccttgccgaacagctcgtcccacggcccagagccaatggcgatgaccatctgtggcaccacgatggagatgttgaggacccccgtgcacagtccctgcccgccggccttggccgccgccagctgtgccgtcacggcgaacggaacgcttgataggaccgctaatggga

SEQ ID NO: 16238 - DNA, 453 bp, Zea mays
  unsure at all n locations
  Clone ID: cC-zmpo148044e02b1
ggccgaaccacgcgggcggaacacgggacccagcacccccancanacccggctttccatttgcggaactaggcaccacaccaaggggccgngggggaacaacaaacagcggacaacggcgacgggcaagggcagagcacgggggcccgcaacaccgccaaaggggagccacaganggccaaagccaacggggctgagccaagggacgagccgtgcggcaagggcaacatcccggcgcccggccttgccgacgacttcgccaacaccgctgccggagcacggaacatcatgctgccaaagcagcccaagaccagccaacgggccgtcaccatgggaggaggccatggatgaccacaacactaggatgcacggcccactgtggtccacgaaacttttacctgtgggagcaggacggccaggcgatagacctcaaagccgctgccgaagcctaaac

SEQ ID NO: 16239 - DNA, 334 bp, Zea mays
  Clone ID: cC-zmpo148044e03a1
acaaagcagaccaatcacatgcgtaatgctcattttacaaatcgtaagacaaccaaacttgttttggggtcaaatcacaaaattatttgccaaaacgattcaattaaattattttaaccaggggggaaaaaatgcccaactaaggatgggtggtgatcaacggaacggccacgcacaatcccagggcatggagactactaattaattaacgttggcgttggtgtccttgttaggatgcattcacaggccttgctctacgaggtatttaccgagccttttaaccaccatgttgcactgtccatgggttatgggctctttttaaatgccgatcacc

SEQ ID NO: 16240 - DNA, 445 bp, Zea mays
  Clone ID: cC-zmpo148044e03b1
ccccaacgggaggtttactgcttttgcaagccccagcgggacgggggggaggggcgacaatcacagcacaggcacccccggcagacgtacctggatcagcagcctatgggcgagagcgagggccatcacctgagctctgccagcataaggccgcacgagggggccgcatgggcccagagcagcgggttcccacagttgacgccctacgagatgaccaacatcattaaggacctccacgagcacgaggtcgtggccacgagcggccattagctcggcgccaccaaggccatggtcatccaacgggagcccggtgctgccattcgcgggaagaagggatctggaggcctacctgggaatacaacccgacaggcgctggcgatcggaaacgacaatgagcccatgacccctggacagagcaacatggcggctgagaggctcagcgact

SEQ ID NO: 16241 - DNA, 546 bp, Zea mays
  Clone ID: cC-zmpo148044e04a1
gtcgtcgctgtccttcttggtttcgatgacagtctcgaaggcgcgggcgagggccttgaccttgctccgacgcttctccagcagcttcgtgcgcgcctcctcgatcacgtcggtgctccgcgccacctctcggcgacgcggctgctccgactccgctcgcgcctacaacgccgtcctcacacggctgccctggaacctccgcattgcctcctccttctcgtcctcctccgcctcctgcttcttgatcgcctccttcacaaccgtcacgaacttgtccgccaccacgtcttccactgctgctacggcaacgatggcctccggcgccggcgccggcgacagagccgcttcttgcttgggcgattccaccacctcctccttctcttcgaggttgcggcggcggcggcggcgataggctccggcgccggcgacagagccgcttctttcttgggcgactccaccttctcctcctcctccttctttgaggttgcggcggtggcgatgacgatagtctccggcaccggcgacagagccgctcctttcttgggc

SEQ ID NO: 16242 - DNA, 434 bp, Zea mays
  unsure at all n locations
  Clone ID: cC-zmpo148044e04b1
gcatcccgcctggccttttttggttgactccgaccaccgaacatccggggccgngggggcgtcgaacgacctctgcccaccccgaactgcctgcgagggcttctgatggccactcgacgccgtcctttgcttctagtgcccagatttattgcagatccagccctctgatcctcgtcttctttcaactctccaacatgaaggcaaacaccaagatcaagctggagccggtcatggtgccgacgtcgtacctgacacagagcgccagcgagctacccgacccgccgcaaccgttcagatacaacacagaacaccaccccgtgtccgtgcacaccacacctaagttggccttatagagctagtacctcggccacatggagaaaacggccaccgacacacagccgatcacgcccaacaagaagtaagaccacaagccg

SEQ ID NO: 16243 - DNA, 475 bp, Zea mays
  Clone ID: cC-zmpo148044e05a1
aatctccaattagaacatgttgtttcatcagaggagctccgtggaggaaaataatgggagacatccaagaaggttagtttgttacatggtgtggccagtcgagagtgtctttcccgacctatgccgctatgccaactgtagagaattcaagtgtcgtctccttgctcgatcacacactgatcatcaggtatcatcagccaataattatattagttggcacgcgcatgcacggacagtcggtcagctttgctgcgcctgcttctccttcctggcctcctcgacgtccttcttcttcgcctccaccgtcgtcgtggtctcggcggcggtggcgaccttttcctctgcattggcggctgccgctggcttctccttctcgacgacggtcttctccacggctttctccttcttgtgatcgggctcggcgacggtcgcctctggagcgaccacctcattagccttctgatgctcaacgtcg

SEQ ID NO: 16244 - DNA, 373 bp, Zea mays
  unsure at all n locations
  Clone ID: cC-zmpo148044e05b1
caacaattttgctttttcaaccgccacatcaaccatgggcngcggggggacttaacccaagacgcttgaggggcatgccccagctgaggccgccgtctccacacccaaggttgcgcccgaggccactccaatctgcgttgaggttgccgctgatgaacatgtagatgacaaggtggtggtggaggagccggctgccgcggtcgctgttgaacattacaaggctaatgaggtggtcgcttcacaggcggccttcggcgagcccgatcacagggaggaggaagccgcgtagaagaccgccagctaggaggagaagtcatcggtatcccccactgcacaggaaactgtagcaaccggctgaaagaccaccacgacg

SEQ ID NO: 16245 - DNA, 238 bp, Zea mays
  Clone ID: cC-zmpo148044e06b1
gggccggcacaagcagggccaactccccgggagcggcaacaacgctaaggggcacaaggcccataagggggccaccggccaggctgaggccgaccaaggcccaggacaaggatgctgtgcacccctcctggcatggcggacaaagtgaagaccgatgtccattagattcggctctgtgcgtcacccaaacttcgtcacgcctcacaaaatgatggccacgcggttccaagatctactt

SEQ ID NO: 16246 - DNA, 447 bp, Zea mays
  Clone ID: cC-zmpo148044e07a1
aaacaaatggaaaaccaaatcatagattgatcgcatgattacagaacgacttgacacaaatagataaattaaatcacgtctatgtaattaacacaacccgtcaccatgcatatatattcatatcagatcacatcaataataatatatggaaacagcggtgcaggtgacgtcttccaagtcgaccaccgcagcaacagtcaccaagaacgagcgaggcaactgcaatggcaacggtggacggatccatcgtcgtccatgcgcgcgtacgtaagcacgcacactcttagtggaggtagtaggctaggagggagaagaggatcgcggcgggcgccgcggcgagggcggacgcgccgctgctggcggagggccccgcggcggcggcgccagcggcagcgccagcgccagcgccagcgggagcctcggcggacgactcggaggcagttgggg

SEQ ID NO: 16247 - DNA, 506 bp, Zea mays
  unsure at all n locations
  Clone ID: cC-zmpo148044e07b1
ataagggccanccaaagaaacaaattttactttttccgccgacatccgagcgaacggggcanngggccccntacccaaggcaatccgtcgccaacgtaccaccaccaccgcaggagcgagatggagatgaagaggatcctcttcgccgttctcgtcgtcatcgccgcctcggccaccgtaatgctggcctccaccgaggccgccggcgagggcgccccaactgcctccgagtcgtccgccgaggctcccgatggcgctggcgctggcgctgacgctggcgccgtcgacgcggggaccttcgtcagcagcagcgcgcccgccctcgccggcgggcccgccacgctcctcttctccctgatcgcctactacctacactaagcgtgtgcgtgcttacatacgcgcgcctggacaacaatggatccgttctccgctgccattgcagaggctgtggttgttcttggtgactgatgataaggagttctatttggaagacgtcacctgcgccg

SEQ ID NO: 16248 - DNA, 460 bp, Zea mays
  Clone ID: cC-zmpo148044e08a1
ctgacctgtatggatgggcaggttaatgacaggttatatctatttaaggaacattatgttacagcacattcgaggatgtaggggggagggggacatgcgggagtacaatggaagccatcatcgaggaaggatcagcgcagaaagctcagggacaagagggcaacgatggcagcccacaagaggccattccccgcgttggagctggacgccgaggaggtattgtcagccgcctctggcgccggcgcgtcggcggtgatcacagctttaactggaggcagcggcgggtccacaacgtcggagggttggagcaaaggtgccggtgctcccgccggagccagcgttccgggggctgccaggttcaccagagcgccaggttgtgcaggcaggatcgagtagcttaggttcaggttcatgtcactgcatggacttctgaagtacgaagccgcggtggcagggtagt

SEQ ID NO: 16249 - DNA, 605 bp, Zea mays
  unsure at all n locations
  Clone ID: cC-zmpo148044e08b1
gggccaaacccccgcggcggcgnnnggcaggagctcacgacattaatgcgctgttatgttttttgctcctcctggccaaatggggggaagggatcctcacatgcatctggtcctactgctgcttcatggagccagtgctgctttgaatcctccaacagcagggccaaaatggcagactctgagcggtcgtccccctcaagtcgtaactcgaggaggattctatggtttgtttcctgactcgagccacatggcctaccagcttgccttgtctaccagcttgcctgacgtcgttctgttatgtgatctacaattctcaagcgaccgcataggctactgtaagacagggctgacccttgataactcgaccactgtcgctgagatcttccccaagatggacaggacgtacaagctgcatggagaggatgaccatggctggttctccctagatatcaccgcggagcagctggttcacaacgtcactttgatccagaacatcttttctcgcccgagcacattcgatgccttctttgggatgtacacgctcgatgatgtcgttgaactccacccccctcaaatatggctgaatgtaaagaacaattaattct

SEQ ID NO: 16250 - DNA, 112 bp, Zea mays
  Clone ID: cC-zmpo148044e09a1
cacactatcattttataaaacacccgaatctctatagggggggggggttaattttacaaatggatacccactaatggtcaaatctatgtcaaaagaaatatttctaccaata

SEQ ID NO: 16251 - DNA, 488 bp, Zea mays
  unsure at all n locations
  Clone ID: cC-zmpo148044e09b1
agagacaccaagggttgaactcncctaaacagctaccaatcataccttagaaagctagacaccgtaccgngggatcgggctaacgtcatctttgtcattgctgctctcctcttcgtcgccatggtcgtagcaccgatggccgaggcaaagtctgccgatgcccctgtggctgacgcgccggccgatggacctagcgggccggctgctgcacctggcccccagggtgtcgaaggcctgtcaggcaatgaggatgacgatgatgactccaccaactgaggccacacatgtcggcccggttaaatttggaacaagacatggaagaaaaatgagagcaatgtctttaaaaccatgaatccataataatgtgtggtcatccatggatacatccttgctctccctctttttctttctgtgtgattttcaatgtgttatcatgttggtagttaactgtatcgactcatggtatcaaggtctaaaaaattatcgtc

SEQ ID NO: 16252 - DNA, 431 bp, Zea mays
  Clone ID: cC-zmpo148044e10a1
gcgtacaaatatttcattaggcgggtaggatataacttgtcaatccatttcttaactattctcttttaaacaacaacgaagtctcactctagctatatatggagatggacaagatggagaaggaggatgacgccattattgttggcgccagcatcactgtcgtaatagggtagtggtagcaaatagatatcacggtccaatgcatgcatgtgtaatgcattgcttgggatccaacccaatctagtatagctagcataggccgacttaaagtattgtcaccactaaagttaattatttggcggcgtaagcggtgttggccttccagttggcatggatgacatcgccgtagacggtcttggcgcctccctccttagcgaggcgcacggtgaggggtcccttaaacggtaggtcattgtccttcctccagatgg

SEQ ID NO: 16253 - DNA, 478 bp, Zea mays
  Clone ID: cC-zmpo148044e11a1
aatgcaaattctatttcatcgtggggggtggattatagatttacaaggacaataatctccatgactgcacgacaacatagatctaaaatgccaatgcatcgttgaacccggcatcataagcggcgtcggtctcatagtcaccgatcgcctctccgagcattatccccccgaccgcaccgtctaggagccctaggccgagccccatccccatacctacgccatgcctcgccggtgcagctaccggctgtgctgcgtagttgtacatcgccggttgtggggaagcagcattgtacccgtacggtggcggagcatggtacccgtaaggctgccgcgggtacgccgcgtacggcgaacaatattgttgcggcgggtatgcggacgccatggcctgcggcggtgggtacacggtgggcggcaccatactcttgtccgtagtgtttttggagtcctgcacgtactttttggcgtactggacttg

SEQ ID NO: 16254 - DNA, 378 bp, Zea mays
  Clone ID: cC-zmpo148044f01a1
aggcccaccaatagcgcgggggctgaaggcctttatttataggagtccaactctatttaacaggaaaatcaaacaagagatgtccccctaaacaacttggctgaaacacaatctaatttggaaaaactaatgaagctcaaattaaaaagaacttgtgagctatatcattatcaaggatgacataccatgcatgcatgcaaaaggaaggtcattattataccaggcaagccagtgcctctatgcttcccttggcggtgcccttggcgttactgcaaaccgccatggttttgttgttcttgccggcgtactccacgttgacatcgatgagggaaacccccctgcatggcttcgtttcccaacaaaacaagctgatggcct

SEQ ID NO: 16255 - DNA, 448 bp, Zea mays
  unsure at all n locations
  Clone ID: cC-zmpo148044f01b1
cgcggccgaagcaatnccaaataaatactctcttgaatttcttaagcggacacatctatatcggggtgggataaagtaatagatccttaacaccaaatccaacctggcgcaaatctgcttctgatgctcattgtgggcaccgatatggtacaggcaagggaatgcgaaaagtacaaagagcgacatggtgaagcatgcatgatcgcacacaactgatccaatgtataccgcgatgaggccttcttggccagcagacgcagcaccaaacggcggcgctgcatatgcactccgcagagctaaacaagatcgcacgatcgcttgccatgcatagacaacctatgattaataacgttcattatatggttcttatgaacgacgaatgtcatgtatgttctggagactgtcatgtatattctcatgacagacatgtcacttgaacatgtatgct

SEQ ID NO: 16256 - DNA, 527 bp, Zea mays
  Clone ID: cC-zmpo148044f02a1
aacctggccttgtgagttacagggaccggtttacttttgtgatgagtatgacagcatggttacattatagtacaccggaacttctagttcattaaaaactattcagcatagtactggtactaatgttatatttcaagatttggatattgcaaaagaaagacaatatacaacacctccacttagcgaaggaacaagtgctgtacaggtttgctgctctaccaattgaatgatcagactcagaagtagcaaccagttcaaagaaaaactgagttgctctgttttgcaggagcacccattggggcaaggtcactgaaaggatcaccaaatgggttccaagcttcagatgtaagcacagagtactgatactggtggtgatacatgtttggcattggcattgccaacgtctgttgatgctgctgaaaatactgctgctgctgtggctggaaatacagctgcgcctggtaatactgctgcgcctggtaatactgttgttggttctgaaccataagtgccaactgcacaataac

SEQ ID NO: 16257 - DNA, 469 bp, Zea mays
  unsure at all n locations
  Clone ID: cC-zmpo148044f02b1
ggaccaaggggatcggcaccaagcggcattaaatatttaaattttggaggcaggacgccatctgaggggctaggggnactacccatctcgctttgggtgatcaccgcctgatggggtcctggcgcaaggcctacgacaccctcaaggactccaccaaggtcggcctcgccaaggtacaacagcgaattcaaggaattggatattgcaattgtgaaagcaaccaaccatgttgaatgccctcccaaggaacggcacgtcagaaaaatactcttggcgacctcagcaaaccgccctcgcgcagacctctcgtactgcatatacgcattgtcaaggagattgtccaagacaaagaactggatagttgcgctcaagacattgatagtggtgcataggcttctgaaggagggcgatcccatgttcaaggaagaggtcctggcctactcatcccgagggaacatcttgcacatag

SEQ ID NO: 16258 - DNA, 229 bp, Zea mays
  Clone ID: cC-zmpo148044f03a1
agtggccatgataaaattgggagggcatggctaggatatacatagacaatacaatattcgtgttgttgtttgtcacactccttatatccttttattaaataaaaaattaaaaaataaaggtctatcaagtgtgccatttgatacttattattatttggttagtttatttggcggtgtaggcagtgttgggctttcagccggcggggatgacatcgtctgagacggtctt

SEQ ID NO: 16259 - DNA, 237 bp, Zea mays
  Clone ID: cC-zmpo148044f03b1
cgaagaccggctacgaggatatcatccccgccggcttttagctttacactgcctacaccgccaaaggggctaacggaataataataagtatcaaatggcacactcgatagacctttattttttatttattattcaataaaaggatataaggagtgtgacaaacaacaacacgaatatggtattgtctatgtatctactatatatgcaatcccaattttatcatggccacttttgctt

SEQ ID NO: 16260 - DNA, 381 bp, Zea mays
  Clone ID: cC-zmpo148044f04a1
atattatattttttttttttttttttttccagggccggggttgttttaaaattgaccattaattaccggcggtattccaaacacaagagttttttacaacacaaccttgcattgttaccaacgatccccaatgaagaaagctgcaccctaaaactgcacacccactaacactttctgcccacccggtaattgaacccccccgcgtacctggtgaacgaatcggtgtactggccccccttggcctggatgagggaaaacctttcttacttgccctcgttctggccccccgactgtttgaaaaaggcccccttaaagaacaagttcttctgcgacttccacacccaaatttttgactccctggactgcgcgtacccccccttg

SEQ ID NO: 16261 - DNA, 361 bp, Zea mays
  Clone ID: cC-zmpo148044f04b1
cgcaccagggagccccaaccaaagaagattcaatattttacccaccaacaaccgccggggaccggggggcgccccacaacagaggagcccccagccaccccgccgctacatccaagccgacgcgcccgccaccggcgtggggacgccaacccacgccgaacatcgacgaagaagacccgcacctcgtcaacccaacccctaaccaagagcactaagcggaacacgcacaggcggcgcacccctacaaccctgcggaaccccacaccgaccgagcgggcgcactacaccgcttacacagccgcggacacaaggcgaccgctacccggccgcgggccctgccgcacagagagcagggaccacg

SEQ ID NO: 16262 - DNA, 400 bp, Zea mays
  Clone ID: cC-zmpo148044f05a1
acttatcgaaacttggacccaaatctcaggggcgaggtacacacttccagctttacacacaacacaaggctcagctcagcacaagaatagtttttgtttttgcaaatttacttgaatatataccaatacgtaacagcattacaacaacatgacggactgtaccagtctccactgcatgggcaggacgagatggtttcactttcaccgcgccgacttggaaggctgggcttgggcagcgagggtgcgccagaggtaccgcccgctcgccatgtccaccatcgtccagaaccctgctttcacggccgatccaaccttggaatgaaggggcaggggtgccctgggggatcccgagtcgtcggcgtcggcgtcgaactggtcgggctcagcgttgaagcccctg

SEQ ID NO: 16263 - DNA, 525 bp, Zea mays
  unsure at all n locations
  Clone ID: cC-zmpo148044f05b1
cgtccgctgggatgggaatncggtacgcttattaagaangaagcttttccgttttagggacggctcaggcgttagcgcgggggccnggggtgctacactctcccgagaaaggccaaatagaaaccgttcccaccaccaacccaggtcgactcaccccccaacccaacccaaccgcggcatatggtctagctttcccatccccttcggcagcctggtcagagcccaacccgcccggatccacaaagggcgccggctattgctgaacccacgttcgcgccggatatgatcgagtggatgggcacgatccctggtcgggaatcaaaggaggcagcacgagaagagatgtgcccgctgctggcgaacctaatattcctcttcgccaccgatgccggcttgtgtcttatcagaggccttaacgagtgaaccttaccactgagactccgacgccggctactggggatcccccagagcaaccctgccccttcattttaaggttgcatcggccgtgacaccagggttctagga

SEQ ID NO: 16264 - DNA, 355 bp, Zea mays
  Clone ID: cC-zmpo148044f06a1
aattattaatttctcggcccgggttttttttttttttttttttttttttaaacaattatataaaaattttaaaaaaaatataaataaattatttttatataccaatcaaaaaaaaaaaaccaaaaaaaaataataaaaaaataaaatccaaaataaaaaaaaaaaaaaaaaagaaaaaaaaaattttctaaaaaaaaaaaaaaaaaaaactcctatcaaaaaacaaaaaaaaaaaaattaaaccatgttattacaaataaaaaaaacaaacaaacaatttctaaccaattctaaaaatctttctatccaacccataaaaataaaaaaatatatcccccccccatatataatacaa

SEQ ID NO: 16265 - DNA, 441 bp, Zea mays
  Clone ID: cC-zmpo148044f06b1
gaagttacggggcgacccccgcggccggaagaaacttacggggattcccctagtaacggcgatgcgttttcttccttcgttttccgcgggaagaggagggggtcgaggaaagggaaacatgattgtgtgttcgatactacgattacgaacttcgttttcccttcttttttgtttgtttggaaggggaaatacttctcttctattctacaacaatgtcacgtacatgcaatgtaataataaaaaatgtatgtgatatatttaacaatgtgattgatgattgatgaaaaaaaaaaaaaaaaaaaaaaaacgaacgaaaaaaaaaaggaaaaaaaaaaaaaaaaaaaatcaattataaataaagggggggggacttgggaaccaaacatttatttcccgggcatcgcattacaaagccctgttggggggggcccttaaaaggaa

SEQ ID NO: 16266 - DNA, 491 bp, Zea mays
  Clone ID: cC-zmpo148044f07a1
aattataaaaataaatggctttaatacggggaggatgttcaaatcgggagagagctttatatgctactatcgatatacaaaccgagagcacagtacatatggcacactactacagggcacgcatgtattgccgcttataaatgtgggaaaaaaaaagataacccgtttctctagcaatggaaagaagaaatgacaaaaacacggcacacacacagagaaggatggttttttttcactgatggtcgtctgatggaaacacttgttccgtagtgtatacgtgtggacgtgtggttaatttcatgcaggagctctcccttaaaccttaatcactgcagcagcagcagcagccgccgccgccttctgatgagcggcggcggcgaccgccgagaaggtcttctccatgactttgagcttctcgggaggcggggccgcaaagaccgcgtcggccgcctggccgtatgcagcaaggatttttgcgatcttgtccttgt

SEQ ID NO: 16267 - DNA, 630 bp, Zea mays
  unsure at all n locations
  Clone ID: cC-zmpo148044f07b1
ggggcgacccccgcgtgcgcgatcgattacaggggtggcggccaaggtgttccttctccttcgactcagcatggncgccgtcgggggggcggggatcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttctgcgagacctacgccaagacggagaaggccttcagcggaaccatcggctccggggacacgcccaagagcaagctggggatcacgggcgccgtgctcaagctgaggctcggcaccgacgccaacatcaacaaggcctacgcggagggggacaagga

SEQ ID NO: 16268 - DNA, 356 bp, Zea mays
  Clone ID: cC-zmpo148044f08a1
ggggtggggttttttttttttttttttttttttttccacaaaaagccccatttcatattataaaaaacaaacatttgtataagtttgtccactcgcaatgccgctaaggcgcctaaaaaattaacataaaaaccttgctttaaaaaaaatgacccaaaaacctgggtttatttgaaattattttttttgccgcaaaaaaaaactgggggtttttaaccccccttacctttgaaagaattaactggtttgacaacccccaccgccggggggggttggacaccccccaagccctaagggcccattttggggggggggaggggaactttccccaaaggcccccacccactaaaatttcg

SEQ ID NO: 16269 - DNA, 492 bp, Zea mays
  Clone ID: cC-zmpo148044f08b1
gcgtgcgctcctggtgatcctggccaccacctagacatcacttctaattttctcggcagccgccacacctggggcgtccgggcacggtgctgcatccagagccaggcgctcctgcacagaatttaggggatggaggccactggtgcaagtgccactcaccaccaccaagatggacgctgacgacatggaggatgtacaagcccccacggtcgtccaggttgtcaaaccagttgattccttcagtagtaagggacgttgaagacacccagatcatactagcgacagaaaaaataattacgaatgaagcaaggctcttgtgtcaattctcttgaaacaagggtcttatgtcaattctctatgtaccttagcagcattacaaactaacaactcataacaatgtttgtgttatgaaatatggaagtgagcttactgttcatgtagatagttaactgtatcgacctcatgggtttaagggcctaaaaaatattcgtc

SEQ ID NO: 16270 - DNA, 385 bp, Zea mays
  Clone ID: cC-zmpo148044f09a1
caggacagggttttttttttttttttttttttttctttttcttttatttattttttttttttagggcccccccaaaaaaaaaaaaaattttggggttggtacctaatccgggtaaatattttatgggaaagcacaaaacggtttaaaatatgggttttttttttaggaacccttatctctacaaaaatgggtttttcccctggccaaaccccccaaattttttttttaaaaaacgggaatggggaaaacctaaaaagaaataaaccccctctgggcaatttttaatttcctctttttttttttttattccggaaaaacctttttctccaccctccctctcacaatttaatataaaatttttttaaaaaaattttccaaaaccccc

SEQ ID NO: 16271 - DNA, 379 bp, Zea mays
  unsure at all n locations
  Clone ID: cC-zmpo148044f09b1
ccgggagtggaagcactggggcaccgacaagctcgagttcgccatttacggggtcaccgacacgaccggggccntggcgatattttctcaaggacagccactaagaggacatctgccaggtggtgctggtggccaggccgcgcaaggtctgaaaccaggtgcaggtgctcagggacctggccggcgtcctgattaccaggaacgttggtatatcccacagcctgcggctcgccaacccgctaggcttcttaaaggacgtgccgctccccgtctgcgcaccgcttctcaagcagctggactagggcgacgacgacgaccactatactataccactgcagcgtcgcggacatccttgacaatgatgcaccgattcataacg

SEQ ID NO: 16272 - DNA, 276 bp, Zea mays
  Clone ID: cC-zmpo148044f10a1
ataattcaactcgtattcaaatagggaggggcgcaaggcatgctacccgcaccgccttttgcctgtacagccaacaaaattcttgagtacaaagaacgtgagattcaatacaatacaatacttccggttgcactcatcctgtactaaacccactagcctggtaccatatctgataacatgtcagtcgtctaccacctttgtcctgtaaatcttcactcaaaagtggtgtgtattaaaatggttctctatgttcaaatggtaataataacccattgt

SEQ ID NO: 16273 - DNA, 350 bp, Zea mays
  Clone ID: cC-zmpo148044f11a1
attaaacatctgaccatcacaagggcccgggttttttcttccagcagtataaacattcaatataccatggtacaatcagggagtgtgcagtgctaatcactacacacgctgttaagtaacatcacacaagtatacaacaacggtttgctgaaggccttcagctacagatatatataaatccccatacagggataacaaagtcagaaagaaaaacaatcgtttatgtgaactcctcatgtcatgtgagcgttcctaaaagggcgacagcaaaacaatgtgacaggtttctacctgtcttatctctctctttcctagcttggtgcatgcacaccattgctcaaactatcatt

SEQ ID NO: 16274 - DNA, 406 bp, Zea mays
  Clone ID: cC-zmpo148044f12a1
ggcagggggggggcatttcccatttcctttggctgcaaaatcctagtgtatttgaaagaaaaaaacctccgacttgctgtcctgtcctgccttaactgctcatagctcgtcgcgggaatcactatcgacttcaccttcgctggcgtaatgatcatccatatacacggggctgtaaaaggatatgtagtcgtctagcatctcctccagcgacagtttgccgtcatggttcacatcatcctttatcaaaaacttggcatgtgaggtagcataggagaactcccccgtgacgaggctctgcaatacacagcgcgctttttccaccgtaaagtagttgtccttgtcggcgtccagttttgtgaacttttttgcagcttcggcacgcccaaggtcatgggcatggccaccg

SEQ ID NO: 16275 - DNA, 546 bp, Zea mays
  Clone ID: cC-zmpo148044g01a1
atgtcattaacatatgtttagccccatcatgcgacggggtttattacaagacaacgatgtaacctcttttaaatgccggtggacggctccatactccaagggctcatcaagaggaacctttcgtcgacccaacttgcaatcaaccgggcgtgaaggtgaatttgttcttcaatacgatatagctcctcgtcgctctgtccggcggcaaagcccttcatgatcacgatcgtgttggtctcgtcaaaatgagagccatctacctcaaggctatactgctcccatagactacaccctcaaggaccacgtattccacgtggtcaggtaacgtcctcaaccaatcgggcagggcaactttgaccggcggagggggagaaaggtgggcgcacaccgtgctcacggtcgacctgagagcctggagctctgtgctctgctctgagagtgaagcctccgtttgaactctcgcgataacaatgatgtctcgggcaaacaagaacttctgggcctcgtcctttgccatggtctttgcctctcccaccgtcttttggc

SEQ ID NO: 16276 - DNA, 542 bp, Zea mays
  Clone ID: cC-zmpo148044g01b1
ctcaggggatgtcgggagcgactattcctgacactttcctttttgagccgtcgccccctacagcggggccgggggggttctatcggtggaaatggaagttggtgcttcttcgttgccgccccacgctcccttgccttcgggcattgtggtgacaagtgaccaatctgggcagcatctaccatacgagattagattccctacggtctgcgccttttcgcgcggtctgtggctcgagcggaagtgctactggtcacctagtgggaggtggatcaactatgtgctcaggccatctgttctgaggagagggagcacaagttcgatgttctcaactccgaggctgacatggccttcctgatgaggctgcgcgcttgtgcaaagagcgcgacaacgtgtggggcgatgcaaagcgtcttctagaagcgaggtcccagctttagaaggaccttcacgaggctaatcttctaattgaggagggtgggtccatcctcagggaggtctttgctcatctggagatggcagatgtaaagcttctgaaagagcgc

SEQ ID NO: 16277 - DNA, 392 bp, Zea mays
  Clone ID: cC-zmpo148044g02a1
aaaaagaataattttagtaacatgggatggggttaagaaaaataaaaggatgaacacttaggattacattacattttgtagaagtgcataatgaatatcttggatattgcttttgattacaccaactgaaggtccacgtactttggaccttgagaacactgcattggatggtcaatagcggtaccaacaagcaaatcaatgaactggggccaaaacctgtatctggatgatgatggtgaccatacccgtacaccgtaatggcaggtaccgccagcgcgagttcacagttcccgtcggtttagggtcacagacagtatcccgccggtgtcaccattctcgggttcgctgtcggcttcattaaaggatcggattcgaccaccttcatgagccgc

SEQ ID NO: 16278 - DNA, 398 bp, Zea mays
  Clone ID: cC-zmpo148044g02b1
gcggctcatggagggggtcgaatccgatcctttgttgaagcttacagcgaacccgagaatggtggggccggggggatcccgtctgtgaccctaaaccgacgggaactgtgaactcgcgctggcggtacctgccattacggtgtacgggtatcgtcaccatcatcatccagatccaggttttggccccagttcattgatttgcttgttggtaccgctattgaccatccaatgcagtgttctcaaggtccaaagtacgtggaccttcagttggtgtaatcagaagcaatatccaagatattcattatgcacttctacaaaatgtaatgtaatcctaagtgttcatccttttatttttcttgagtgaatgaaatgttactaaaattattcattttccagat

SEQ ID NO: 16279 - DNA, 433 bp, Zea mays
  Clone ID: cC-zmpo148044g03a1
aagtattatatttatttttagacggaccggggacagaggtggttcatgttatacaaactgtatacgtaaatacacgcgtgtgggattaaatcaatccctacttcctttgtgggaaaaaaaatgaccaaactgtactgtgatgtgtaacaatgccacaacacagtacttgaaggcaaacgtttattaattagcagaacgacaacctgtgatccatccttgctttcttccatgaaatgaaacgcagccatcgcgacctggcatggccaggccatgagctagaagaagcatcctctgacgcccaccggccggccttcatcacggtttgcccgtgcaacaggacagtgtgccggagaagcgggtgagccttgtaacgtaggtttctggcttgggcttgacccactcgttggtgtccacctgcttgggggcgccgccc

SEQ ID NO: 16280 - DNA, 439 bp, Zea mays
  Clone ID: cC-zmpo148044g03b1
gcggcgcccccaagcaggtcgacaccaacgagtgggtcaagtccaagccaggaacctacgttacagggctcgggcgcttctccggcacactgtcctgctgcacgggcaagccgtgctgaaggccggccggtgggcgtcagaggctgcttcttctagctcatggcctggccatgccaggtcgcgatggctgcgtttcatttcatggaagaaagcaaggatggatcacaggttgtcgttctgctaattaatctacgtttgccttcaagtactgtgttgtggcattgttacacatcacagtacagtttggtcattttttttcccacagaggaagtagggattgatttaatcccacacgcgtgtatctacgtatacagtttgtataacatgaaccacctctgtttgcgattggtctaaaaataaatataatacttatatattg

SEQ ID NO: 16281 - DNA, 268 bp, Zea mays
  unsure at all n locations
  Clone ID: cC-zmpo148044g04a1
attgtatattatttttttcattatttaactcgggcnggggtttatttttatttttattaaacataaccccccccatagaaccacccctaaaataccaaccccatccctaaaccctacaaactccccacaaaaaaaacaaataaaaacaattggaaaaaaaacacaaaaaaaactacccatttaaaaatatatacacattccaataccacaaaaaataaaaacctaaaccaaaaaaacaaaaaccctaaaaacccaaaaaaacatccaa

SEQ ID NO: 16282 - DNA, 456 bp, Zea mays
  Clone ID: cC-zmpo148044g04b1
gggccaacccccgcgtccgctccgaacaaaaaagaaaaaaaaaaaaaaaaaaatttaaaattttaaaaaaaaaaaaaaaaaaaagggcccgggaggaacttaacaactaagggccccacccccccctccccgtccttaccacgcggtacttcttcgacaaggccgccttaatcaaatttcctggcgccggccttcccacttgccgactggaaaaaccctttgcgcacccaaccttactagcactgccgagcatcccctctttgccccctggctcctgtcctaaggcgtccccttcgacaaggcctcccaccaaattgtccacccccaatggcactggcgccaccccccttatgggtggattaacccctccaggtggggcggctccacccagttttaacgaacattttcgcaacctcctacaccccggaggttatcactctcacctttgctttcaac

SEQ ID NO: 16283 - DNA, 485 bp, Zea mays
  unsure at all n locations
  Clone ID: cC-zmpo148044g05a1
gcttctaaagaagaaattttataccctagggtngggggtgttacaccgtcgaacataatatagctgttggatgtttgtcgttttactgttgtgcgttaccaatggatagcaactaatatgcaatgcaaggacgagagaaaaattattactagagagatgggtcagtcgacggagggtctaaaagcatgcaagctccttgaggcaacccttggtgctgcccttggcgttcgtgcatatagccatggtcttgttgttggtgccgctatactcgacgttgacgtcatccatggtgacgccggtgcatgggaccttggcagtgcagagcatgctaatggccttcggggtggaggaggtgccagtgatgttcttgaaggtgacgttcttgacggtgaccttggaggcgccgttggcggtacacaacttgttggggcagtacttcatgtctatgaaaatggggttggctgagttctccatcttgatattct

SEQ ID NO: 16284 - DNA, 530 bp, Zea mays
  Clone ID: cC-zmpo148044g05b1
gcgtccgcccacgcgtccgccacgcgtccgcacggatggcattcacattttcgactcatccgggatcaccatggccaagggcgtcattggcgtcggcgaccactgcatctccatcggccctgggacctccaaggtgaacatcactggcgtgacctgcggccccggccacggcatcagcatcggcagcctagggaggtacaaggacgagaaggacgtcacggacatcaacgtcaaggattgcactcttaagaagacaatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtaccgccaacggcgcctccaaggtcaccgtcaaggacgtcaccttcaagaacatcactggcacctccttcaccccggaggccattaacctgctctgcactgccaaggtcccatgcaccggcgtcaccatggatg

SEQ ID NO: 16285 - DNA, 480 bp, Zea mays
  Clone ID: cC-zmpo148044g06a1
aagcccaattagaacatgttgggtgagcataataactccgtggaggaaaataatgggagacatcgaagaaggttagtttgttacatggtgtggccagtcgagagtgtctctcccgacctatgccgctatgccaactgtagagaattcaagtgtcgtctccttgctcgatcacacactgatcatcaggtatcatcagccaataattatattagttggcacgcgcatgcacggacagtcggtcagctttgctgcgcctgcttctccttcctggcctcctcgacgtccttcttcttcgcctccaccgtcgtcgtggtctcggcggcgggggcgaccttttcctctgcattggcggctgccgctggcttctcctcctcgacgacggtcttcttcacggcttccttcttcttgtgatcgggctcggcgacggccgcctctggagcgaccacctcattagccttctgatgctcaacgtcggccgcc

SEQ ID NO: 16286 - DNA, 551 bp, Zea mays
  Clone ID: cC-zmpo148044g06b1
gaagttaagggcaacccccgcgtccgagcacctgctcctggcccgccggccaacaacatcattttgccgttttccgccacatcagccatgggcgggggcgggggcaatcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccataggcggccgtcgccgagcccgatcacaaggaggaggaagccgtggagaagaccgtcgtcgaggaggagaagccagcggcagccgccaatgcagaggaaaaggtcgccaccgtcgccgagaccacgacgacggtggaggcgaagaagaaggacgtccaggaggccaagatggagaagcaggcgcagcaaagctgaccgactgtccgtgcatgcgcgtgccaactaatataattattggctgatgataccctgatgat

SEQ ID NO: 16287 - DNA, 535 bp, Zea mays
  Clone ID: cC-zmpo148044g07a1
gacttcaattatgatgcatgggggcgcgaactttacaaagccatccggcattatctcccctacgatcgaatcgaagcaacatgaactaccctgaccccgtgcttcagagagttcctgttcctgccagcaggaggcaatggcgacaggaacagcagctaccatcgatcaggtcacctggttgttgcagcagcaggagcaggaccaggagggaagttcacccactgcagctgcagctgtatctccccgctctcgacgttcctgagccggaggatcatgtcctgcgcgaacttgccgttcctccagcacacgtggctctcgtcggcgaggcagttcctggcgctcggccgctcggacctgatgatggcgccgttcctcagactctccttccgcgggttcatgctcaccgcctccatcagtggcgccacgtccaccttcgcgtcttccatggggtcgtctctgctgaaggtgtcttgtcgacacctcctgtacatacagtttaaaataatgaaatccaacaggatcgttcggttgctgc

SEQ ID NO: 16288 - DNA, 538 bp, Zea mays
  Clone ID: cC-zmpo148044g07b1
gcggccggctaactggtaatgggcaggatctaagcaaagactttatttttttatggacggattggtaggccgggggaagggtcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggtgagtgagcagcaagcagaacgatcctgtttgtgattcattattctagactgtttgctacaggaggtgttcgacaaggacaccttcagcagaaacgaccccatgggagacgcggaggtggacgtggcgccactgatggaggcggtgagcatgaacccgcgggaggagagtctgtggaacggctccattcatcaggtccgagcggtcgaacgccaggaactgcctttccgactagagccatctgtgctggaagaaccggaagtttgcgcaggacatgat

SEQ ID NO: 16289 - DNA, 399 bp, Zea mays
  Clone ID: cC-zmpo148044g08a1
agcaagaatccagcgggcgggatttggtacagccacgcagttacatttttgttttcctttcctttctcagttacatatttgtaatccaggtgaagaggatttgtggtttattgccagccagtctgcgacgactgcggtcggtcgtcgactacgtgctattacatattgatcgtcgtcgtcgatgtgctattactgatcgtcgtcgtcgttccgagtccaactgtttgagcagcgaggcgcatatgggcagcggcaccttcttgaagtatcccatcgggttggcggggcgcaggttgtctcttatgcccacgtttctggtgagcaagacgccggcgcggtccctgtccgcctgcacctggtcgcagtccttgcgcgggctcttcaccaagaccaccttgc

SEQ ID NO: 16290 - DNA, 596 bp, Zea mays
  Clone ID: cC-zmpo148044g08b1
cggggggtaccctggtcaggggctcactcaccccgccttcttttcttctccaccaaataaggacccgccctggggggggggtacatgggggacaggaaatcaccggccatggcctcgattccggcgacgaccttcgccgtcatcttatccgtcctcttctgtgccgcggctggcaccgccgtcgacaacgacctccccgactacgtcatccagggccgcgtttattgcgacacctgccgcgccgggttcgtgaccaatgtcaccgagtacatcgcgggcgccaaggtgaggctggagtgcacgcacttcggcaccgggcagctcgagcgctccatcgacggggtgaccgacgggaaccgctcgtacaccgatcgagctcaaggacagccaccaggaggacatctgccatgcggtctctggggagagccctcgctaggactgcgaccagttgcaggcggactaggaccgcgccggcgttctgctcaccaagaaacgtggcttcagtgacaccctgtcccccgccaacccgtttggttcctaagggcgtgtcgttgccatctggctttgttgttcaacagtggactcggccaccacac

SEQ ID NO: 16291 - DNA, 500 bp, Zea mays
  Clone ID: cC-zmpo148044g09a1
aaccactgaatatggattgaatgagtcgggttaatatatacagggattggactaaatgcctgtcctatccgaacagcgctactcgtttacacatcagagcagctcgtctacaggcaattctgcttcccaggttcattcattaataatgtggtgaatggctaccgaatcatgttctgatgatggcaacacaggcgcctctgtaggccagcagtggagggagtttaggccgaggtcccgccaagctgtgtggccatgcgaaccatttttatcatccagccacaagggcccgttgatccgaactaatgaagccactgcatgctggatgttgacatatatacaggtgacgtggacaccgctaggtgctttggtgatcatgacgcgcctaccgccatttctggtggtttctcttgtgcctcatccttgcccagcaatgctggtgtgactgaaacaacaccgatcaggaatagcagtgctatcgactgggtgtcgtaaaggtcact

SEQ ID NO: 16292 - DNA, 665 bp, Zea mays
  unsure at all n locations
  Clone ID: cC-zmpo148044g09b1
caccccgtgccgatgatacccgagggacagagtattcatgctcagctgctctgtctgtgtgctcttgttctgggcaacatgacgtggcacttggggcatgggggngtctttgtctgccacctgtcaggtgccttcttcagtgctgatttgcctgtacgaagaatgcattgggaacgccagctggtgcttcacacctgtggcacagataaagctcagtctttcttcccagagacatggtgtgctataaagaagaagagacagttgttgaaattaccatgctttatcctcaggggtgacctccaacagttgccaaatgaccttcatcaacattagacttcatcccatgagtaggatggtcccctaccactatatgntcttactgggaacatctcaattggtcttatcccagctgacttatgtgacatgacagnggctggaattgcctcttggagaagctaacattcgcttgagtgacctttacgacacgccagtcgatagcactggctattcctgatcggtgttgtttcagtcacaccagcattgctgggcaaggatgaggcacacgagaaaccaccagaaatggcggtaggcgcgtcatgatcactcaagcacctagcggtgtccacgtcacctgtatatatgtcaacaatccacatgcaggggct

SEQ ID NO: 16293 - DNA, 414 bp, Zea mays
  Clone ID: cC-zmpo148044h01a1
ggaatggcttttttttttttaaatttttttttctttttctttttttttttttttttttttatttttttttttttttaaaacgggccctaaaaaaaaaaacaccccaacccttccctctaaaaaaaaaaacacccccccccaaaatttaaaaaacccccccctattatttcccccccccccaaaataaaaaaaaataaactcccccccccccctttttaaaaaaattcctttttctcccccccaaaatcaattttaaacaaaaaaaaactctccctccataataaatctcccctttttttctcccccccaaaacccctcccaaaagaaaaatccccccccccctcctccggttttttttcccccttttaaacctttctcaccccaaaaaaattttttttccaaaaattttctttc

SEQ ID NO: 16294 - DNA, 582 bp, Zea mays
  Clone ID: cC-zmpo148044h01b1
ggggcgacccccgcgtgcgaaagacttgatttaggtatggacggattggtaggtctcttgtaagttcgcgtggtccggggtatgggccttggctaccgtgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccacgtgtgctggaggaacggcaagttcgcgcaggacatgatcctccggctcaggaacgtcgagagcggggagatacagctgcagctgcagtgggtgaacttcccttctggtcctgctcctgctgctgcaacaaccaggtgacctgatgatcgatggtagctgctg

SEQ ID NO: 16295 - DNA, 430 bp, Zea mays
  Clone ID: cC-zmpo148044h02a1
atggtatagcttcacagatgttgagaacaagggccggttcccgtataaacaaaagctgagcacaggcattgctcccagtcccagtagcgtgagctaagctaactgcaaacaaacaagacacgcatgcaagggtctccttgtttgccaatacctggtaaacgtacggagccacatttacagacttcatatcgtataatcgtatatatttagtgtagtaaaaccagctgggcaggcgttgccgcctcatgcagcaggggattcacatcgcgacgcctgggatgttgacccaagtgaggtgcaggacgagctctccggtctcggtgtccctgagcttgagcaccatgtcctgggagaccttgccgtccttccacgtgatgtggctctcggtggcgaggcagctgcccttcttcgggcggatcgtttttatcac

SEQ ID NO: 16296 - DNA, 582 bp, Zea mays
  Clone ID: cC-zmpo148044h02b1
ggggcaaacggccaggccctctagcttttgctgggtgttctggagacagagcgttagagtttgagagagagagaggtagacgggggtggggggcctgctggggctgctcaaggtgcgggtggtgcgaggagtgcacctggcaatctgcgacccgctcacccacagcagcgacccctacgtcgtcctccgccacggaaagcagaaagtgaaatcaagtataaaataccgcacgatcaacccagaatggaacgaggagctcaccctgtccatcacgaacatgatgaacccggtcaagattggactcttcgaccacgacacgttcaccaaggacgacagcatgggcaacgccgagttctgcatcctcaacttcgtggagatcgcgaagcaggacctgagcgacgtccccgacggcacggtgataaagacgatccgcccggagaagggcagctgcctcgccaccgagagccacatcacgtggaaggacggctaggtctcccaggacatggtgctcaagctcagggacaccgagaccggagagctcgtgctgcacctcacctgggtcaacatcccaggcgtcgcgat

SEQ ID NO: 16297 - DNA, 427 bp, Zea mays
  Clone ID: cC-zmpo148044h03a1
ccccaaaaaagggaccgcacatttttttactgcaaacaaaaaaaattcttatttggccatatacattgctgctgtacatgcatattttttaaaccggaaactgaacttacgtgcggtcacctcggctttaccctattcaaacaatggcttagtatagcattacagggtttttctatttccattgttttccgggggcggagaacacaacctaaagatagccctacatttttccgatccttttcggggaaaggatataccaaccatatggatttcctgttcaggggagttagcatattaaataactgctcaccgttgttaccaacaataaaaccggggacatttgccagtggaacttccattctgaggacaagttatgtgaattaacatttaatgttgccccccttttgcctcccttaattttaatgct

SEQ ID NO: 16298 - DNA, 638 bp, Zea mays
  Clone ID: cC-zmpo148044h03b1
gggccaacccacgcgtccggcggcagccagcaggggaggaggacacgaatcgttttcggtttcccgcccgccccggcaattgtgggtgctggtgcgcgcagggcggttctggattgcggtctgccccacccacgaacaatccatggctccatctccgcctcggcgtgctgcgctcctcctcgccacggtgcttctgctggcggcggccgggtccacccccggcgccacggctgctggcatcttccaggtgcgccgcaagttcaccgccggggtgggagggggtgctggcgccaacatcagcgcccttcgcgcccacgatggcacccgtcacggccgcctcctcgcagccgccgacctccctcttggcggcctcggcctccccactgacactggcctctattacacggagatcaagctcgggacgccacccaagcactactacgtccaggtcgacaccggcagcgacatcctctgggtcaactgcatcacctgcgagcaatgcccccacaagagcgggctcgggttagacttgacgctttacgaccccaaggcatcctcgaccgggagcatggtgatgtgcgatcaggcattctgtgcagccacctttggcggaaagctgccgagtgcggcgccatgtg

SEQ ID NO: 16299 - DNA, 324 bp, Zea mays
  Clone ID: cC-zmpo148044h04a1
gggcgggccggcttgcaaaggcaagcagggttaaaattgaccattaattacgggcggcattccaaacacaagagttttatacaacacaaccttgcattgttacaatcgatcgccaatgatgaaagctgcagcctaaaactgcacacccactaacacttcctgccgacgcggaaattgagcgccccggcgtacctggagagcgactcggcgtactggccccccttggcctggatgaggtcgaacctgtcgtacttgccctcgttctggccgccggactggttgaaaaaagccccctttaggaacaggtcttccccgacgcctggg

SEQ ID NO: 16300 - DNA, 362 bp, Zea mays
  unsure at all n locations
  Clone ID: cC-zmpo148044h04b1
ccacgcgtccggggggacctgnncctcaacggctttcttttttatccagnccggcggccagaacgggcgcgggacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgcctttgcctgccggccagcanaaaaaaaaagaaaaaaataaaaaaataaaaaaaataaaa

SEQ ID NO: 16301 - DNA, 430 bp, Zea mays
  Clone ID: cC-zmpo148044h05a1
aaaggcttgcattgggcagggggtcattgcaatagcctcggaaaacctcccctcactacgttgtttcgcgtcggacgatacaaacgcaaagaaaggtcgtggctacttggtccttgcgaggagaatccttgcctagtactaggaacgtgcaagaatccatccgccatccctgctgggtacgttgggacttgggacgagcccggaaccggtgtatatgaagcttccgtgagctccgtctagtgctgtggctgaagctgccgctgggtacgtcggtccctctgcgccatcgccgccgctgccgccgcctgctgctgctgctgctgctgcgctatgagggcctgctgcttcttcctccggtgccttatgcggtccatgtcgatctgctccctcctgcaatcgtcgctgagaatggcgtgtcccctctgacatg

SEQ ID NO: 16302 - DNA, 559 bp, Zea mays
  unsure at all n locations
  Clone ID: cC-zmpo148044h05b1
cggcggagcgacagcggcaccangaccggcccccgctcgcgtgttttacgcgccagggacgacaccgggggggggagggagaacacgacgaccaaccgccacgcctacggcaaccccgaccgcgcggcggcggaccccggcgacggcggcagcgcgcaggcccaccggccgcgccgctccaccgacggcgcgaaggcggaggacggcaggagccccaccaccacaacggcgaggcgcgcgccgcccatgttctgcgtccccgacacggaggcggaggagcccaacggcttcctggacgagtgcaccctctgccgcaaggcgctctgcggcgacatcttcatgtacagaggggacacgccattctgcaacgacgattgcaggagggagcagatcgacatggaccgcataaggcaccggaggaagaagcagcaagccctcatagcgcagcagcagcagcagcagcaagcggcggcagcggccgcgatggcgcaaaggaccgacggacccagcggcagcttcaggcacagaactagacggagctcacggaagcttatataca

SEQ ID NO: 16303 - DNA, 421 bp, Zea mays
  Clone ID: cC-zmpo148044h06a1
aaagtgggcccaattttaaatggggggaaaattttgttaaaaaaaaaactttttttcctaaactggcaacaacaacagaaaaacttttttgccccaaaaaaggggggggaaacactttttttccaaaactgggaaaaaaaaaaattttgggggttaaaaaatttttgttattaaaaaatttaaagatttcaccccaccgggtttgggaaaaatggaatttaaaacttgcccaaaagggcagggggggatcccaacacaaaatatccaatcaaatccggaaggcctgccatttaatacttggagctcctcaaaagggacccccgggggggcattgaaaacataatttatagtcccggggccaaaaagggggtgtcgatgaccccaacccaaattatcccattggatccggtttttttgacaa

SEQ ID NO: 16304 - DNA, 553 bp, Zea mays
  Clone ID: cC-zmpo148044h06b1
ggggcaacccccgcgtccgccacgcgtccggttgtatccggaacattcgttcgttccgtttgtgtccaccgtccgaactccgacggggtgggcgctgctccgcccgctcggcggcggcaacgctccggccagctcggcctcctcgacgctgttcgccgatggggacgacgacggtgaggtcgacgccggcggttgccgtccgtccatgcgtttgggatcctcagggatgtttgtcgtcgctgatgcccgcctcgagccaagctacaactgcgtgtcaggagctacaaccaagcatataagagaacatccatattccatagtaaacataatcgactgacatcgaagaaagaaagggactccattgcagtcagcgacatcccgtccaagggcaatggggcctacactggaatcaccggcggtgttttgcaccagcagcgtgggtttcccatcttcagggatattcgtcaagaataccggatccgatgggatgatctgccttggcgtcatcgactgaccttgttgtgcccaggactatagaagatgtttgcaatgc

SEQ ID NO: 16305 - DNA, 476 bp, Zea mays
  Clone ID: cC-zmpo148044h08a1
cttacaaactgggttatcgatgcgaggggtgggcatttcttcctgatccatattgggtagagtcgtctctgacacgaatgcaatttcggtgtaagatcagaacgattacatacatgccgcaagcggatggatcaatggatcactcggaggcacggccgttgaacgattctgacttgaactgctcatagaacttggtgatgaactcctccgcctgcatgtcgatggcgtgtgggcaactgctgtcaccgtcatcgccaccctcagcaccctcttcctggtcgctgtccatctggtgcagatcctcagcggacgcgtagcggctggtcatgcccacctccttgatctcgaagccgaaccgtgcctgcgacggcggcgggaggatcacgtcatggtacacatcggcgtggcccaactgcggtggcggcggtggcggcgggtaatactccagctgcccgcggaggcggagcgggcgcata

SEQ ID NO: 16306 - DNA, 457 bp, Zea mays
  Clone ID: cC-zmpo148044h08b1
cgaccggttaccctggaagccgaaggcctcgtgccttctctttctcctttgcatggaggaagtaactgtttggggtatggtcgttgccgccgtagtgctggacaacaatggcgctgacacggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagtctcttcagggcgatgtttctgtccttcggccggagcgacgacagcatgaagaagacagacgacgacaccacgagccccaagaagagagccatcgcggctgctgatgacgattgc

SEQ ID NO: 16307 - DNA, 519 bp, Zea mays
  Clone ID: cC-zmpo148044h09a1
ccttatctgggggggatatatttttacacttaaatctaccacatgaatcttgatagatcgaaagagaaagataataacgattaaagatatgttttacaacacagcttgctgatgttggtagataacaacattgttttttttatgagaaaaataaagggtgtaattgggagtgtcttgacatatgcacaatgcacctgaacctgagtcaattgaccgcccctgatacatttccttgccaaaatgtggcgacctatacacaaaacatggaaaactgggtacagttctcgtgttctctgttttagtcgagtttgcaggcagtagacacatcactcaatcaacatcttgttgttctttgacggctgcagcagcaagtggaccattgttactaccaagcttcagtgacgcgttcttgaacatcttgcggctgagggtgttgtacaccgctctcgagtactgccgcgacgtattccttcagtccactccagctttcatcatcagctcaaactcctcgtagcttat

SEQ ID NO: 16308 - DNA, 605 bp, Zea mays
  Clone ID: cC-zmpo148044h09b1
ggggcgaaccacgcgtccgcccacgcgtccgccggcgcgtccggtcatgcgcaccatcattttagtcgtcctgcattgccacaagcgtgggggattcaccgggacctcaagcctgagaactttctgtatgccaacacatctgagaactcggctctcaaggtcatcgactttggtctctctgtgtgcttcaaaccaggtgacaggttcagtgagatcgttggatccccctactatatggctcctgaagtgctgaagaggaactatggacaagaaatagatatatggagtgcaggagtcatactctacatcttgctatgtggcgtcccaccgttctgggcagagactgatgagggcatagcacaggctatcatccggtccaacatcgacttccgcagagagccttggtcaaaggtgtcggaaaatgcaaaagatcttgtgaggaagatgcttgatccaagcccctactgtcggttgactgcccagcaggttctagaacatccctggatacagaatgccagggcagctcccaacatccacttggagaagcagtgaggtccaggctgaagcaattcactgttatgaacaagttcagaagaaggccctgc

SEQ ID NO: 16309 - DNA, 538 bp, Zea mays
  Clone ID: cC-zmpo148044h10a1
aatcaaatcgtttcagttatataggggggggccccataaagttacaagagcaaacgaagtgagcaaagcaaagcaacacttgcgttattggtccctcccgaccagacgagcaattaccgcacagccaactacgtgcccaccctcgacgacacggtccctggtgaactcagtagaagatcatggtagcgacagcagcggcgacaccagcgatggcagctccgcttccaagggtagcagcaccggaggcatcagcagccgccggtccctcagcaggcccatcagcggcaggggacgccacctcggcggtggatgccgacggcgaagggctcaactcctcgtccgtggaagaagacggtgtataggcggcggtggtcggcgcggcagctggaccatacttcctagacgacgactactatggggcaacggcagcggcgggggtggaggcggcttgaggtgccttaacgggggcagttctcgtggcagcagactcgggtgccttggcaggagctgcaggactgcctgcctttggtgactcggc

SEQ ID NO: 16310 - DNA, 359 bp, Zea mays
  Clone ID: cC-zmpo148044h11a1
gggtgggggggtccttgatatcaaaaattgatacaattataggctaaaaacatgataacccatctaaatcaaacaaaaagaaaaagagggggagcaagaacatatcacggatgaccacacattattatggacttttggttttaaacaacattgctctcacttttcttccatgtcttggtccaaaagcaaccggacccacgtgcttggccttaattgggggagtaataatcgtcgtccttattgcccgatagaccctttaccccctggggaccaggggcaccccccggtcccttaggtccatcggcaggtgcctcaacaacgggggccggggcttctgcggagggggcataaacggactt

SEQ ID NO: 16311 - DNA, 506 bp, Zea mays
  Clone ID: cC-zmpo148045a04d1
cccacccgtgcgcccacgcgtccgaagcaatctcaagtgaatcaaaccgccagatttcgctgtcctcctccactaccagagcatgggcgttggcgcgacccgaaccgccgccgccgccgccgctcaccctccgagcgccttcctgctcctcctcgtactcctcggttgcgcgtccctcgcgatcggaggagcagccatggccggccacgtcctcggcggcgtgaaggagaacccagccgcggccaacagcgccgagtccgacgggctcggccgcttcgccgtcgacgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtcaagccatggctcgacttcaaggagctccaggaattcagccacaagggggacgccaccgccttcaccaacgccg

SEQ ID NO: 16312 - DNA, 419 bp, Zea mays
  unsure at all n locations
  Clone ID: cC-zmpo148045a05d1
gcgcgcatcacggaatatatgtgggcgattataaggcgatccatcctacttgaggaagaggacaggaggtcggagcaggagctgtcgtcnatattattcttgtgagttccaccccaaaacgaagcaacacgccttgcccggtgtgcaccgacgaaaccagcgacagcagcacagagacgaacggcgtggtatcctcctgtctcagctgcttcctagctgggggtgctctctaccgttttgagtacgcagtcaacccggcgctcttcctcgccaaagcgcgaggagggacgtgcacgctcgctccctctgaccctgacgacactgtggctcgtcgtgccagatacctgttgagcaacggtttcatgtgctacaacctgttcaagaacaactgcgaggacttcgcgatatactgcaagact

SEQ ID NO: 16313 - DNA, 409 bp, Zea mays
  Clone ID: cC-zmpo148045a06d1
cgtttcttgactctgtcttacactattttcctgatggcatactttctgcttatgttgtatgagaaatacgaagagcaaggggatatcgtaagcgagaaggccctcattgagataaaaaagcagtacaaagtgattgatgcaaagtttatctctaagatcccaatgttgtctgagaagaaacaacactgagagagggtgctccaaaggtctaattcagcacattaccaatatatgaaagtagttcctttggctttgctatatcatcatttagcaacctttaagatgataccatagatattatatggattcctaaggttggaaatttgtgtcttccgagtcccctagaatagttgcttcttcctgtctgacagtgaatttgattttgtatggatgtgacatatatatgcct

SEQ ID NO: 16314 - DNA, 443 bp, Zea mays
  Clone ID: cC-zmpo148045a07d1
acacgcgtcccaaaaaaaaaaaaaaaaaaaaaaaaaaaaaaaaaaaaaaaaattttaattttaaaaaaaaaaaaaaaaaaaaaagaaaaggtaaaaaaaaaaaaaaaaaaagggccgccccctttatagtttccaagtttactccccctggcatgcaacgttttacttttttttttgtggcccctaattccatttccttgcccgtctttttccccccccatacctggaaaacccctggcgttccccatcttattcgctttgaaacacatccccctttccccagttggcttataaacaaaaaggccccccccaatcccccttcccaacttttgcccaccctaattggcaaatgggcccccccctttatcgcccttttaaccccgggggttttggtgtttccccccatattacaccttctctttgccaggccctttacccccctc

SEQ ID NO: 16315 - DNA, 597 bp, Zea mays
  Clone ID: cC-zmpo148045a08d1
acacgcgtccgcagtggtgcaagccaccgcgggagcacttcgacctcagcattctccgttcctccagatcgcgcaagagaaggggggcggcgtgcccatctcctaccgcagggtggcgtgcgtgaagcagggcggcatccggtacaccatcaccgggaacaagtacttcaacatggtgacgatcaccaatgtgggcggcgctggcgacatcgcggcggtgtcggtgaaggggagcaagcgcgtcaagtggacggagatgaagcgcaactgggggcaagtgtggcagaccggggaggacctcacctgcgagtcgctgacgttccgggtgatgaccagcgaccaccgcaaggccacctcatggcacgttctccccgctgactggaagttcggcgtcacgtaccaggcatccaagaacttctaagtagccactttccctcctcttcttcatcctgcatatgcccacaagcaaccatgcaaatgataacatgcatcatgcatgcatattcattctttcgctcatgcactccaatatggtgccggagttaaaaaatgttaatcaatgtgcaaactcaaatgacatcttaaccagttgtgatc

SEQ ID NO: 16316 - DNA, 623 bp, Zea mays
  Clone ID: cC-zmpo148045a10d1
cacccgtgcgccggaccttatcagatcgtcttcagaaccccgagaagacatagactccctccacctcgacggctacgccgtcttgggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccgttttcacctcgtgttctgaccattcagtctaactaatccattcctgtgctgctcggcgaaataaaatcatcaaaaagaacaaagacgaaggaagcctatggaagggagaagggacgtctggtggggggtgagccaaatgaaaacgcacggatatatctattgatgtaatcttgagatgccctctcaattactgtatgggggttaaa

SEQ ID NO: 16317 - DNA, 579 bp, Zea mays
  Clone ID: cC-zmpo148045a11d1
cacccgtgcgacagtgcgtccgcgtgtctgctccttcctgtgcagctcacctttcggtttatccggtatgcctgtgcctggaggtaacggctacgaagcggacgaggatagccattgccgaaatgcagcggggccctctccggcggtctctgccagctgggtcggggcaggacgcccgatctgttggtgctccgccgaagcccaccattggcggcgccctatcgtggatgtggtggcagtcctgagcagcgaaagctctgtgcccggtgcgcggggggtcctatcaccttcgctcggtctgctccaatgcccattctcggcggtgccatgaccttggcgggactgggctccatggcggtctccttgcagcgaaagctccatgtcagtacgtggaaggtgcccacctttgcaaggcccacgtcatggcttggtcgtcagggtcttctttgcaggtctctttggccctattgggacctctgctccgtcaacgctcttctgtctacaagggacacatagatcttatgtcgggtcggtgttttccggctcttctgctttcgtaccgcgctggatggtggcatg

SEQ ID NO: 16318 - DNA, 597 bp, Zea mays
  Clone ID: cC-zmpo148045a12d1
ggggaagctctcttctttcttcctcctcctcgtcctctcgaatttcgttttttgtctctgtcctcctcgctcgagttccggggttcttgagaggggaaataggaggcggagccgaggagagggatggggagggacgagaggttcccagtgtgggaggccgcgctcggcgctggggtcgccgccgccttcgccgctgggctcgtcggggtttacctttccatgccggactccgactacagcttcctcaagctgccactggccatcttgagaactatactagcgactacaccctacaggtgttggtaggctactgcgccgtgtacatcttcatgcagaccttcatgatcccaggaacgatattcatgtcactgcttgctggtgctctgcttgggcagctccggggcgtggccctggtagtcttcgccgccactgctggcgcttcttcgtgctatttcctgtcgaagatgattgggaagccactggtgttcacgctgtggccagataaactcagcttcttccagagacaggttgcctaaagaagagagaagctcttgattacatgcttttcttcaggtgaccccacattgccaaatcctt

SEQ ID NO: 16319 - DNA, 520 bp, Zea mays
  Clone ID: cC-zmpo148045b04d1
gacgcgtggctgggagcgcggagagctatccacctcttctcatttccctctggcgtccccctccccgggccgggtgccggcgagccgcggagatccggggttctgacctcgcctccttctgctgagttgatgctaaacatgcttatttaactaaactagaaatttgttaccgagacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgtcaacattggtgctgcaaatgccccatcccaggtccttgcaacgctaagtggccactatggtcctgtgtggcgtgttgcttgggcccatccaaagtatggtgcaatccttgcatcgtgcagttatgatggccgtgtcattatttggaaggaggatgcacgaggcaattggtctcaagtcacgtcttcagtgacaa

SEQ ID NO: 16320 - DNA, 562 bp, Zea mays
  Clone ID: cC-zmpo148045b05d1
cgcgcaccgcctccccgtgtcccctccttctcgcccggctttgtctttctcggctgtggaaacagaacaaacgcatgggccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtcagggcgcgagctctctgaagaggaagacgcgcattcgttcgcgcgatcgccatgcatgccccggaacgacagaagctgt

SEQ ID NO: 16321 - DNA, 557 bp, Zea mays
  Clone ID: cC-zmpo148045b06d1
tcgtcgtctcactcaccccgccttcacgcctccctcaccattttaggtttcgcccttttccgacattcacagggggggcgggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacaccatcgagctcaaggacagccacgaggaggacatctgcgaggtggtcttggtggagagcccgcgcaaggactgcgaccaggtgcaggcggacagggaccgcgccggcgttctgctcaccaggaacgtctgcatcagcgacaacctgcgccccgccacccgctcggctacctcaaagacgtgccgctgcccatctgcgcctcgct

SEQ ID NO: 16322 - DNA, 553 bp, Zea mays
  Clone ID: cC-zmpo148045b07d1
cgcctatgaacggatcctcatctggggttaacgatctcttcctttatgcagtcggagctccctgagcgggtccgggtgctgcgtcaggttgaacaagatcgatttcactgaccaagaagttccaacaatagtcaccgttgatgacacctgacgcatttgatcaaaatggtcatcagacgtgcgagctattattaactgctgcaaggctagatccatgggattcagaggcgacacaagaactgatgactccacgccttggtttctgcctaatatgttcgccgatctgcctacttttaagcacgggctttttcttgtcttccctgtaactataatataataatgtatattatatacaagacgatacaaccctgcgggtgttggtcatgttcctaacctttttgcacactccacttgctggttgcaattatgcctgcttccagatgcagaaagacattgaacctgacaatattcatatgcccatgcatcagacggacatgtacattcataataggaatttgacagacattgcggcgggtgcaccccgttggtaagc

SEQ ID NO: 16323 - DNA, 611 bp, Zea mays
  unsure at all n locations
  Clone ID: cC-zmpo148045b08d1
cagcagataggactactctgctgtggcgccaatcccgcggcacagcttcctacttttttgggncttcggncaccaatcccggggacgcggggtcgtaccatccgcagttcatccatcccccgttgctgacccccggtcacggaccgtcaactagcgggcctcagcattcggggactaggatgagcgcccgacaaagcccaactccataacgatgctcactcggacgccatctgtcggcgaggcccgacatagaacgacaagctatcgtggacaagtcgcggcaacatcctcctacaccgagccctgcacctacatcaactccctcgccatcggcccgctcgccgcgctcgccgtccgaggcgtgcaactcgttggcacgcagtgatctatccccatgcgtgcgtgtgtgtcccgctgtatcgtttcttccctgacatgatatgacttctactccgttactgatgattcattgattcccgccgcccccgcattgttcattatattatgtgacgtctgcgggcgcgtgcggggatccatccaaatctttcactcgctattgtttctgtacgtacatacgtgtccgtccagattataatggaactcataataat

SEQ ID NO: 16324 - DNA, 398 bp, Zea mays
  Clone ID: cC-zmpo148045b09d1
ctcttcttgtgcccgcgagcttgtgacaccgcccgtcagacaaccgatcctccctcgactaccgtcaatccaggggccgctgtctatttgcgacatcctgctctgcgccgggttccgtgacccaatgtcatccgagtacatctgcgggcgccaaggtgagggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgttctgctcaccaggaacgtcggcatcagcgacaacctgcgccccggcaaccc

SEQ ID NO: 16325 - DNA, 326 bp, Zea mays
  Clone ID: cC-zmpo148045b10d1
gcgcgaggacccttcgtgctcttagtggctctcactcagctacatgtgcttcattcactgtcgttgattatgtatccatcctcggttattatttttgcagacaataatctcgtgcgccctcccggccattgtattggatggcaggcgttgtatcaccaatttatgtgctacctaccttctaatctttattataattgttattactaacaacaactactggtaatatccatcatagacccacgctttaccatcgttgcttcgtttcacttgtcctttcctttcttgctagctggtggtgtatctaccatctaaatctatcaataaca

SEQ ID NO: 16326 - DNA, 509 bp, Zea mays
  Clone ID: cC-zmpo148045b12d1
gacccctccgggtccacgccgccgtaggccgacttcgtttgcgtttcatcctgatgctgggcgcgatgcgcgcggggctcacctactactggcgcaccaacatgcccgagacggcgcggtacacggcgctggttgccaagaacgccaagcaggccgcggctgacatgtccaaggtgctgcaggtggacatctcagccggcgccgccgaggaggacgccgcggctgcgactgcgactgagcctgcgccggcgtcctttgggctcttctccggggagttccttcgccggcacgggctgcacctcctgggcacgtcctccacgtggttcctgctggacatggccttctactcgcagaacctgttccagaaggacatcttcagcgcggtggggtggatccccaaggcggcgaccatgaacgccctggaggagctgttcagcatcgcgcgggcgcattccttgatcgcgctgtgcggcacggtgcccgggtactggttcatcgtggcgctgatc

SEQ ID NO: 16327 - DNA, 550 bp, Zea mays
  Clone ID: cC-zmpo148045c04d1
cccgtccgcccacgcgtccgcggacgcgtgggggctcacgggcgtcatgattttcatggacacctgcgtcgacggcttcgtggacgagaagctcaaggccgacatgcactccgtgctgcgcaacgccaccgagctcagcagcaacgcgctggccatcaccaacagcctcggcgggatcctgaagaagatggacctcggcatgttcagcaaggactcgcgccgccgactgctgtcgtcggagcaggatgagaagggctggcccgtgtggatgcggtcgccggagaggaagctgctggcgtcgggcaaccagcccaagccgaacgcgatcgtggccaaggacggcagcgggcagttcaagagcatccagcaggccgtggacgccgtgcccaagggccatcaggggaggtacgtcatctacgtgaaggccggcctctacgacgagatcgtcatggtccccaaggacaaggtcaacatcttcatgtacggcgacgggcctaagcaaagccgcgtgaccggccgcaagagcttcgccgacggcatcaccaccatg

SEQ ID NO: 16328 - DNA, 469 bp, Zea mays
  Clone ID: cC-zmpo148045c05d1
cccgtccgcacagccccggcgcatcgacgagttcctgctgcatagccactttcagcttgtccggcaagctggtcgccggcggtggtggaagaaaggcagcaagaaggagcagcacagatggcagaggcacggcatgatcacattgaaacggcgtgatcaaaacaggagatgctgcgagcagatgaaagggatggaacgagttgggccatgagctctcctgatgagcaggtgtttttttcagggctggacagacagacagccccatgccatcagggaaagctgagatggaagtggaagctgttgtagtggggttttcaggtttcatgcaaccagattttgctctacctgaactagacaacaatgttgttgctgctgctgttgtacaagatctttttttgtgctcgcttgtgatgataatatgcatggcaagctccaaaatgtggtttccaatttatgtatagcaaggggt

SEQ ID NO: 16329 - DNA, 540 bp, Zea mays
  Clone ID: cC-zmpo148045c06d1
cacccgtccggtgagccggcacacgatccaggtgtacccgcggtcatggactttgatcatgctgacattcgacaacgcgggcgtgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccgttttcacctcgtgttctgaccatccagtctaactaatccattcctgtgctgctcggcgaaataaaatcatcaaaaagaacaaagacgaaggaagcctatggaagggagaagggacgttgggtgggggtgagccaaatgagaacgcacggatatatctattgatgtaatcttgagatgccctctcaaatcactgtaatggggtttaaaaaacaatcattgtaatgggagttatatatacttttatcttaacatttatttacaccc

SEQ ID NO: 16330 - DNA, 603 bp, Zea mays
  Clone ID: cC-zmpo148045c08d1
ggggggacattctggaggagaagcgtgacgggaaggacagcgtttaccttagcagcacaggcgacaaggcttgggtcgggctcgggagcagtgatataaacatcccgatggaagaagcggttgatgaacctgttaaaccggcggaagctgtggacgaagctgggctgaagagagatgtctgctgttcaccagctgagccaaacgaagccgttggtcagaacgagctcaatgaggctgctgtcgtcggtgaaacgacgactgaaccgaaggaggctgaggatgaagccaagataataaagcaagtcgactgcgaaactgcatcaaaagaagttgctagtactggggccgagtcaagggacgatgccgctactatggaacgcgagccgctggtagcagcagcagcagcaccacaagaagagaaggccaaagctgaggagaagacgacgcagccaactaaggccgtggaatctgccaagtggaggacgaaagatgaagggaggagcaacgaagccacagaagagggcaggggcaagtctaccactactgttgccacccaggagaggaagaaccaggtgatggccttgttgggagggttgagactgc

SEQ ID NO: 16331 - DNA, 554 bp, Zea mays
  Clone ID: cC-zmpo148045c09d1
acccgtccggctataagttcaccgaggtccccgccgtctcttgtgtctcgtatccgttaagcaaacaagtccagtacgccaggaagggcgtgcaggactccaagaacacgacggacaagactatggtgccgcccaccgtgtacccaccgccgcaggccatggcgtccgcatacccgccgcaacaatattgttcgccgtacgcggcgtacccgcggcagccttacgggtaccctgctccgccaccgtacgggtacaatgctgcttccccacaaccggcgatgtacaactacgcagcacagccggtagctgcaccggcgaggcatggcggaggtatggggatggggctcggcctagggctcctaggcggtgcggtcggggggatgatgctcggagaggcgatcggtgactatgagaccgacgccgcttatgatgccgggttcaacgatgcattggcattttagatctatgttgtcgtgcagtcatggagattattgtccttgtaaatctctaattaatacgaaacgatgaaatagaatttgcattttggatctctt

SEQ ID NO: 16332 - DNA, 516 bp, Zea mays
  Clone ID: cC-zmpo148045c10d1
cacccgtccgccttcccctgttcctcgaccacctcaacgagcttctgctccttcgactacgacgcgccgccacagccacatgggggacgaggccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcatgagctgctgcagccctgcaaggaggacggcaggttcaagctcctcatgcacccggaggcccgcgcgcggccgtgcggtggcggcacactgcatgaacggctagggaatgatagctagcgctcttaattgatcagctgatcagatgatct

SEQ ID NO: 16333 - DNA, 254 bp, Zea mays
  Clone ID: cC-zmpo148045c11d1
aggctactccctgagaggacactgtgctcacgtggcctgcttcggctgtcaccaccgcgccgactcactggggctcaccgtatcacaccagtcgctcgcgcatcgtcccgtcacgcccccgcggcccacagacaccacgcccgggcggcataacgccagcttcgtgacctgacgcggcgcgccacccgaggtcacatacgcaaaaataccgccatagatggttccggccatgcgcagctcgtcgttaacgttca

SEQ ID NO: 16334 - DNA, 293 bp, Zea mays
  Clone ID: cC-zmpo148045c12d1
ccttcttcttctttctatttacatatttagacccaataagaacaaagacggactatgactcttcttattttgcgacccatccccttcccacccaaaggctcctatcgccaactccatcctcgccaccatggcctcgcaccggtcgctgctgctgctgctcctcgccaccgcgctcgtcgctgcgctgacctctgtcacatcctccgactactccaaccccatgcccaccatcctgacccccgtggcacataccccgctggggtcctttgacagcatacaatgcctcctctaac

SEQ ID NO: 16335 - DNA, 515 bp, Zea mays
  Clone ID: cC-zmpo148045d05d1
gtccgggggtggtgtcctgcgccgacatcctctcactggcgtcggtcttgctttttaccatgaccggcgggccccggtgcccgggtccgctggggcgcagggactcgctgtcgtcgtcgcccacggcgcccgacgtggagctgccgcacgccaacttcaccgtggaccgcctcatccagatgttcggcgccaaggggttcacggtgcaggagctggtggcgctgtccggcgcccacacgctgggcttctcccactgcaaggagttcgccgaccgcctctacaacttccgcaaccagggcgggaagccggagcagttcgaccccagcatgaacccgtcctacgccagggggctgcaggacgtgtgcagggactacctcaaggaccccaccatcgtcgcgttcaacgacatcatgacgcccggcaagttcgacaacatgtacttcgtcaacctcgagcgcggcctcggcctgctcagcaccgacgaggagctgtggacggacccacgcaccaagccc

SEQ ID NO: 16336 - DNA, 589 bp, Zea mays
  Clone ID: cC-zmpo148045d06d1
ggttgacccacccgtccgcggacgcgtgggatcagaagaaaagaatagttaggtcccggttgtcgatcgaacgaagctgctgctgctaccggccgggcgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtcgatccgacctgcaggaggaggcaacagctaccgtaataaccaaagcggaagcacaagaggcttcagctgaaggtggcgattaacctacctaaccatattatttattcattcatatgcatgcatccttgttgctatgccagccattcttctatcttcttctattttaagcatccttgctggatttccctatatattaagcattcactatatgcatgcatgtgtaagcaatcgaccatatattttataatatgtatacggggtattatc

SEQ ID NO: 16337 - DNA, 359 bp, Zea mays
  unsure at all n locations
  Clone ID: cC-zmpo148045d07d1
gtgcgcgagaggtgaaccagcagcctccaataaaagccagcacattctaatattaccgagagacctcagccctcancgagcgggccgccgacgtaccaccgcgccaacccgagagaaagatggagatgatcaagaggatcctcatcgccgcgctcctcgtagtcgccgtctcggtcaccgtagtgctggcctccaccgaggccgccgtcgccggcgccccagccgcctccgagtcgtcggcgtccgccgaagcccccgctggcgccggcggcgccggcgccggcaccggtaccgtcgcggggccctccgccagctgcgccttacccgcccttgccggggggggggggggtggttttttt

SEQ ID NO: 16338 - DNA, 388 bp, Zea mays
  Clone ID: cC-zmpo148045d08d1
gtccgcaaaaacaatgctatcaacaatcaagcattgcaaaaggcaaatactattttataattcgtcgcatcaactcatgctggggttaaatggagaaatatgatgactaacaaaatcagcgcgtgttccctgtccttgctcatcaggttctgatgacgatcacgcctttcatatggaagacattaatgattcccttggagggaggattcttccagctctttgttttggatggagacttttatctgcccacacccgtgactattccactgggtggggtcatccgtccgcaatatctgctattcatctatgatatcttcttctatttacactaaacctctgcgggggggggtgctatttgttaggtctcttatgccatattcctatcttt

SEQ ID NO: 16339 - DNA, 529 bp, Zea mays
  Clone ID: cC-zmpo148045d09d1
gcccacgcgtccgcgcctcatgcaccacctccagaacaccacctagttctgccttatggccgtcagcctcggctggtacgagacgctcatgtcctgctccggcagcagcaccagcagcgagatgccgcccgaggaccgcgcgcgcgcgggcatctccccgggcctcgtccgcatgtccgtcggctacaacggcacgctggagcagcgctgggcgcagttcgagcgcgcgctcgcgctcatgcagacgccgacgcccacgcaccatctcaaggccgccgccgccgaccgcgacggccccgaagccgccaacaaccaccaccgcaagcactgacgcgcttgcgcttccgagcgtgcatggcctgtgtggacttgtgtgtgtcgcgttcgtgtatatactactagtgccattcaagcaagaatattaaacaccatctgatccctctggttcagatggatcgatatgccagtgcaagcggcttgatctctggggaacctgggaatggacctgaataaatgggatttgtccttt

SEQ ID NO: 16340 - DNA, 501 bp, Zea mays
  Clone ID: cC-zmpo148045d10d1
acccgtccgaagcaatcactgccggacgatccgagcagagaaggggaggtttttgtttcgactagctagattccacgcgcgagggcgggcaccaggatccgcgtggccttgctgagcttggcgctggtggggctgctcatctgccacctcgccaccaccgccttcgccggcaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgccggggccgacgaccagttgaagcgaggaaggtggccaaaactgagggcccggctactatcttttgctataactaaagatagggccagtttattttctccgataaattctgtccgagcaaaaagtatgatggggtttttagtcgagatggtaaataatg

SEQ ID NO: 16341 - DNA, 540 bp, Zea mays
  unsure at all n locations
  Clone ID: cC-zmpo148045d11d1
aacacccagtccgatcccctccgtgtcccggagcccagggagcggaggcgggcggttctcggtttgcggccatggacgtggactgcgggtcggggcccgacgccccggcgggcgacgtggatggcggcgccgcccggccgtggcccaaggccgtgaccaacggcggcgtccacgagctgctggagtgccccgtgtgcaccaactccatgttcccgccgatccaccagtgccccaatggacacacgctgtgttccacatgcaaggccagagtacacaaccgttgccctacctgcaggcaagagctgggcgacatcaggtgcctggcgctggagaaagtcgccgagtcgctggagctcccctgcaggtactactcgctggggtgccccgagatcatgccttactacagcaagataaagcacgaggcgcagtgcggcctgagaccgtacaactgcccctacgccggctccgagtgcggcgcggncggcgacatcccttccctctgtctccacctgagggacgaccacaaggtggacatgcaca

SEQ ID NO: 16342 - DNA, 366 bp, Zea mays
  Clone ID: cC-zmpo148045d12d1
gtcccatcaagacaagcttagccatcttagagatgtttgttagggtattctgcttacatgtttccgtgcaaaaccatttagtctttgctccccactgtttctgtgcagtcaggaaggggggaaaaccttgcatgcatgtaaattttgaggaaatcatgtgctgttgtatattaggaatacctttgcatttgctggtgcgacgcctaatcttcctgtctattaaccagagtttttatttggcaatgtatcatgaacttgtaggggtttttttaggatttctctcttgtttgtggtgctgctgtactttacactgtaatcttcattaaagaacttggtttcacttcgttattatactccactttgaag

SEQ ID NO: 16343 - DNA, 659 bp, Zea mays
  Clone ID: cC-zmpo148045e05d1
ggggcgaaccacgcgtgcgggggcaggccccagctgaggccgccgtctccacactttaggtttcgcccgaggccactccaatctccggtgagggtgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaggccaggaaggagaagcatgcgcagcaaagctgaccgactgtccgtgcatgcgcgtgccaactaatataattattggctgatgatacctgatgatcagtgtgtgatcgagcaaggagacgacacttgaattctctacaagtggcatagcggcatatgtcgggagagacactctcgactggccacaccatgtaacaaactaaccctcttcgatgtctccattattttcctcacggagttcttctgatgaacaacatgttctaatgtgcctactgggatgtggctccatattaataatcgcttgccatg

SEQ ID NO: 16344 - DNA, 595 bp, Zea mays
  Clone ID: cC-zmpo148045e06d1
ggggcgaaccacgcgtccgcccacgcgtccgatcaccaaggaggttgacgagcatttgattttcgtccagaacaagaactcgtcctagttaggggagtggatccccaacaacgtcaagtccagcgtgtgcgacatcccgcccaggggcctgtccatggcgtccaccttcatcggcaactcgacctccatccaggagatgttccggagggtgagcgagcagttcactgccatgttcaggaggaaggctttcttgcactggtacacgggcgagggcatggacgagatggagttcaccgaggccgagagcaacatgaacgacctcgtgtcggagtaccagcaataccaggacgcgactgccgacgaggaggagttctaggacgaggaggaggtgcaggccgatgacatgtgaggggagggctgttatcgcgtgaagccttgtggtccctatggcaagcggacctcgatgagttcggtgtttcctttcgtgttgttgccatctttctactgttagcgtacccacccctcgtggcccattccgtcgcttgtgaccgatggctttttcttgtgctatggaaccctgcttttggtacggact

SEQ ID NO: 16345 - DNA, 598 bp, Zea mays
  Clone ID: cC-zmpo148045e07d1
gggcgacccacgcgtgcgcccacgcgtccgcagggattgaatcgatccttcgccttgtttttgtttccgtccgccgggcggtccaggcctggttacaaaaatattacagcagcagcagccgaatagctgatcatccaatccaattcataggtcctttgtgctggcggcgccgctgccttcgtcgacgccgcgcttgccgtagcaatgaaagaagacccagagcagggcggcgttgagcagcgtgttgaagacccatgcgccgatgccgctgcacccgccgccgacggcgccgaagtgcatccacacgacgccgacgtggcaggcgaggttgcagccgaggaggcccagctggcaggcgagcgcgacgtgggcggcgcccctggcggggagccccgcgccgacccagaacctgtagccgagcgcgacagcgtgcgtgagcgtggacgcgaagatggccagcacctggaacgactgcgagaactcgagccacaggaacgccatggccacggatgcggcgtgcgcgaacacccgcggggcggcgcttcgtcgtctgcgcagtaccggcagcacgccccgcgccgcgtggaggtagcgggac

SEQ ID NO: 16346 - DNA, 542 bp, Zea mays
  Clone ID: cC-zmpo148045e08d1
ggggcgaccacgcgtccggcaaaaaccaccatccgtcgtcgccaaccgtagcattaacatttccaccgcccagcaataatggcgcggagcgtgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttcttgaccccgtcgaatctttttcctttctattcttctactatactactactatctgtttgtcgcgttgatttcttctcatacatcgatcgaggatcgactcatcgctttgtaattcctgcaacttgtcagtggtatgacctatatgatttagtcttccttt

SEQ ID NO: 16347 - DNA, 578 bp, Zea mays
  Clone ID: cC-zmpo148045e09d1
gggcgaccacgcgtccgcggacgcgtgggttcccggttaccccttcggcctcctcctattttccacccgggacgtcttccatgggggcctgggagtagaatagttctatctcaccgcaacaactcctcattacatcctttatgagaggctgatcgattggtagatacgtactcgggtggagcagagcaacgagagacatggcgacgacgacgcgtgttgccgccgccgccaccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttccccggccccaggatcaactgctcctccaacaacaacatcgtcgtcaacgtctttaaccagctcgaccatccgctccttttcacctggaacgggatgcagcacaggaagaactcgtggatggacgggatgccaggcacgcagtgtccgatcctgcctaacaccaacttcacgtacaagtggcagcccaaggaccagatcggcagc

SEQ ID NO: 16348 - DNA, 460 bp, Zea mays
  Clone ID: cC-zmpo148045e10d1
gggcgacccaccgcgtccgcccacgccgtccgcatgcgacaagagacgatcgtcgtcaactttcagtttctcgacttcgagaaagctgcagcgcgggcacgcggcgacctcatcatccgaggcgtccggcaccactgtccgcaggcatctgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctcccggccgcgagcggcctcatccgtgccctctagcgcaccagcgccatcggggtcgtttgagttcttccccgcaccaggcccatcttttgatggcacctccagcgccccagtaccattgtccggcgaccattctgattc

SEQ ID NO: 16349 - DNA, 472 bp, Zea mays
  Clone ID: cC-zmpo148045e11d1
gggcgaaccacgcgtgcgcggacgcgtgggcgggtacaaggacacgcgcgcgctttggtatggcgtgcagacggtggccgtgagggcgggggtgttcgttgacggcgcggcctgcggcgggtgctactaggtgcgctgcgtggacagccctagcgggtgcaagcccagcgcggcgacactggtggtgacggcgaccgacctgtgcccgcccaacgaccagcagtccgcggacagcggcgggtggtgcaacccgccgcgggagcacttcgacctcagcatgcccgcgttcctccagatcgcacaggagaaggccggcatcgtgcccatctcctaccgcaaggtggcgtgcacgaagcagggtggcatcctgtacaccatcaccgggaacaagtactttaacatggtgaccatcaccaacgtaggcggtgccggcgacatcgcggcggtgtcggtgaaggggagcaagcgcgtt

SEQ ID NO: 16350 - DNA, 549 bp, Zea mays
  Clone ID: cC-zmpo148045e12d1
taacattaagggccacccacgcgtgcgaagaaaatgacccacaacaaggacagcaaattgccctttggctatagtcacgagaagcggggaatgtgcgaagggagggcggagaacgttctgctcctcatcaagcacaggtttcctggcattgcccagtcggcgctggacataagcaagatccaatgcaacaaggatgttggccttgccattttggagagctactccaggactctggagagcctggctttcacggtcatgtctcggatcgaggacgttctgagcgcggacttggccgctcgagatctcaggaacacggaatcgatgagaatcgccgccagtttagcttcggacgacaccgacaaggtcgtctcagacgctaaggccgaggtagagaagacggggagaatggagcccgcttcgccggcgctagctgacttggtcggcccgaagctgacgaagatctcgccagttgcaaccaaaaggttttcgtaccttgagaatctgggtggaacaagaagcccgatagctagacactatctgctgtaggta

SEQ ID NO: 16351 - DNA, 609 bp, Zea mays
  Clone ID: cC-zmpo148045f05d1
ggggcacccacgcgtccgcccacgcgtccggtcctctcctctgtccctctacggtgctttttctcgccggcccaaaatcgcctcagcgacggcgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctgcttcctagctgggggtgctctctaccgcttcgagtacgcagtcaacccggcgctcttcctcggcaaagcgcgaggagggacgtgcacgctcgctccctctgaccctgacgacacggtggcttcgccgcgccagatacctgctgagcaacggtttcaggtgctacaacctgttcaagagcaactgcgaggacttcgcgatata

SEQ ID NO: 16352 - DNA, 477 bp, Zea mays
  unsure at all n locations
  Clone ID: cC-zmpo148045f06d1
ggcccgaggccgacatatggagcgtcggcgtcatattctacttcctgctctccggcgttccgccctggtggggggagtcggagcacggcatcttcaacgccatcctgagggggcaggtcgacttcaccagcgacccatggccgcgcatctcgcagggcgccaaggacctcgtcaggaagatgctcaaccctgaccccaagcagcggatttctgcatacgacgtcctcaaccatccgtggatcaaggaggacggcgaggcgccggacacgccgctggacaacgcggtcctcggccggctgaagcagttcagggccatgaaccagttcaagaaggcggcgctgcgggtcatcgcggngtgcctgtcggaggaggagatccgtgggctcaaggagatgttcaagagcatggactccgacagcagcggcaccatcaccgtggacgagctgcggagagggctggccaacaggggcaccaagc

SEQ ID NO: 16353 - DNA, 486 bp, Zea mays
  Clone ID: cC-zmpo148045f07d1
cccacgcgtccggacaaaacatggctgtgaatgtgttaaccttttggtcgtcgatgcgggcacatgtggcgagggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccactttgatttagcaggcacggcgttcggcgccatggccaaaaagggcgaggaggagaagc

SEQ ID NO: 16354 - DNA, 519 bp, Zea mays
  Clone ID: cC-zmpo148045f08d1
cccacgcgtccgcccacgcgtccgcccacgcgtccttcggtttctgcgcgcgcacatcaccagattgggagcggccggtgccgctgctggggttctccgtctgctcgggcgcgcgggtcacgtcggtcgcccagggagcttcaccagggcacggtgttgcagggtcggacatcaatcgcgacgtccctagctccccgccggtgtcggggattgaacatgtgccgctgcgagcgaatcagttggccgctgtcaggaatcttcaaccgcttcaacgatttggtggtgctcggtggtcgggaagcttctctggctcacccctcacatgtgtgtggccttattggacaaagatagccttccgagctcgaccaattgctcatcggtgcaatggctccaccgcgggcgggaccactgctgcagacccatttcactcccttgccatcaccgcgtgaggtcacgagtcacctgaagatcattctggtacctggaatctcaagtcccaggtcagaaacaggttcccac

SEQ ID NO: 16355 - DNA, 663 bp, Zea mays
  Clone ID: cC-zmpo148045f09d1
gggcgaccacgcgtccggggagctggcactggtcaatgctccaagcacccattcaagccttgcagttgagaccaacttggctggaggctgggacaagctgctacttgacagcctctacgaagacgaggccaggaggcagcacatcgccggcgcgacctacaccggtagcctaggagcagccaaccctttctgcaccaatgccagcgatccgttcaccatgtctagcagatttgcaccaccggctaatgtgcagttggcactgatggctcagaaccaacagcagtattaccaggcgcagcagtattaccaggcgcagctgtatttccagccacagcagcagcagtattttcagcagcatcaacagacgttggcaatgccaatgccaaacatgtatcaccaccagtatcagtactctgtgcctacatctggagcttcgaacccatttggtgatcctttcagtgaccttgccccaatgggtgctcctgcaaaacagagcaactcagcttttctctgaactggttgctacttctgagtctgatcattcaattggtagagcagcaaacctgtacagcacttgttccttcgctagtggaggtgttgtatattgtctttcttttgcatatccaaatcttgaaatataacattagtaccaggactatgctg

SEQ ID NO: 16356 - DNA, 599 bp, Zea mays
  Clone ID: cC-zmpo148045f10d1
gtccggtgcggtcaatgtaattaactaagcttctcattcattcttagcttggcaaatgcctgagggctggctggacaaggtccgttgagctagcccctttgggaagaagggagaggaatggcgctggtggcccgttgagcgaggaagaggctattgagaacccgttaacaagaattgccagcagcatctggacaatcttgttaacagagttccaaaggttcaattccaagcggatacaacaattgatccgatccgattagcaatttccgagttggatcgagaagagtgcgtgcatccgtccgtccacgttcgtggttcgtataagctaggtttcatcaaccatgggcacaaagatgaagaaggggatcctgaagccgttccgctatatctcgaacatgatggacggtaaggagcctgaaatgcaaattgggctccccacggatgtaaaacatgtggcgcacatcggttgggatggtcctggatccaccaacagcgggcgcagcaacaacaataatgccggaggagctcctagctggatgaaggattacccactcgcgccggtcgactcgtcctcctttatgagcgagagtgggggcacg

SEQ ID NO: 16357 - DNA, 635 bp, Zea mays
  Clone ID: cC-zmpo148045f11d1
gggcgaccacgcgtccgtgcctgtgctggtgctgctgcttcctgttgttcatcttggcgtttgctggccggcacggccgcctactggttctgcgtgtacaagcccaaggcgccgtcctactccgtgagcaacatgtccgtctcgcagttcgacttcagcacctccgacctgacgctgtacgtcaagctcaccgcctccgtgcgcgccgagaaccccaacgagatgatcaccatcaggtacggcgagggctcccacaccgtggtctcctaccgcggcacgccgctgtgctccgggaagctcccggccttcttccagggctacaagaacgtcaccgtcatggacatctccatggagggccgccacggcttcgggtcggggctccagcaggcgctagaggagagcgagaaggccggggacatcccgctcgacatcttcgtcagcgtccccgtggagctgcagctcggctccgtcgacctccgccagattaaagtcaacgtgcactgcgcgctcgtcctcgatagcatctcgcccaagaagaaacccaacataaagtccgcaacctaccaggccaacgtagagttttgattcacaattgggtcggaggtgatcagtccaggccagggacatatgtatgc

SEQ ID NO: 16358 - DNA, 577 bp, Zea mays
  Clone ID: cC-zmpo148045f12d1
ggggcgacccaccgcgtccgcccacagcgtctcgcccatcgcgtctcgatcatccgagccgctctcgctcattcgatcgtcaccgagagcccgctccgagggaggcaggtgccgtcgttcatgtgggcaagcgcccctctgctgatgagaccaggcaggtatggttcattgatagctggcccgactccgattgcttgggcatagacggtcacctccgtgaagagggctttgattccaggcgcctcgccccgtcgcgtcccatgtgccttgcatggaggacagctgccaagccggccgggcgatcagcagacgtcgtctcggcgctctcgttcctcgccgatccgcaatactaccctccccaaggcacgggagccgagcagaaggccacacatcgagagagtaaacccaaggacaattctacagacaaggatagcagtcctcataatgccggaatgatcagggcagacgacgaaacgaagcatagatgatgaccgtagggggggaaggctaacgacgggaattaaagggaggaacactgcagagctgtctgtctgctctcttgaatctttctttttgt

SEQ ID NO: 16359 - DNA, 592 bp, Zea mays
  unsure at all n locations
  Clone ID: cC-zmpo148045g04d1
gggccacccacgcgtccgcggacgcgtgggtgcagtcatctcctccaccaccaccaccaatctcaacaacagccagctcgcgaaaagtgatgagagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctnctccttcttgaagcgaagccccttgaaatgaatgaaccatgcatgcatgcatgcatgtatgca

SEQ ID NO: 16360 - DNA, 476 bp, Zea mays
  Clone ID: cC-zmpo148045g05d1
taactttaagggccaaccacgcgtgcgatcttgggctgacgccgcacgtcaagggccagccatttcttttcatggcagccgtccggtccgacagggtcgagcaccaccaccgccgctccgaggcgtcttgcccggcaacctccgcggccgtggcggcggctagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgctttccctgcgtcatggtggaggtccgtggagctcgtcacggttcgcgcgcc

SEQ ID NO: 16361 - DNA, 562 bp, Zea mays
  Clone ID: cC-zmpo148045g06d1
taactttcagggccacccacgcgtccgcccacgcgtccggatccaacgacctggccaagtacattgcgttttggatccaggtgtcgcacgttagggacagggtcatcaacggctccggcacgctcgatggccagggcaccgcagtatataccaagagcaagaccgacgtcgtcaaggcgatgcccaacacactagtgttgttctacgtgaccaacggcactgtttccggaattaaactactcaactccaaattcttccacatcaacatcgacacttctaaggacatcaccgtgaaggatgtgaacatcacggcgcccgcggacgtcgagaacacggacggcgtccatgtcggcgggtcctccaatgtacgcatcaccaactcgaccattggcaccggcgacgactgcgtctccatcggccccgggagcgacggtgtcatggtgaacaacatcacctgtggccccgggcagggcatcagtgtgggctgcctaagccgctacaaggatgagaatgacgtgagcgacgtgacggtgcgggattgcgtgccttaggacaccaccaa

SEQ ID NO: 16362 - DNA, 518 bp, Zea mays
  Clone ID: cC-zmpo148045g07d1
cacgcgtccgttcttccacgtggtcaacaacgactacacgcactgtgttcatgttcgccatcggcggcagcaaggccgggaccgggatcagccagggcaaccgctacatcgcgccgcccaaccttgccgcgaagcaggtcaccaagcagcatgacacgccggagtccgcgtggaagaactgggtgtggcactccgagaacgacctcttcatggagggcgcctacttcaccgtcaccggcggccagatcaacagacagttcaacaagaaggacctcatcaagcccaggaacgggtcctacgtcaccaggctcacgcgctacgccggctccctcgcctgcacgcccggcaagccctgctagatcaagccaccagcgaggacggccgacgaccagaggcagacctgcatgcattcgccggctcgccatgtaagaaacaggggagttgaaagtgcgacacaccagaaaaccggtctgtgtatactgtgtaaaggtcctaaaggaaagagaagatgcacagac

SEQ ID NO: 16363 - DNA, 491 bp, Zea mays
  Clone ID: cC-zmpo148045g08d1
aaatttaagggccacccacgcgtgcgacggttttcacatccattttctggcaagaactcatgttcttgtagggcactaagctgcggatgacaagggcgtgtcatcctcaatctgatgggcagtcccagtcggccaaccgcgtcatcctcatgtatctacgctgtcttacgggggacagaccgcgggattggctcagatggctgccgtgggcggagtatctgttcaatacggcctatcaaacttcgctgaaagatactccgttcagggtggtttatgggcgcgatccgccgaccatccggtcatacgagccgggagacaccagggtgccagccgtcgcaaagaatatggaggaacgcgcagaatttttggcagacatgctccatcgcctggaacaagctcaaacatttcagaagcggcactatgaccgtgggcaccgaccgattcactataaggtgggcgattgggcgctgcttcgtctacgacaacgtgct

SEQ ID NO: 16364 - DNA, 466 bp, Zea mays
  Clone ID: cC-zmpo148045g09d1
ggggccacccacgcgtccgcccacgcgtccgcggtgctgtatacacaatttaaagtagcgttagggcagcggcttctctcgtttcggtgcttgggtagctttgtccccctagctcgtttgttctctcgtcgtcccgtcgtccggttcatttccgcttccgaggaataataatcaaccaaaggggcgggcgaccagggaaattaagaggcgatggtcagctgcaaatgcattcatgcgtaaacacatcgagacgccgtctcgaaccattgtaggagttaagtatatgatgatatataatcctgtctatctaataagtccctcagccaaaaattgttctttatatttatgtatatgtacatgcatgtctcctgattcaactttgatgtttattgtctctttcgctttcgtactgaacttatccgcgtaacttggtattggtatatggatcaatagattgttattcact

SEQ ID NO: 16365 - DNA, 495 bp, Zea mays
  Clone ID: cC-zmpo148045g10d1
gggccaccacgcgtccggctggttcgtggatggcggtgccacaacctctcctgttgtctttgctggtcgccgtgctagcggtgggcgcgggtgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctactaggtgcggtgcgtggacagccctatcgggtgcaagcccgacgcggcagcgctggtggtgacggtgaccgacctgtgcccgcccaaggaccagtggtgcaagccaccgcgggagcacttcgacctcagcatgcccgcgttccttcagatcgcgcaag

SEQ ID NO: 16366 - DNA, 517 bp, Zea mays
  Clone ID: cC-zmpo148045g11d1
cacgcgtgcgcaaagggtgaaaaacacagtccacagctgcgacagtttgtttttttgccaagggaaagagtaattgggggtaagcatggatatggcaatacaggtgataagctagcgcatgcctcagtgacggatggcatcagccaaccgagcttgagtgagagaagctttctgaagagtgaaagcatcagtgcttccaagtgtataggtgaaaaaccgaagcatgtcaaagatggagaatctgctttagagagcgtggatgaaacagtcgatgatttgtcgaagaaaattcctcaactgaaaacctgatttttctcaagttcactggagcaatgaatagctcgtagtatggcacgttaggttctcaagacgatggacctacggcaaaggtctatagccaatgagaccacaagttctaatgccagtaattctgttgtgatgtaaatttcctcccatttgtgtttgtactttgcgactgcaaacaacctgtttctgactaaatggctcgtgtttttcc

SEQ ID NO: 16367 - DNA, 563 bp, Zea mays
  Clone ID: cC-zmpo148045g12d1
cgtagacccgctcatccgatccatgctaatgtttataattttttaccttttcggttcccagccccaacccctgggatctgcactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaagattgccgtatgtgctgcttcgggtctcgagttcctccacgagaaggccgatcctcgagtggtccaccgcgacatcaagtcaagcaacatact

SEQ ID NO: 16368 - DNA, 536 bp, Zea mays
  Clone ID: cC-zmpo148045h05d1
ggccaaccacgcgtgcgcgaacgtcttacgagaacctttctccctcctccacctttctctctttcttgccacggcaaaacacctgtggccagcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacactttcccatcccggctgccgctgacacccgcggcctcgcactccacgtgaggctccgcgcccagcgtctatacctgggctatcgcgacatcggcgaggtgtttgtgcccatcgacgacctcctggccggcgccgacaagggtggcgatccgaggcccgtgagctaccatgtgcgcaagccgcactctggccgcgcccacagcgtcctctacttctgctataaattcaccgaggtccccgccgtctc

SEQ ID NO: 16369 - DNA, 480 bp, Zea mays
  Clone ID: cC-zmpo148045h07d1
gggcggccacgcgtcctcgcagagggccgtcacctggtccttacgcctctgtgtccattcggggcaaacacggagacggtgggagcctgccgcacctccatcgatcggaacggaagaatggtgggagaacagagaaactccaccgccatggcccggcgccgcgcctcctctggtgcactggtaccgctgccatgtgccgtgcagtgcgttggtgggatcctgtcgtcgtggtgggaatccagcggccctgggtaattcgggtgtgcgcccacatttggcctcggtgaccagctacaggattccgccgacatcttcagtgcaaatcatgtggtcattgcgggtggattgattccttatgaccctgtgattgttcaccggaaaatctacacatgtggcatagcgactctgagcggtgaccggagtgattaccccattccatttggtaagaaagcttaccctgtcaattctattcttctctcc

SEQ ID NO: 16370 - DNA, 462 bp, Zea mays
  Clone ID: cC-zmpo148045h08d1
gcccacgcgtccgcccacgcgtccgcccacgcgtcctttccggtagcgcgagcgcgtggcacctcggggcgggatgctaccccgtcgcctgggcaggcggccccgacgcacaagtgcgagcgcggtccccagcagcgtgctggctcgtggccatggcgcgagtgcgctgacacgactgggcgaccaggcatcggggcgagcacatcccatcctgactcgggttgcgccatggcaggggctgcgcccaccgtcgctgttcacttgggcgcaaacaagccagggcctgcaggccacgggagccaacactgttccttgaattgaaaatcgttgtacggcgagcgcacgtggcagaaatgttcattaattatgaacttgataagtttactattcgtaccttgtaaaatcagacttctctgatttgtttatttgaacggatgctcttataaattgatgaatttgtcc

SEQ ID NO: 16371 - DNA, 537 bp, Zea mays
  Clone ID: cC-zmpo148045h09d1
gggccaaccacgcgtccggcatgggcgggcggcggcgctccgcctccgtggggttggcttctgagatctacgagctcccggtggagaacggcggcgtcttcgtcaaggtggacgccagcgccgtcgaggcggtggcgctgccggtgaagcccgccttgcagctggaggagacgggggagcttgagaaggaggtgtgggccaggttctacggcacgggcttctggaggagcgtgtctcagctcgacgacgacgacaggtgaccggaacaatcaggcccgtgagtgagcgagcgatcgaccagctcctccggcgatgcttaagcaatagcatgcgtttccttggttgggtttccttcgttgttttccgcggaaataagagaagatcgaggaaaaggaaatgtgatgcatggtcgtcgatcgactatacgagtttcttttgttttgctttttgaagggagaaccattctcttctacgatgccctgcatattaatgaaatgtatgtctattgaacaaaaaaaataaaaaaaaataaagggc

SEQ ID NO: 16372 - DNA, 465 bp, Zea mays
  Clone ID: cC-zmpo148045h10d1
ggggccaaccacgcgtgcggaaagaagtcgcctaattctttcgatcgaattaggtttccttcttcgtcccacgctccgtctttatggggaatggtaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgc

SEQ ID NO: 16373 - DNA, 535 bp, Zea mays
  unsure at all n locations
  Clone ID: cC-zmpo148045h11d1
ggggcgaaccacccgtccggtcgtccaacgactccgctcacccttcgcggtcgccttcgctgttctctccaccacttccccgccggggcctgcgaggcgtccgcgaggagggccagcgatgaagggctcctcccactcgcaggcgggggcgcaggcggtacggaggcggcgctgggggtgtcttctgccgctcctcgttggcgccgccttcctcgccgagatcgcgttcctcggccgcctcgacatggcgaagaacgccgaggcggtcgagagctggaccacctccttttaccgccgctccgccgatttgggcgatgccgttggcgggggcgcagcctctagggcaggcggcgacagcgaggacgaagagatccggctgtgcgagcagcggctcgagagggaggatgccgtgccctacgaccgcgactttgacagtgatcccgtgcttgtcggtggcgctgccaaagattggaataaatgctacgtangatgtgacatttgctttttctgcgagtaagacacctgatgctacatt

SEQ ID NO: 16374 - DNA, 568 bp, Zea mays
  Clone ID: cC-zmpo148045h12d1
aaaaaaaaaaaaaaacaaaaaaaaccacaaaaacaaaaaaaaaaaaaaaaaaaacaaaaaaaaaacaaaaaaaaaaaaaaaaaaacaaaacaaaccagaaaacaccacaaaaaaaaaaaaaaaaaaacacaagaacacaaaaaaaaaacaaacaaacaaacaaaaaacaaaaaccaaaaaaaacacaaacaacacaaaaaaaaaaaaaaaaaaaaaaaacaaaactaaaataaaaaaaaaaacaaaaaccaaacaaaaaacaaaaagaaaaaaggaaatagaaaaacaaaaaaaacaaataaacaaaacacaaaaactaaacaacaacaaattaaacaaacaaacaacaaaaaaagtaaaaaaaaacaaacaaaacactacaaaaatctcaccacaaaacgaacataaaaacacaaacgtaaaaacaaaaaaaaccaaaacccacacaaacaaacaacaaaaaaaaaaaaaaaaaaaaaaaaaaaaaaaacaaaaaaaaaaaaaaaaaacaacactaaaaaaatcaaaaaaaacacaaaccaaaacccaaacaaaaaacaataacaac

SEQ ID NO: 16375 - DNA, 490 bp, Zea mays
  Clone ID: cC-zmpo148046a01d1
acgcctacggcacgcgtgcgaccactcgtccggcgaaataccatgaaatatatattaaaatatagcgtgttcactgggattcaaaccggggtgggtaggaacaaagcactcgtctctaaccactacagttcatgtcggtttgtgttatgcagcgaaaccatacaacgggtactaacacgataggagaccacgagcaactaactagtaagggcatgtttgggagtgaagtacttttgcagtttataggcaataccatactttaaaggaatactgtcctattttatactatgaggtgttaggttgtattcctagaaactgtactttaaagaccaaggtcttgtagataccatggcttcttgggaggattggaaactgcacttcaacccaaagtttttattgcatggatagcttttgcctaccgaccatggttgacattgtcgtatccaaacaatgcgtctcaaaaccatggaattcctggagcttgagaaaa

SEQ ID NO: 16376 - DNA, 498 bp, Zea mays
  unsure at all n locations
  Clone ID: cC-zmpo148046a02a1
acagtaaatgcttgtcttttttgtggttcatataaattacagtacctagtagttctgaatttacaaaaggatttcactcacctctttttttttacttctgatttcactctgttctttcttctatcctccttcctgctgacaaaacggttacctggacaccggcacaccgctttccatgagctgggaaagacaatgactcaatggacaagccttaactttactgatttcactcgccacgaaactggaagcgttgtcctgacacctgaccaacaatcagctcgaaagggatacacatgcatgcagcagcaagcatcgccgtcggcgatcgacaatctacggcggcggcgtgccgattcacaccgccattgtcagcagcgcggacacgaggcacaggcaggcggcggcgagccccgcgcccgcgcggnccatgaggcgggcggcgccggagctgtcgtcgtccgtgtccggcggcggcggcgggaccaggagcacgttgat

SEQ ID NO: 16377 - DNA, 343 bp, Zea mays
  Clone ID: cC-zmpo148046a03a1
cactgtccaaaatatttctcgtttcctgaaaattttcaccaggagaaacaaccaaatgaatcaaaaagaaaagaaaaagtggtaaaggtacaaacgttagccctcctgtcctgcgacacctcaggtacaaacatgtatgtgccacctccctatcgagtgctgtatataacatgccatgcgtgcggtctttagaacttgaacccgaagatgtgcggcgtgccggtgaacttgagccacaacgcgccgtcgatgaacggcccggcggtgaactgctcggcgttctttcggccgatgacgtggaacccaagccaggtgaccctcttgctggtaccggcgccggggc

SEQ ID NO: 16378 - DNA, 573 bp, Zea mays
  Clone ID: cC-zmpo148046a03d1
tcgtcccacgcctccgcccaagatggcaaatgctctcctaggaggcctgtgggccatcgccttcttcgtggtggtcgtcggcgtggtcgccaccgggacccactccggcaagaaggccggcgacgacttcaccgtcccgggggaagcctccattgccacgtccggcaagtcgggcgagtccctgtgcgcgcccacgttgtacaaggagtcgtgtgagaagacgctctcccaggccaccaatggcaccgagaaccccaaggaggtgttccacagcgttgccaaggtggcgctggagtcggtgaaaacagcggtcgatcagtccaagacgatcggcgaggctaatgccagcgactccatgaccgagagcgcgcggcaggactgcaagaatctactccaggacgccgttgacgacctcaggggcatgctcgaaatggccgggggctacatctaggtgcttatcagccggtccgacgaccttgatacatggctctcgggcgtcatgacgatcatggacacctgcttcgacggctctgttaccagaagctcagagccgacatgcacaccgtgctgcgc

SEQ ID NO: 16379 - DNA, 432 bp, Zea mays
  Clone ID: cC-zmpo148046a04a1
tttttttttttttttttttttaaatattttttattttttaacttattgtggggaaaggggttttttcatactttcatgcccattttttgttttacggagaaaccccctattgttgggggaaaaaaataaagactggtccaggacgaatcaccaaaggttgtttacaaacatgcggaagattatttgaaataaattttaaatgaaaaacatggggcctccaatgacaaatcattaccttgcgaagggggggccccccaccttaaactttcgaggaggaaatagaccttgccaaatgggcccaggcaggaattaattaagacataatacttcttggaagccccaaactactgggggccaataagattaacccttttgtaaacctaccccatgggggggggaacactctccattgtgtagaaggccacgcacccg

SEQ ID NO: 16380 - DNA, 381 bp, Zea mays
  Clone ID: cC-zmpo148046a04d1
tcgatcccacgcgtccgccgacgcgtgggcaagcctacccacgacttgttctcctcgccctcgttacgtttttgtctgcctgcctcttcccgcaggcgttagggaacggcttgggcaacgtgcatggcagcagtgccgtcaaccctctggatgccggcatttgctctagcgccccattcctacaggtgtgctcggccacagccgggcgccatgcatccaagtacccggtcatcgacaatttggccgtgctgaacattcacgtggccttgttcgccaagctcacatcgaaagcgcggaagcacgtctcgatggcggcccgcactatttcaccgacgcaagcacaggccctcaggacctgctacactatgtacatgaacacgc

SEQ ID NO: 16381 - DNA, 179 bp, Zea mays
  Clone ID: cC-zmpo148046a05a1
accaacatcagtatgaaaactgaccatgatcggacaaggggtcacgaacaaaatttctggcagtgtagacacgggtagtctcacccaatacatttgcttctcgtggatggcggtccctaccaaacgaaacacaagagctcacttaccaatggggtagacctagaccgaacaaaatgtat

SEQ ID NO: 16382 - DNA, 117 bp, Zea mays
  Clone ID: cC-zmpo148046a05d1
gcggcaatcgcatatatcacccaaaaaaccaattctatgtacctattatcattttcaactgcatacaaacgatctctgagagtggggattgaatagaggcttctctgcctactctca

SEQ ID NO: 16383 - DNA, 229 bp, Zea mays
  Clone ID: cC-zmpo148046a06a1
acaaacattagtaagaaaagtgtccaataaccgacaacgggacatgcacaaacttgctggcggtgttcacactagaggactatcccaatacatttttttcacttagaatgagtcccctaccaaacgaaacacaggagcgtattccccaatcgggtataccgtaaccgaacaaaacgctagatgtcggattaaatgcagccgagcatgttcagaatggggactaacgagt

SEQ ID NO: 16384 - DNA, 182 bp, Zea mays
  Clone ID: cC-zmpo148046a07a1
ccaacatccttaagaaaactgtccaataacggacaaagtgacttgcccaaaattactggcggcgctccctctagtttactatcccaatccattggttttccgtaaaaggagttccctaacaaaagaaactcatgacctgattgaccaacggggcatacctaacccttacaatacgatacttg

SEQ ID NO: 16385 - DNA, 391 bp, Zea mays
  Clone ID: cC-zmpo148046a08a1
agagttcagacaaactgtgtttatcgatgcgatcactgatacatttcttcctgatccatattggggagagtcgtctctgacacgaatgcaatttcggttaagatcagaacgattacatacatgccgcaagcggatggatcaatggatcactccgaggcacggccgttgaacgattctgacttgaactgctcatagaacttggtgatgaactcctccgactgcatgtcgatggcgtgtgggcaactgctgacaccgtcatcgccacccttagcacccttttcctggtcgctgtacatctggtgcacatcctcagcggacgcgtagcggttggacatgcccacctccttgatctggaagccgaaccgtgcctgcgacggcggagggaggatca

SEQ ID NO: 16386 - DNA, 152 bp, Zea mays
  Clone ID: cC-zmpo148046a09a1
gacttacttttttttatatttttcacatttactatgaaaagtattgaacaacctactacagggtttgaagatacttactgggagccttacctctttatatatgatctaatacagtattcttcggtagaacgagcttccttttacacgaaatt

SEQ ID NO: 16387 - DNA, 131 bp, Zea mays
  Clone ID: cC-zmpo148046a10a1
gtacaattaaaacatgcatttgaaaaagtactcgatacacgagcgcgcactttggagagaattctgggggcaatcaactcaacacaagtgtccttaataagggagcctttgaacaaagcattatctgaaaa

SEQ ID NO: 16388 - DNA, 218 bp, Zea mays
  Clone ID: cC-zmpo148046a11a1
gtatgatgtacactatcgggtggataagtatcgataaagatacagggtgcttggaagaaagtgcttagaattgttagatcaaaattaaaatgcaaaaagggggaggagggaggatgagcctctcgtgcataacgatcttcttgttcttgatcaccatgaggtaaaaccttgggaatacgcaaccgaattagtggtaattaaggaacaagcgaatggtc

SEQ ID NO: 16389 - DNA, 492 bp, Zea mays
  Clone ID: cC-zmpo148046a12a1
gtatgctgtactcgatcgtgtgtatatatatagatatagatacaatctgcttgactgattgggcttaaaattggaagaacaaaattaaaaaacaaaaaagaagaagagggaggaggatcctctcgtacgtagcagtcgtcagtcttcttgatcatcatcatctccaacctcggaatcaggcaattgcttcagtagtaattaattaacaatacaatcatcactcagtaaatcagtcagcgctactacgtacgtacgtagataggaacgaacagatgggtggatggagtcagttattgtttggtgttttgatcttgatcttgtccaggtccgatgcataggacttgcaggtgatgaagacgccgcccttgaagcactcggctcgtgcgcagccgaccttggtgctcctattgccgaccatgagcgcgaagtggccgcactccttgaagaccttgccgtacttgcacttctgcttattcttgacggagatggcct

SEQ ID NO: 16390 - DNA, 499 bp, Zea mays
  Clone ID: cC-zmpo148046b01a1
aacagaaaacatgggtgcataaattagaactcagccaaaatgagatgttacaaaatggaataacagtccagagcatgagacaaaaaaaattacaaaggtttctgtgagacttctacccaggctccctcagaatccaagaaaacatatcataataacagcgcaaacgctgcagtcaatcagcagagcacctagtgctttctgtagcagcaacccgatctctagcatctgccctaagctatcagctgaacccagattgacgccaacgggtctgcttctcacattggggtctttgttctccatcaacaatgtgaagacaatggtgatgttggttacaatgagaaatagaagaggccttgtaccaactaatactctggtgatggcaccaccaatgtcaaggccccagtttgacagaaccaccaggaaagcaatgacgacagatgctacgaaacggttactctcggtcgccgaaatggccttggttatttcctgtggagtgaaa

SEQ ID NO: 16391 - DNA, 618 bp, Zea mays
  unsure at all n locations
  Clone ID: cC-zmpo148046b01d1
cccacgcgtccgcccacgcgtccggcgaaataccatgaaatatatataaaaaaatagcgtgttcactgggattcaaaccgtggtctctaggaacaaagcactcgtctctaaccactacagttcatgtcggtttgtgttatgcaacgaaaccatatatgatatatagaaaccatagtgatgcacgagcaactaactagtaagggcatgtttgggagtgaagtacttttgtagtttataggcaataccatagtttaaaggaatactgtagtattttatactatgaggtgtttggttgttttcctagaaactgttttttaaaaaccaaggtattctagataccatggtattttgggagtattggaaactccactccaacccaaagtttttatggcatggctagcttttgcctaagtaccatggtttacattgttgtatccaaacaatggttctcaaaaccatggtatttttggagctgaagaaaaccgtagtattgcctcggcaattgcaaagtatagcattgtaaaaactatgattttgaaaaacaccgttgccaaacaggccctatatgataatacaacacctccatcgatcgctgntagctaatagatatccaaaaca

SEQ ID NO: 16392 - DNA, 362 bp, Zea mays
  Clone ID: cC-zmpo148046b02a1
gggggcggggccctaaaaaaaaggggccttttacttgagcttaaatatgaagcatggcctcccaaactttacaaagccccccgggtttatctccccttccatcgaattgaagcaacatgaacttccctggccccgggctttaaaaagttcctgttcctgcccccaggggggaatggcgacaggaacaacactttccatcgatcaggggacctggttgttgcgccccccggggccgggcccgggggggagtttaccccctgggggggggggtgggtattccccgttttaacagttctgggccggggggataatgtctgggggaaatttgccgtttcttcaaacaacggggtttttttgggggg

SEQ ID NO: 16393 - DNA, 417 bp, Zea mays
  Clone ID: cC-zmpo148046b03a1
attagaggcacaagcactggcagacgtgttaattttcctcataaacaactgtgcatacaccaagatttttggattttgaactctgcgacacaacaaaagacactcttcccatgacaagcttgctttttaactgacttatggacacgccgtaccacccgcttgctttccgccgttctccatgaaccacccgccgccggcgagctcccgctgacctgggcattactttaaccacttccactggtggtcccgacggggcttatgcgtgcctactacgcgtggacgagggtccttaaccgggtgagctccggcagtacgaccgttgctagggcccgccggtcccttcggcgcatttccgcgcacttgagcgcaagctttgctttacccatcgccttctttacaggccaatccttgacggtg

SEQ ID NO: 16394 - DNA, 479 bp, Zea mays
  Clone ID: cC-zmpo148046b03d1
cccacgcgtgcgggcacgccgaggagactgctctggcactggccgatatggagaaggccaagtgccgcgcggccatggaggcagccgaggcggcgcaaagactggccgacctggaggcgcagcggcgccgcaacgccgaggtgcgcgcgcgccgggaggccgacgagaaggtgcgcgcactggatgccatctccaaccacgacttccggtaccgcaagtaccacatcgacgagatcgagatggccacggagcgcttctccgacgagctcaagatcggcgagggcggctacggccccgtctaccgcgcctccctggaccacacccccgtcgccatcaaggtgctccggcccgacgcgcaccaggggaggaagcagttccagcaggaggtggaggtgctcagctgcatccgtcaccccaacatggggctcctcctcggggcgtgccccgagtacggctgactcgtgtacgagtacatggag

SEQ ID NO: 16395 - DNA, 498 bp, Zea mays
  Clone ID: cC-zmpo148046b04a1
aactcgaaaaaaacaaatcttattcataaacaaaatgggggcacagatatttctccatacgttcatgctcattgtggtagacgcagctgaccacctagagctgcatacttacttattcagactgatccagcatgtggcaacatcggaagttcacatgcttacagacgacaaattttcataacaatagcctggcttggctgcttcacagaataaccaaacgacaaccacgaaattgcgacgatataaaataaacaactcagaagcaaatcgaccccagaagcccgtcttactcatcaagcactcccgccttctcctccatggcatccgcttcctcctcccagcagagaagattagccagcttgtagtccttcttcataggaggaggagcactctccacgttctcgccgtcaaagcagtggaaaacagatttgggcgaggtagcaacagcgtcttcagcagcacagaagctctggtacacgaggagcccgccttcaggca

SEQ ID NO: 16396 - DNA, 581 bp, Zea mays
  Clone ID: cC-zmpo148046b04d1
tcatccacgcgtccgccgcgcgcgtgcggcttcttgctgccaaagcattccctcccctagccgttggcttcgtcgctcgtctccctgtgaggtgccgggagggaggaactggccgagtcctaagtggagaatcggccttttcttgtctcaccccggggtttgctgcgtctggtggtggtgaatgggagaaatccttgacatctgtgccggatcaggcgtgctagctcggcaatcaggggtttcacacatagctttcgctgcttggaatttgatgtactaatggagtctaagggtggttaaaatgttaccattactcgtcgtataatgtatgaagcttcccttggctacagcattgaggacgttcgacctgccggaggcgtgaagaatttccagtctgttggttactccaactgcgcgaggaagccatcctgatatcccttttggatttctcattctagcagtgtaggatttcttttgtgacacctttgattatgaccaatctctctggtctgctgcttcctgattattgaccagttacacatccttgctccttgcactcactcgtccatgtccagcattgt

SEQ ID NO: 16397 - DNA, 200 bp, Zea mays
  Clone ID: cC-zmpo148046b05a1
ggatgtaccgacatcagtatgaaaagtgaccaagaacggacaaggggtcatgaacacaattgctggcggtgtagacacgggtggcctcacccaatacatttgtttccagtcaaaggggctctctaccacacgaaacacaggacctcattctccaatggggtataccttaaccgaacaaaacgcatagatgtcggattaca

SEQ ID NO: 16398 - DNA, 170 bp, Zea mays
  Clone ID: cC-zmpo148046b05d1
gcggtacatgcatatcgtacgtaaaaaaccaattctatgtccctattttctcatcgaactgcactcaatcgtcctgggagggagggaagtcaatagaggatcctaagcagactctcacgctgatggggtagccatgtaccctagaaattaaagacattgcggatgctacg

SEQ ID NO: 16399 - DNA, 194 bp, Zea mays
  Clone ID: cC-zmpo148046b06a1
accgacatcagtatgaaaactgaccaataacggacaaggggtcatgaacacaattgctggcggtgttcactctggaggactctcacaatacattttttttcattggaaagagacctctaccacacgaaacacatgaccttatttgccattcgggtatacctaaaccgtacaaaacgatagacgtgggattgcat

SEQ ID NO: 16400 - DNA, 349 bp, Zea mays
  Clone ID: cC-zmpo148046b07a1
accttgattttctttttttttgaggtaccaacacccgtcagaaaactgaccaagaacggacaacgtggcatgcccacacttccgggcggtgttccctctagtggtctatcacaatccatttgtcgcacttagaccgaggtccctagcccacgaaacactggaccttattgctcaacggggaataccctaaccgttcaatgcgcaactcgtcgtatgacgggttgccgtgaaggatctgaatgtctaggaacaagggctggaggtagtcgttacggccaaccgatatccacatgtcctagttgacagggtggcggttgaccacagtttccgctctcattccagatgacag

SEQ ID NO: 16401 - DNA, 450 bp, Zea mays
  Clone ID: cC-zmpo148046b08a1
tcgcgatctaccgccctttttttttttttttttttttttcagaactatttgacatccgattgcagggttcggagcatctcacggagggcctcgcctcttcatatgtgttttgtacaattgcgctcattcagaaggagctcccgtttacaagagattttggctgctaatgtggtaccagtaaaaaaaaaagcatacagtcccaagcaggtggtatcacccgaagaggtggtctatctgaatgtggcctcatgagggctacacagattctctgggtatcacttattcgtctggttattatttgcgtcagattcagctttccacacgatatctttcaactccgatgagaagttcttgtaaaagctggggaactccaatggggctccttcgggtttacgaagctcaaccatgtgaagtgatggggcaacctcaaaaacctcatttgcaacagat

SEQ ID NO: 16402 - DNA, 364 bp, Zea mays
  Clone ID: cC-zmpo148046b10a1
ctatctatctccctttgtttattcttttatcggttgcagaactacctgacatcctatggcggggtctgaagcatataacggagggcctcccctctgcatatgtgttctgaacaagtgcgctcatgaacaaggagctccctgtcacaagaaactatggatcttaatgaccgaccgggaaaaaaaaaaccgtacagtaccaagcaagtggtattacccgaagacgggcactatcagaatggggcccaaggagggctacacaaattctctggggatcactcatgcccacgtttattattcgcggcggtagcagttttccacacgatatttttcagctctgatgaaaacccataggagaagatgcgga

SEQ ID NO: 16403 - DNA, 180 bp, Zea mays
  Clone ID: cC-zmpo148046b11a1
gcataagtatctaacatccgacagggtgctttgaagaaaattactgacgctgtctccatcatgatttgtgtcctaaacaaaagtgctcatgaaaaaagagctcccttccacacgagactcatgatgttaatgaccaaccggtaaaaactaggccatacaataccgattcatgtggtatta

SEQ ID NO: 16404 - DNA, 527 bp, Zea mays
  Clone ID: cC-zmpo148046b12a1
gtagtaagagaatttacagttgcaaagggttgctataacatatgttttcttcttcatctgctgcctttcactattcaccacggcaaaattcacctccactatgtttaaagaagcaaagggaaaataattcctggtatctcccgatccaggttttctgaagtattggcctaaccaacccgaccttggagcttcctgatgcacgctctaataagggcctgttctgttttatgagactatgatagccctagagaacgagaaaagcgatctgcaaggttcgcgataacaaagcctgaaaatacctggacagaaccaagaatatatactgctgaatagtgacggccgtgaatgatcatatcagcaaccattgctattggaattgtgagagacatgcctagagtggccaccaagggagtagtccaaacaacagaaagagcccagaagtagtctgataatacacttccgattaggctatttgccaccaccacttcatccactttagctgagtggggcattgaaaactttggctc

SEQ ID NO: 16405 - DNA, 500 bp, Zea mays
  Clone ID: cC-zmpo148046b12d1
cacgcgtcctcctgcctgcctgcggacatgggctccagcctcttgtaccgttctggcctgtgcctcatcgtcggcgtcgtgctcatctgggtcatctctgccttggtcacgcaggggatattgatgatggagaggcaggcagcagcagtcacttactggtgggcctccgttatggtcatatacctccctttgcctttgatctaagtttgtatatacaccttattgctaaggcattctagaaactcttgtgcttcctaaattgcaagcaaatcttcctttggaggtagtgccccttcgaagtatggtgtatttcagaagaagttggacatggaatcactgtaaactattgaggtatattgccctgatgtgtgcatccctgtagaggatgagactaaacctctcatatgcggtatctctgaaatggatgatggcctcttcaatgacatgcaactttccactaaagagatcgcaacgtatggattgtatctttgccccttatg

SEQ ID NO: 16406 - DNA, 481 bp, Zea mays
  unsure at all n locations
  Clone ID: cC-zmpo148046c01a1
agcataatgaataagttccaagattgtgaggcgtcggtctaataataattacatcggttggttttgtgatgatccaaagaagaaagaaaatacaaaccagcggattatatattccgcggagacttgagagtacgtgagaaagagagaggttacgaagagtgattatatgtataatatatgcatgttagccaatgggttcagatgcaggcgagctcctttgccaagccgatggacttgtcgatggcgttcttgcagacggccatggtcttgttgccggatccattgtacttgatgtcgacgttgactagctggacgccctggcatggcatgtcgttggcacacatgagcgtgatggcctccggcaatgttgaggtgccggggatgttactgaagacgacgtcgntgacagacaccttggaggcgccggacttgacgcagatgttgatggggcagtacttgtggacgatgatgatggggtaag

SEQ ID NO: 16407 - DNA, 602 bp, Zea mays
  Clone ID: cC-zmpo148046c01d1
gcgtcggcgacgactgcatctccatcggccccgggagcaagatgatccgcatccatggcgtcaagtgcggaccaagccagggcatgagcgtcggcagcctggggcgctacaaggacgagaaggacgtggaagacgtgcaggtgacggggtgcacgatcgccggcaccacgaacggcctgcgcatcaagtcgtacgaggactccaagtcgtggatcaaggccagcaagttcctgtacgagggcatcaccatggacaatgtctcctaccccatcatcatctaccagaagtactgccccaacaacatatgcgtcaagtccggcgcctccaaggtggccgtcaacgacgtcgtcttgaagaacatacacggcacctccaacacgccggaggccatcacgctcaactgcgccaacaacctgccatgccagggcgtgcagctcgtcaacgtcgacatcaagtacaatggatccggcaacaagaccatggccgtatgcaagaacgccatcgggaagagcatcggcttggcaaaggagctcgcctgcatctgaaccaattgactaacatgcatatattatatatataatcactcttcgtaacctgtttct

SEQ ID NO: 16408 - DNA, 360 bp, Zea mays
  Clone ID: cC-zmpo148046c02a1
cactaaaatgaacaatctataaatatattgttagatgctccccgcccagccacgagtacaatatagggttttttaagcttacaatgacagtaccgacaatgtgttccccgcccagccacgaataggatgtcccgacgagcgactgaattactgcgcccggctgggcgaccctcttgaagccttggccttgaccggcaacctggccgttgggcccgaaccattggcgttccccgcctaaaacttggcgggcaacggccagcgggaaaaccccttggccaaggacccctttttcaacaacttctttgccccccgcctgtgggaatttcccaacgggttttttccccaaaatcccgcgggggt

SEQ ID NO: 16409 - DNA, 538 bp, Zea mays
  Clone ID: cC-zmpo148046c02d1
gcggaaccttggcaaactattacatgtaccatggtggaacaaactttggaaggacatctgctgcctttgtgatgccaaagtactacgacgaggcacctctcgacgaattcggcctgtacaaggagcccaagtggggccatctgagggacctgcacaggcgctgaagctgtgcaagaaggccctgctgtgggggacgccgtcgacggagaagctgggcaagcagttggaggcgagggtgttcgagatgccggagcacaaggtgtgcgtggcgttcctctccaaccacaacaccaaggacgacgcgacgatgacgttccggggccggccctacttcgtgccgcgccactccatcagcgtcctcgccgactgcgagaccgtcgtcttcggcacccagcacgtgaacgcgcagcacaaccagcggacgttccacttcgcggaccagacggcgcacaacaacgtgtgggagatgttcgacggggagaatgtgcccacgtacaagcaggccaagatcaagctgcgcaaggcccggcgacctcta

SEQ ID NO: 16410 - DNA, 499 bp, Zea mays
  unsure at all n locations
  Clone ID: cC-zmpo148046c03a1
atctccgttaaaaattatagcagtacaaatcatagcacattctgtaggtgtaggatacagtaacacagcagcagaacatcaaacccatctcctgccaggctctgagcaaacgccaaagcctccaacgtggcacctacgtaccgtaccccactcctggtacccagtcacccaccccacaccctacctcgctcgcagtcgcagcttccggtgtacgcacactactgcgcggtgcacgcaccgacgacacggnggggcagcttatgtatgagtaagtatagggactcgccatacaggtagtcgtcgcagcgtgccaccccgtctagcgatcgaacacagtcgacggggaacgccggccggtccggtcagttggtgagcgcgacggcggcctcatgcaccaggggctgggtggcgtgcgcgacaccctcggcctcccgcttcacctgctcccggnacgccttccgcgcgcgcgggtccgtcatgcgcttgacgaacgcggcga

SEQ ID NO: 16411 - DNA, 596 bp, Zea mays
  Clone ID: cC-zmpo148046c03d1
cttggaggagatggacaaggaccaggacctggcctacaccgaccggtgtggccgccggaactacgagtacgtctccctgggctgggacgcgatgcccgtgctcaagggccgcacccccatccagtgctacgccgacttcatgcgcgcctttcgagaccactttgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgagtagcttgaaggcggctgctgaggcagtgggcaagccggagtggggcaacgcgggtccgggcgactccggcagctacaaggactggccggaggacacgggcttcttccggcgcgagggcggctggagcacggagtacggggagttcttcatgagctggtactcgcagatgctcctggagcacggcgagcgcatcctgtcagcggcgacaggcgtgttcacggggtccctcggcgtgaagatctcggtgaaggtggccgggatccactggcactacagcacccggt

SEQ ID NO: 16412 - DNA, 399 bp, Zea mays
  Clone ID: cC-zmpo148046c04a1
cttctcttgtttcgggaggaaatcgatgtattccccggacaaacttcggggatggccggagcctgaaacgcgacaaaacatctttggcctcccctccatgttttcccttccggattggtaacaaaacaattgcatctacgccggagctgaactggactggcctgcactgtgctgtaccaaagactgctcgttggctttagaatgggctccctggttttccgccggaaggaaaacctacaaagaaccccggctttcttcaaaggcccaacccctggatgtacagatcctgcgcgggcttgcgttccgtcccgtcccggtccgggcggaagattgcccagcgcgaggggggcctcttataccaaagatcctgtggcctgttggacaccgtgcccctcccgt

SEQ ID NO: 16413 - DNA, 410 bp, Zea mays
  Clone ID: cC-zmpo148046c04d1
gtcgatcccacgcgtccggccgcggagcgggaggcgcacggcgtcgcgcaggccaccgggtcgttggtgctcgaggccgccgtcgcgctgcggagctgaccggccgggacgggacgggacggaacggaagcctacgatcgactgtacatacaggggttgggacttgggagggagctcgggtccttgttgggttttcctttgggtggagagcgagggagcgcagtcgagagccagcgagcagtctctcgtgcagtgcagtgcagtgcagtgcagtgcagctccggcgtagatgagattgtattgtgaccaagccgggagggaaagcagggaggggaggacaaagatgttttgtcacgtttcaggctccggccatcgccggagtttgtccggggaatatatcgatttcctac

SEQ ID NO: 16414 - DNA, 160 bp, Zea mays
  Clone ID: cC-zmpo148046c05a1
ggatgtaccaacagaggtttgaaaagtgaccatgaagggacaaggcgagatgaacacaatggttggcggggtagacactctttggatggaataatcaaattactgggcatcaaatggagctggtacataacgaaagacaagaggtcacatgcgaatgggg

SEQ ID NO: 16415 - DNA, 166 bp, Zea mays
  Clone ID: cC-zmpo148046c05d1
gtcgattcacgcgtccggccgacgttgcgaatactacgtaaaaacccaattacatgttcatcttttctctttctacctcactacaatatatcaaggagaatgggaagtcaatagagaatcttatcctgaccttcctgcccatgaggaaccaattaatcctataaaa

SEQ ID NO: 16416 - DNA, 417 bp, Zea mays
  Clone ID: cC-zmpo148046c06a1
agatgtaccgacaccggtattaaaagtaaccatgatcggacaaggggttttgaacaaaattgctggcgttttagaccctggttggatagcacaatccattttcgtgtcagcacattgagttcgttaactaacgaaacacaggacctcactgacgatcggggtgaggatagaccgaacacacccctagtggtcgcataggctggtccctggcatgatcaaaatggtgacgcacagggtctcgacgttaacgttcgggctcaccaaagcgcagatgtactatctgcacgggtggcgctttggcatgttctactgttcagtccagatgctagtccatgggagcagtggactgtattccaccgagtatgcgcccccgttggggccgtcattggcggaagcgcatgaggatgcgtcttggtc

SEQ ID NO: 16417 - DNA, 431 bp, Zea mays
  Clone ID: cC-zmpo148046c07a1
gaggtacttacaattgtttgaaaagtgaccaataacatacaaggtgacatgaccacaattgttggcagtgttgacacgagtgggctcacacaatacatatgttgcacgtagatcccgttctctaacaaacagagcacaggaccgcatttaccatgggggtataccgtgttccatcaagaggcttgatgtcggattgcatgctcctgagcatgttcaggatggagaggaacagggtcaggatgtcgaggtacagcccaaccgacgcccatatgtactcttcgtaggtgtggcgcttgatcaagttcttcgtgtcgtacaggatgaagcctgagaagaccagaggctctataccactgaacaagcccaccgacaccggtcccaatgggaagaaaacctgaagaaagcttgttaggacaaggatagttagcgcg

SEQ ID NO: 16418 - DNA, 241 bp, Zea mays
  Clone ID: cC-zmpo148046c07d1
ggtcgatcctcatcgcgtccggagctaaccgcgtatagcgcgtagattccgtatttcccgttccctgcaccgtatcgcaccgcaccctatcctcgtgggtgagtgagaaggcatcggaggcaggagttgcagtccctcgcgccgacggggtaccgccgcacgccggagttgttggtgatggcggtggcctcggaagaggacctgtatgccgtgaccgggtagacgctgtacccggggagct

SEQ ID NO: 16419 - DNA, 231 bp, Zea mays
  Clone ID: cC-zmpo148046c08a1
gaggtacttacaattgtttgaaaagtgaccaagaacatacaaggtgacatgaccacaattgctggcagtgttgacactagtgggctcacacaatacatatgtctcacgtcgatcgcgtcctctaacaaccaaagcacaggaccgtatttaccatgggggtataccgtgttcgatcaaaacgctagttgtcggattgcatgcttctgagcatgttcaggatggagaggaaca

SEQ ID NO: 16420 - DNA, 220 bp, Zea mays
  Clone ID: cC-zmpo148046c08d1
gtgcagaccgcgtatagcgcgtagaatacgaatccccccttccctgcaccgcaccgaaccgtacccaacccccgtgggagtgtgagaaggcatcggaggcaggtgatgcagtccctcgcgccgacagggttccgccgcacgccagagatgaaagagtcggtggaggccttggtggtggacccggaggccagaaccgggtagacgctgcacccggggatct

SEQ ID NO: 16421 - DNA, 98 bp, Zea mays
  Clone ID: cC-zmpo148046c09a1
ggaggtactgacactcgtttgaaaagtgcccaacatcagacaatgtggcatgaacccaattgtgggcgacattcacacgagtggtatgtcccaataca

SEQ ID NO: 16422 - DNA, 363 bp, Zea mays
  Clone ID: cC-zmpo148046c10a1
gtagaggaacttacaccagtaagaaaagtaaccaacaacctacagggtgacatgaacccaattgctggccgtgttgacactaatggactgtcccaatacatagggcccacgtagaacgcgctccactaacacacaaaatacattgatcttaatgacgcatgcgggtataccgagaccgatcaatacgctagatgtgggatagcatgcacccgagcatgatcaagatggagaggaacaggggcttgacggctgggttgagcctaaccgacacccatatgtactacgcgcgcgggtagcgcttgaccaccgaatgtgctgtcagtccagatgaaacactgaaaggaccagatgcggaaagaccac

SEQ ID NO: 16423 - DNA, 438 bp, Zea mays
  Clone ID: cC-zmpo148046c11a1
catcggagggactagtcactaatcccttacaacgagacacgcccttaattgcttggctgctggaggcacatagcccgccgcgccggatgaatcgaacgtcaattccggtctcttacaaacggacgtcaggagcgtattcacgcatcgggttataccgtggccgggcaagaggcttgaggggggaccttctggcccggctcactgttggggcggatagagaaggggccctagagcgcctggggagcgaacatcctccacatggcgccccaagagagcttgatgggtttacactgaatcgacaacttgtcctgggattgcatcagaacgacgtagccaatagacgacgcaaacttcgccaccacgggcgggtcagtggggttgaaacctttagataggtggaacacaatagtttaggcagcggggtacatgggacccgcc

SEQ ID NO: 16424 - DNA, 343 bp, Zea mays
  Clone ID: cC-zmpo148046c12a1
gtattatgtaacttgccaatccattacgtaacttttctctttcaaacaagctagaagcctcactctagctatgtgtggacatgaagaatatggagaaggagggtgacacgatgatgtgtggcgcctgcatcactggcgtcatgcgcttgatggcgcaaatgtatatcccggtccaatgcatgcatgtgtagtgcattgcttgggacccaaccaattttagtatagctagcataggccgctttaaagtatgtgcgggactagcgttaatcatttgggggggtaggcggggttggcgtttcaggtggcaaggatgacatcggccgagacggacttggggcctccc

SEQ ID NO: 16425 - DNA, 400 bp, Zea mays
  Clone ID: cC-zmpo148046d01a1
ggggaaaaccccccccgaacattttgggttccctttcctttctgaaaaaaaaatttgaaaaccagggaaaaaggatttgggggttaacggcaaccaatttggaaaaactgggggggggcggtgaaaacccgctattaaaaaaaaaacgccgacgccgaagtgctattacggagcgggggcgcatccccaaaccaaatgtttgagcaaacagggccaaatggggaacggaacctcctttagggaaacaaaggggttgggggggcccaagtttttcataatgcccaccttcctggggaaaaaaaacccgggggggtccctggtcagctgaaccaggataaaagccttgggggggatttccaacaaaaaaaactggaaaaaggtctccccgggggggtccttg

SEQ ID NO: 16426 - DNA, 660 bp, Zea mays
  Clone ID: cC-zmpo148046d01d1
gtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgcaacccgctcggctacctcaaggacgtgccgctgcccatctgcgcctcgctgctcaaacagttggactcggacgacgacgacgatcaggtatagcacatcgacgacgacgatcgatatgtaatagcacgtcgtcgacgaccgaccgcagtcgt

SEQ ID NO: 16427 - DNA, 311 bp, Zea mays
  Clone ID: cC-zmpo148046d02a1
gggcctcaatgttccgaccatgtattaaaatttgacggaaggcaaagattgtggacaacggttgcaggatgcaaagcaagaactggagccctcgatctcaagaaactaagcatggagatctaccggttgcatttgaacagccaacccatacaaaacgacatgtgccgggccggaaatcatctggtcagctgatcaattaagaaaggttgctattctttccttgccggtccttgaagggtgccgcccccgaacggcctcacgcgggcctacggttgcttaagaagcttgaacctgccgccctccttgaaggg

SEQ ID NO: 16428 - DNA, 638 bp, Zea mays
  Clone ID: cC-zmpo148046d02d1
acgcgtccggacgacacacgcgccgtacagccacatggcggacgacgccgtcgccgccggagcggccgtttgctgcgcagggccggcctcgctgtcttctagcaggaagcagcagcagcagcccgacgacgccggctgcggcagcagcagcagccacgaacactaccagcacgacgtgatcatgctgaggcggacgaggagcgggcgggcattcccggcgtcgatctccgtgatcggcaagggcgggcggccgtggctctgcctgcgggcgcaccgtgagggtggacgcctcgtgctgcggcagatgcgcctgccgtcggaggagctgctggagccctgcaaggaggaccgcaggttcaagctcctcatgcacccggaggcccgcgcgcggccgtgcgggggcggcacactgcaggaacggcaagggaatgatagctagcgctctttaattgatcagctgatcagatgatctgtcgccacgcacacgacagcttgtatggactggctgctacaatgcaaccggtagatctccctgcttagcttcttgaaatcgacggctccaagtcttgctttgcatcctgcaacccgagtccacaatctttgctttcgtaaatttaatacatggcagaacattgagc

SEQ ID NO: 16429 - DNA, 355 bp, Zea mays
  Clone ID: cC-zmpo148046d03a1
aataaaaccagaaatcaatcagtccctagatagacgtcgggggatctgtaaccggtagaaaatataatccaataggcttaccaagacagttcgctaaacgtgaagagcgtctgaccccgattaagctatcccgacaagcaattcaatatgtgcgcccatcttatgagacaaccgggacaaaccgagcaacagtgcaaacacagatctgtataggaggatgataatgttccccatcgggtcatggcagaagcccatccttgagagaagatgcgcttgaataatcagcccaaacccgtgatatctgagaccgccgggacattcatatgccacatgaattcctacctataagactggc

SEQ ID NO: 16430 - DNA, 493 bp, Zea mays
  Clone ID: cC-zmpo148046d03d1
tcgatcacgcgtccggccgggccgcggagaccatataatgttccaacggatcacgctctttatcgtttcaaacggtatccttgacatcctgcggatcggcgactacacagcgctctacgaatgcatcatccgcaactagaatcagttctaccgtctgagcaagcatggcaatggtcatagtctgtccatgatggccctcaggaaggggacgaccgatcacgagtgacatgtccaagtgctccgagggtatgagtcaacgagatgcacggggggacggttatgcaccgcgttcactaggcacctcatcgaccacgaccacgcgatgatgatgggcccgagccacgacataccttcaggacgccctgttgctcaacactctggcttacaacgagatcggcggctttcctgtgcagcacatgaccgcccgtcgcatccggtgcatttaccacgtgaacaaccactacgcgcactgcagcatgtgcgacattctcgg

SEQ ID NO: 16431 - DNA, 287 bp, Zea mays
  Clone ID: cC-zmpo148046d04a1
aaacggacaccattaacgccattaaccattatcggacgacctgtgaagaatacgaacggtagtgcaatagccacacttatgaacataactaaattggaacgagttgatgaacggagcattcgtacaagcaagagagaatcgcttattccgacactggtcaaagcgaaaccaaacaacccgataacatgtactttcaaagcattccgacgaagatgatgaagtgggccacggagttctgacagaagccaaaccttcaacgggcgccggcttttattgtgagctcaaac

SEQ ID NO: 16432 - DNA, 392 bp, Zea mays
  Clone ID: cC-zmpo148046d05a1
agttgtacgcacaccagttttagaagtaaccattatcggacaaggggtgttgaacacaatttttggcggttttccccctttttgaatgggaccatcaacttgcgggcccatcgaatgcaagctgctaaataacgaagcccatgagcttaatgacgatcggggtgaggattgaccaatcactacgcttgtggaggcataggcgtgcccctggcgtgcttaagatggggacggacaggcacacgacggtaatgcgcgggatcaccaaagcaacggagtgctgtcaggactggtggcgctttggcatcttctgtccagacgtccaggtgctactccatggggacccagaatgaaagacgctgattaagcgccctcgttggggccatctttgggtg

SEQ ID NO: 16433 - DNA, 155 bp, Zea mays
  Clone ID: cC-zmpo148046d05d1
cgcgtccggccatgcataataaaactgcctaccaatccaatatcatcttcccattttaacttcataccggatgctaccttccttggggagagggtagtcaattgaggatcctgatctcaccatcactacaactgccatgccatgaaccatataaa

SEQ ID NO: 16434 - DNA, 97 bp, Zea mays
  Clone ID: cC-zmpo148046d06a1
accaacatcatttttaaaagtatccatgaacggacaaggcgttatgaacacaattgctggcggtgttggccctgtgttggatagaacaatccattta

SEQ ID NO: 16435 - DNA, 164 bp, Zea mays
  Clone ID: cC-zmpo148046d06d1
gctccggcggacaagatatcctacgacaaacccaatcacacgtacctttttaatcttcttactgtaccctaacctccatggggagaggggtgtcaatagcggtttttaacccgtccctcatgctgatggcggagctatttacccctgaaaattcatgccactgc

SEQ ID NO: 16436 - DNA, 228 bp, Zea mays
  Clone ID: cC-zmpo148046d07a1
agaggtacggacatcggtatgaaaagtaaccattaagcgacaaggggttatgaacaaacttgctggcggtgtagacactggaattatctgtccatgcattgtgttcatgtagaaagagtctcttaacacacgaaacactggagcttactgacgaagcgggtatacataaaccgaacaaaacgatagatgtcgaataacatgctcccgggcatgttcagaatggagagg

SEQ ID NO: 16437 - DNA, 86 bp, Zea mays
  Clone ID: cC-zmpo148046d08a1
atttatttttttttagatgtacgagcaccggtatgaaaagtaccgactatgagagagtcgggtttgaacaaaattcctggcgctct

SEQ ID NO: 16438 - DNA, 290 bp, Zea mays
  Clone ID: cC-zmpo148046d10a1
gaaattgaacgacaacgattaattttagaaccgagtgagtattggacaaatttgaaacggatgcgtggaccacggttgtaacagctaaagctcaatcggggcgtggcctggcgcgccatcaagaccttaacaacagctgcttgcgcatggcgcgccgccgtctgtgccgtgtgtgaaccatccacaagactacggacagcctgacgccggcagagatgacgaccaggccgacgtagacgtcccggctgtactggtcgacgccggggcagttatagttggtgatggacgtg

SEQ ID NO: 16439 - DNA, 208 bp, Zea mays
  Clone ID: cC-zmpo148046d10d1
gcgacgcgttcgtaaccttcctcccagacgatgtacatcactagatcgacgccgtcgacgagaagctcaactcctgggcgggcggctagtccactctcctgccgtagaactccaggacgatcacaggagtgctgtacctcatggagcacgaactgtctgctgctgcaattgctatggctggcctatcaatactcggattctggctctc

SEQ ID NO: 16440 - DNA, 517 bp, Zea mays
  unsure at all n locations
  Clone ID: cC-zmpo148046d11a1
gaaattaaacgacaacgattaattttagaaccgagtgagtattgtacaaatttgaaacggatgcgtggaccacggttgtaacagctaaagctcaatcgtggcgtggcctggcgcgccatcaagatctcagtcacagctgcttgcgcatggcgcgccgccgtcggtgccgtgtgtgaaccatccagaagacgacggacagcatgacgccggcagagatgacgaccaggccgacgtagacgtcccggctgtactgctcgaggccggggcagttatagttggtgatggacgtgaatgtctctcgcacgaaggagcagtcctgcagctgcaccaggaacgggctgaactcgtagagccccttgctgacgctcgtcgccgccgtcatctggccgtacgccgcgggcgtcacgcgccccggcgtggcgcacagctccgaccccggcggccccgtggtctggcactcgaaccgcttncactcccgcgccgngctgncgaagtcgacctcgccgggcgcgcaccg

SEQ ID NO: 16441 - DNA, 406 bp, Zea mays
  Clone ID: cC-zmpo148046d11d1
gccacgcgtccgagatcttcctcccggccgatgtccagcagaagatcgacgtcttcgaggagaagctcaactcctgcgcgggcgtcttctccactcgcctgcaagtgaactccaggatgatcaagggagtgctgaaccacatggagctcgaactgtttgctgttgctgctgttatggctggcctatcaatactcggattcttgttctccgtactggggttgcggtttcttgtctccctactggagatcgctgctaggatccttctgaccaataccatcatcagttctggtcttttcctcctcttgcacaacgcggaggcggacacgtgcgtcgcgatgggcgatagggtggcgcacccgctagcgcacacggagctggacgacatcctaccgtgcgtggacgtggc

SEQ ID NO: 16442 - DNA, 507 bp, Zea mays
  Clone ID: cC-zmpo148046d12a1
attatataacttgtcaatccatttcttaacttttctctgttaaacaacagagaagtctcactctagctatatatggagatgaagaagatggagaaggaggatgacaccatcattgttggcgccagcatcactgtcgtaatagggtagtggtagcaaatagatatcacggtccaatgcatgcatgtgtaatgcattgcttgggatccaaccaattctagtatagctagcataggccggcttaaagtattgtcagcactaaagttaattatttggcggtgtaggcggtgttggccttccagttggcagggatgacatcgtcgtagacggacttggtgcctccctcggtagtgaggcggacggtgaggggtcccttaagcggtttgtcgctgtccttcctccagatggcgccccaggagtgctttaggggctcgtacgtgtcagagcccttctccttgacgtccactgccacaatgtcaccgtcgccatcgacgtacttgaccagcagcg

SEQ ID NO: 16443 - DNA, 391 bp, Zea mays
  Clone ID: cC-zmpo148046d12d1
gtcgatcccacgcgtccggaatccaagacataacatggctgtgaatgtgtgaaccatgtggtcgtcgatgcgggcacaggtagcgatggttgaggcgttggtgttctaggtgagcggctcatggtgcggtcctcccaaagtcccccctggcatgtacatcacggtcacctatggcaaggtctggctggacgctaaagcgacatggtatggcatgccgacgggtgccggtcccgacgataacggtggcggctgcgggtacaaggacgtgaacaagccccccttcaatagcatgggcgcatgcggcaacatccccatcttcaaggatggtccgcgttgagggtcctgcttagtgatcaagtgcgtttagcctgaggtgagctccggcaagccc

SEQ ID NO: 16444 - DNA, 429 bp, Zea mays
  Clone ID: cC-zmpo148046e01a1
ctcaagattgtacactgtactgtatactctgtatcagctgatgtgcacatgccaaaccctgtctgccaaataatcctctccgaaaacacaaacatgaggtgccgaataagatctacagtacatctcaagggacggtgcctacccatctaatttcccatttggcaagaaaaaaggcttctgaatcttgtcgaagcaaatcgagttccggccaataaagtgatctcccgccaattcgatctctcacgtcacgtgcagaggcaccaggtgcaccggcagaagctagggcaggagcaactgcagcaaccgcatcgccaccactggcaccggtaccaccaggagcaatcgaaccagcagcagccgcagcagcagcacccggtgtcgctgctccgccgctcctcctccgtcgtcatctccatgaaggccgacacg

SEQ ID NO: 16445 - DNA, 606 bp, Zea mays
  Clone ID: cC-zmpo148046e01d1
gccggacgactgggtgacgtggccggatccaccgcctccggccgtcgacgactcgttcgcgtcgtcggacggccgcggcgcggcgcggccggaggcgccgaaggtccagacggtctcgccgaccagcctcggagcggcggggtccaacaacgggtacgatccggggaggatcccggcgtccgtcttccagcacaggacgtcggtgtcgcaggccgactggagcatggcgtccaacgagtcgctcttcagcatccagggcgccagcgacctctaccccggcagcaggtcgcacttcgacttcttctacgacgaggccatggcggaggcggactccaggctgccgtcccttgcggagggggcggagcccggggacgcgcccgagtccaaggagttcgcggcggcgccgcgcagcgcggagcccgccgccagcaccgggtgcggcaacgacgccaagagagccgcagtgttccggagccacgagagcggctccggaagcagctccagcaacttctccttcgccttcccaatactggcggagacgtcgccgaggaagaaggacctcgtcaacaccgcgctgtaccagccgctggagaaggagtgcgaaca

SEQ ID NO: 16446 - DNA, 292 bp, Zea mays
  Clone ID: cC-zmpo148046e02a1
aatatgggcctcagtgctgcgaccatggattaaaatgtggcggaaggccaaaattgtggacgacggttgatggatgcaaagaacgaactggagccgtcgatctcaagaaactaagcagggagatctgccgggtgcattggaatatcctgtccatacaagacgacgtgtgcgtggcggcagatcatctgatcagctgatcaattgagagcgctagctatcattcccttgccgttcctgtagagtgccgccccaggacggccgtgcgcgggcctacggttgcatgaggagcttt

SEQ ID NO: 16447 - DNA, 630 bp, Zea mays
  Clone ID: cC-zmpo148046e02d1
gacgaccaccacgcgccgacacagccacatggcggacgacgccgtcgccgacggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgcgcgggcattcccgccggcgatctccgtgatcggcaagggcgggcggtcgaggctctgcctgcgggcgcaccgcgagggtggacgcctcgtgctgcggcagatgcgcctgcacgaggaggagctggtggagccctgcaaggaggacggcatgttcaagctcctcatgcacccggaggcccgcgcgcggacgtgctgcggcggtacactgcaggaacggcaagggaatgatagctagcgctcttaattgatcagctgatcagatgatctgccgccacgcacacgatagcttgtatgggctggctgctacaatgcaaccggtagatcttcctgattagtttctagagatcgagggctacaggtcttggcttgcatcctgcaaccgcagtcacaatctttgcctccgacaaactaatacatggcgcgacatggagc

SEQ ID NO: 16448 - DNA, 523 bp, Zea mays
  Clone ID: cC-zmpo148046e03a1
ataaccacaaaccaaacaggccctaaattttcttcgagtcattttttaccgggagcgaatttaatccactctaattcccttctaaattggtctaacctaaaaagcgtgattcatcagtcaagcaatcgtcgcatatagtacaagatgtactaataatatattacacacacgtacatatatgccgcccatccaaatccgatgtatataggaagaggagtatgtgcccgaccgggccgctgtatactagcacggctggccgacgatgcacttgaatggtccggcgaagcgcgtgagctgaccgacgtaccggccgtgcttggccggcatgaagtcgaacctgtcgtacttgcgctcgttctggccgccggactcgttgaagaaggcgccgttcatcatgacgtcgccctgcgactttcacacccactccttgtagtccttgtacggcgtgtactaccgcttggtcacctccttggcgttggggtccttccggggcgatgaagcagttgccctggctgatgatggt

SEQ ID NO: 16449 - DNA, 590 bp, Zea mays
  Clone ID: cC-zmpo148046e03d1
ggcggggcgcgcaggtgcacataatgttcgcgcagatcacgctgcataacgtgcagaacgtgatcctgcacaacgctgcgcgatccacgactccaaggcgcactcgggcggcatgatccgcgactcgaagcggcactacgggctgcgcacgcggagcgacggcgacggcgtatccgtgctgtcgtccagcaacgtgtggatcgaccacgtgtgcatgtccagctgctccgacgggctgatcgacgtggtgaacgggtcgacggccatgaccgtgtccaacagccacttcaccgaccacgaccacgtgatgctgttcggcgccagcaacgacagcccgcaggacgcggggatgcacgtcacggtggcgttcaaccacttcggccgcgggctggtgcagcggatgccgcgctgccgctacggcttcttccacgtggtgaacaacgactacacgcactggatcatgtacgccatcggcggcaacatgaaccccaccatcatcagccagggcaaccgatttatcgcccccgacgaccccaacgccgaggaggtgaccaagcgggagtacacgccgtacaaggactacaaggagt

SEQ ID NO: 16450 - DNA, 160 bp, Zea mays
  Clone ID: cC-zmpo148046e04a1
agaaaaacggacaccattctgtacagaaaggattatgggacaacgtattacgaacacagaagctagcccagtacacacacctagaaaattgcaataagtgaggaggcaacggacggcgatctagacatcacgagatactagaccacatttacgcagtagg

SEQ ID NO: 16451 - DNA, 174 bp, Zea mays
  Clone ID: cC-zmpo148046e04d1
ggggagcatcccaagcgcacctgatgtccccggcacgctttctgcttaacgcgccgaacgtgatgctacccatgctggggatacacgactccacagcgcactctgaacacaccatctgccacacggggcagcactccaccctggagactcatttgcaacgcggacgctgttacc

SEQ ID NO: 16452 - DNA, 299 bp, Zea mays
  Clone ID: cC-zmpo148046e05a1
agaattacggacaccattcttaaaagtaaggattaagggacaaggtattacgaacaaagttgctggctgtgtacgcacgggtagaatatggcaatgcattaggttccagtggagggagcctcagacctaacgaaagacaagagctcatttgccaagggggtaatcataaaccgaacaaaacgatagatgacgaataacatgaagccaagcgtgattaaaaatgcgacggacggggtcaggaagttttcgtacgggtcaacctaaatgcacgtgatctatacggatgggtggcggttgat

SEQ ID NO: 16453 - DNA, 173 bp, Zea mays
  Clone ID: cC-zmpo148046e05d1
gtggaacacgccaagcgtacgtaaaataccaagcacacgtttctctttcaatcaccgaaacggatactaacgacgggggggagtgataagacaaaagcggacactaatcagaccctctcaccgacgagggagccatccaccctataaaataatgtcaatgcggatgctgctat

SEQ ID NO: 16454 - DNA, 327 bp, Zea mays
  Clone ID: cC-zmpo148046e06a1
agagttacgggcaccgttgttaggattatggattaagggacatggctttgctaacaaagttgctggctgtgttcgctcggctaagataggtccatgcatgattttccagtggcatgagcctcagacaaaacgaaggcctggggctcacttgcttgcggggtgatgataaaccgaacaaaccgatagatgtcgaataacatgaagggaggagggattaaaatagcgtcggacgggtgctgaaatatgggcaacgtgttaacttaatcctacgtgatctatatgcatgggtggttgttgttcacttcaatcctagctggcctgttgttt

SEQ ID NO: 16455 - DNA, 380 bp, Zea mays
  Clone ID: cC-zmpo148046e06d1
gtgggagatggcaagcgttcgtgcaataccaaacaggcgttccggttcaatgatcttaacggacactaacgacgtgggggggggatgagacaagaccggacacttaatagaccttctcacggacgacggagccatctaccatagaaaatgctgtaactgcgaacgcttctaaagtgtactctctaggtgcaattccttctacatggaacgtgagctgtactgcacgagacagtttgagccatcatttggacggagaccgtaaggcttattcaagaacttaaacgccaggtggatctttatcagacaagtgatgaactgtcaatgggcatccacgcaaagctgtcaaagtgcatttttttggtatccatgataccgtgcgc

SEQ ID NO: 16456 - DNA, 279 bp, Zea mays
  Clone ID: cC-zmpo148046e07a1
agagttacggacaccggttttaggattatcgattaagggacatggttttttgaacaaagttgctggccttcttcgctcgggtggtataggcccatgcattgtgttccgttggaacgagccccataacacacgaaagccaggagctcattggccaagcgggtaaacataaatcgagcaaaacgctagatgtcgaattacatagatgggagcgtgattaaaatggcgtcgtacggggtcatgaatttttcgtacgggttaacctaagcccatttggtctat

SEQ ID NO: 16457 - DNA, 205 bp, Zea mays
  Clone ID: cC-zmpo148046e08a1
agacttacgggcaccggtattagaagtaacggataagggacatggtgatacgaacagagttcctggccttctgcccccagctcagatatggccatcaaatgtgcgcagacgtaccgagcccaagaccaaacgaaagtttgtgccttacttggcacggccgtagaacaaatccgaccacaacgggtgatgtagcatgacgaggaac

SEQ ID NO: 16458 - DNA, 96 bp, Zea mays
  Clone ID: cC-zmpo148046e09a1
acaaaagccattaatattaaaaccgatggtgggatgtcaatatttgaactgagtgcctgaacccctgcagaaggattacatatactaatatgtgga

SEQ ID NO: 16459 - DNA, 433 bp, Zea mays
  Clone ID: cC-zmpo148046e10a1
gaaattaaacgacaaccattaattttagaaccgagtgagggttgtacaaatttgaaacggatgcgtggaccactgttgtaacatttaatgctgaattggggcgtggcctggtgcgccatgaacacatcaaccacagctgcttgcgcatggtgcgccgccgtcagtgccgagtgcgaaccatccaaaagacgacggacagcatgacgccgggagagatgacgactaggccgacgtagacgtcccggctgtactgctcgaggccggagcagttatagttggtgatggacgtgagtgtctctcgcacgaaggagcagtcctgcagctgcaccaggaacgggctgaactcgtaaagccacttgctgacgctcgtcgccaccgtcatatggccgtacaccgcgtgcgtcacgctccccggcgtggcgcacagctccga

SEQ ID NO: 16460 - DNA, 502 bp, Zea mays
  Clone ID: cC-zmpo148046e11a1
aaccgctcaaatcacaagatactttgactattattctcgaaaacaagaaatacataaatatcgtatcttacttcatgcaaggaaaacatgtggtgaaagacaaatcagaacaacgattcacagtcatttcatagtatgataacaaatatcccaaaatacatgtgaatttggcagcttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggccgtccggcatgccgcgccccgcgcaagtgtcgtcccggcagttgtgcgtcttggtgcagatgacgcgggtgtcggaccagcagtcctcggaatggacgggcaggacacagcctgtgttgatgagaagcagcagaacgaggaggcctgaagccatc

SEQ ID NO: 16461 - DNA, 365 bp, Zea mays
  Clone ID: cC-zmpo148046e11d1
tgcatccatcgcgtgcgtacattaatctaagcgatcttcatcctgccttctgctctgctccctcgttgtggtagcgtctagcttggcgatggcttcaggcctcctcgttctgctgcttctcatctacactggctttgtcctgcccgtccattccgaggactgctgggccgacacccgcgtcatctgcaccaagacgcacaactgccgggacgacacttgcgcggagcgcggcatgcctgacggcctctgccactgggagtgccccaacctggagcccttctgccagtgcctgcgccccaactgccactagtcctggcgccttggattggctcacttcgcctgcgatgatggatggtgcccaactg

SEQ ID NO: 16462 - DNA, 438 bp, Zea mays
  Clone ID: cC-zmpo148046e12a1
gaaattaaacgacaacgattaattttagaaccgagtgagtattgaacaaatttgaaacggatgcgtggaccacggttgtaacagctaaagctcaatcggggcgtggcctggcgcgccatcaacatctcagtcacagctgcttgcgcatggcgcgccgccgtcggtgccgtgtgtgaaccatccaaaagacgacggacagcatgacgccggcagagatgacgaccaggccgacgtagacgttccagctgtactggtcgaggccggggcagttatagttggtgatggacgtgaatgtctctcgcacgaaggagcagtcctgcagatgcaccaggaacgggctgaactcgtagagccccttgctgacgctcgtcgccgccgtcatatggccgtacgccgcggtcgtcacgcgcccaggcgtggggcacagctccgaccccg

SEQ ID NO: 16463 - DNA, 427 bp, Zea mays
  unsure at all n locations
  Clone ID: cC-zmpo148046f01a1
ggttgtcatacttatacattaatcatcaaaagttgagccacatacatcagtatacacctcagatatgcgaggcaagaaacatcagttgccatgcatacagtaacgatcgacgaccaatgtataatgcatgtgtgtaatatatacacacacgcggcaccacacgctgaggcctggtacctgcacgcgcgtgcgacattgacattgcgcgcacatcgaccagagagatatgatcagccgcgacagccggtgatcgggttgcagccgcgggtgtagtcgttggcgggtttccctgggcgggaggcctcggggcccaggttcttgtcgcagttgcccagtaccttgcagctgatcaaattgtcaaatgacaccatcccctcggcgctgatggccccctgcggncctgtcgctaacaggaggcacagaacca

SEQ ID NO: 16464 - DNA, 542 bp, Zea mays
  Clone ID: cC-zmpo148046f01d1
ctagcttgctcctcgatccatcaattgcaagaggagcaagataccaccaccgtagcaccacacgcaggtacgaagaaggcgacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacacatgcattatacattggtcgtcgatcgttactgtatgcatggcaactgatgtttcttgcctcgcatatctgaggtgtatactgatgtatgtggctcaacttttgatgattaatgtataagtatgacaacc

SEQ ID NO: 16465 - DNA, 486 bp, Zea mays
  Clone ID: cC-zmpo148046f02a1
gaagcagggagaatcttcgccttcgttgctgcattacttttaaaactcgaattggttgtaatcagtcgtgccaccagatgcacgacacgaccatacaaaagaagaaaaagagcaagatccgtcgatactccctttctctccctagccttttcttaattcttcctattctttcttctggaggccggtgccggccggtcgtcttcaacctttgttgcacatatgtggtgcacgctcagccagctgctctgagaagaggtcgactgatctgtgctgaaacacatcttaactgtctaagtaatgcaagctgcctgacttgtcacctggcagtctaccttaagcaactcgtgctcaatctcctgcggtgctgcctaaaacaactatctgcagtgctccgtctgcttgagatcgtctcatcattctgcctcgcaaaaaaaatcgcagctgaatcaacgacgaggacggcgggcgggcggctggctagctctc

SEQ ID NO: 16466 - DNA, 604 bp, Zea mays
  unsure at all n locations
  Clone ID: cC-zmpo148046f02d1
cggacgcgtgggccttgacacagattcttcgctctccgttgtgcagcttctggaacacgctaacagttgtgcgtccgacaaccttcggaaggggcaggcatacaacaacatggggagcacctacgtggactgcaacatgctggatgaggctgccgagtgctacggcatagcgctgaacataaagcacacacgggcgcatcagggtctagctcgagtccatttcttgaaaaacaggaagaaggctgcgttcgaggagatgacgaagctcgtgcagatagctaccaacagcgcgtcggcgtatgaaaaacggtcagagtatggtgagcgcgacgctgcgaggagcgacctggacacggcgacgcttcttgatcctacaaggacgtatccttatagatacagagcagctgttttgatggatgagggcaaggaagaggaggcgatcgcggagctgtcgggagccatagctttcaagccggacctncagctgctccacctccgcgcggccttcttcgactccatgggcgacagcgagagcgccctgcgggactgcgaggccgcactctgcctggacccgacccacggtgacaccctggagctgtacagc

SEQ ID NO: 16467 - DNA, 496 bp, Zea mays
  Clone ID: cC-zmpo148046f03a1
gcctccgaaaatggcatgtatatttaacattttgcttgttttccactctttggaattcggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctagtagaattggacgttggaagtgtagacggcatcgggtctccagttcggcgggatgacgtctttggcgatgaccttcttgccggactcgctggtgaggcggatggagaaggggcccttgagcgccttggcagtgtccatcctccagatggcgccccaagagagcttcatgggcttccactcagccgacaacttgtcctggatttccatcagcacgatgtcgccgtcgtccgccacatacttcaccagcac

SEQ ID NO: 16468 - DNA, 604 bp, Zea mays
  Clone ID: cC-zmpo148046f03d1
atgtcgaataacacagttgagcgcgacgatgggatccctcgctaataacatcatggtcgtgggtgtcgaccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggaaagggctgcggctcatgctacgaggtgagaagcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtccagttcagaagggtgcgatgcacgtaccccgccgggcagaagatcgtgttccacatcgagaagggctgcaaccccaactacctggccgtgctggtgaagtatgtg

SEQ ID NO: 16469 - DNA, 439 bp, Zea mays
  Clone ID: cC-zmpo148046f04a1
agaaattaaacgacaacgattaattttagaaccgagtgagttttggacaaatttgaaacgggtgcgtggaccacgggtgtaacagctaaagctcaatcggggcgtggcctggcgcgccatcaagatctcagtcacagctgcttgcgcatggggcgccgccgtcggtgccgtgtgtgaaccatccaaaaaacgacggacagcatgacgccggcagagatgacgaccaggccgacgtaaacgtcccgggtgtactggtcgaggccggggcagttatagttggggatggacgtgaatgtctttcgcacgaaggagcagtcctgcagctgcaccaggaacgggctgaactcgtagagccccttggtgacgctcgtcgccgccgtcatttggccgtacgccgcgggcgttacgcgccccggcgtggggcacagattcgaccccg

SEQ ID NO: 16470 - DNA, 651 bp, Zea mays
  Clone ID: cC-zmpo148046f04d1
gatcaaccagatcttcctcccggccgatgtccagcagaagatcgacgtcgtcgaggagaagctcaactcctccgcgggcgtcttctccactcgcctgcaggagaactccaggaagatcaagggagtgctgaaccacatggagcacgaactgtttgctgttgcagctgttatggctggcctatcaatactcggattcttgttctccgtactggggttgcggtttcttgtctccctactggtgatcgctgcttggatccttctcaccaataccatcatcagttctggtcttttcctcctcttgcacaacgtggtggcggacacgtgcgtcgcgatgggcgattgggtggcgcacccgcaggcgcacacggcgctggacgacatcctcccgtgcgtggacgtggccacggcgaacgagtcgctgtaccggagccaggaggtgacgtcgcagctggtggcgctggtgaacaacgtcgtcgtcaacatctctaaccggaacttcccgccggggctccgcccgctctacttcaaccagtcggggccgctcatgcccgtgctctgcaacccgttcaacccggacatgagcccccgccggtgcgcgccccgcgaggtcgacttcgcagcgcggcgcgtgagtggaagcggttcgagtgc

SEQ ID NO: 16471 - DNA, 525 bp, Zea mays
  Clone ID: cC-zmpo148046f05a1
atagatgcaaaaacagcactcaccattcagaactatttgacatcccattgcagtgttcggagcatctcacggagggcctcgcctcttcatatgtgttttgtacaattgcgctcattcagaaggagctcccgtttacaagagattttggctgctaatgtggtaccagtaaaaaaaaaagcatacagtaccaagcaggtggtatcacccgaagaggtggtctatctgaatgtggcctcatgagggctacacagattctctgggtatcacttattcgtctgtttattatttgcgtcagattcagctttccacacgatatctttcagctccgatgagaagttcttgtagaagctgtggaactccaatgtgtctcctccggttttacgaagctcaaccatgtgaagtgatggggcaacctcaaaaacctcagttgcaacagataagtgaccttttctttcagatttgtcacccttcaatttcatcttgtaattctgtttccggacgttgaaaccgagtggcccacatgca

SEQ ID NO: 16472 - DNA, 585 bp, Zea mays
  Clone ID: cC-zmpo148046f05d1
gccgaggaagccaacgcagacccagcgatcctcgtcgcgcgtcctcctcccccacggagggaaggatggcggagcccaaagcggcggcggcggcgaggaagacgcgggtgggcccgtacgaggtcggcaagaccatcggcgagggcagcttcgccaaggtcaagcacgcgcgcgactcccgcaccggcgccgtccgcgccatcaaggtgctcgaccgcaaccacgtcctccgccacaggatggtcgagcagatcaagcgggagatttcgactatgaagctgatcaaacatcccaatgtggtacagctgcatgaggttatggcgagcaaaacgaagatatacatggttcttgaatttgttgatggaggcgagctattcgataagatcgtcaattctggaaggctaggagaggatgaagctaggatatactttcatcaacttataaatgcagttgattattgccatagccgaggagtgtaccatagagacctgaagccagagaatttgcttctggattcaaatggagctcttaaagtttcagacttcggcctaagtgcatttgcaccacaaacaaatgaggatgggc

SEQ ID NO: 16473 - DNA, 416 bp, Zea mays
  Clone ID: cC-zmpo148046f06a1
aaacgatgcaaaagcagcacttgccattaagaactgatggacatcccggcgcagagcatgatgcctcatacggagggaccagactgaaaatgagggagaggaacaacagatcacagatgaccagaccttatgatggctagagagtttgaatgatcatgggtctcactttaataaaatatcttgcagcacctgccatggggccgacgcgctagagcttagttattggagtgatggctcatgagggcatcgcccaatctttgcttaacaccctgtggaccatgtgcacttgccggaccattaggttcatccgcaagagcgttaacatccgaggagaaggcatcggcggaggtggcatactccgactttgcctctgccgtcggacgaacatccatcgtgacaaatgaaggagcaacctc

SEQ ID NO: 16474 - DNA, 394 bp, Zea mays
  Clone ID: cC-zmpo148046f06d1
gcggaagacaccatccccatcgctccaactctcgtcgcgtttactgttgctgcactgctgtaaggatggatgggcgcggggccgatgcgctaggcaaaaacacctgatgccccctgcgccagggcccccggaccatctgctgacgcacctgccgctgggcctagcgcacccgcgagtgcacctccggcgcagggcgtaccatgactgtgctgcactgaggacacctactatgactcaagacgctcgagcacatcacgcgggacactttgactatgaagcagaacatacatcgacaatgtgagacagctgcgtgaagaaccagcgatccatactaatatgtgcacattcctggtatgtgctggctgaggctatctatctgattggatgattacta

SEQ ID NO: 16475 - DNA, 458 bp, Zea mays
  Clone ID: cC-zmpo148046f07a1
gaaaaaaatgcctccaaaaatggcatgtatatataaccttttgcttgttttccactctttggaattcgatcatgaacccgaacaaaaggattacatatactagaatttggaagtctcagtacaatataaggttagcggtgcatgctgccaacttaattagcttgctgctgaaggtccatagcccgctgtgccggatgaatcgaagggaattcaaagtctattagaattggacgttggaagtgtagacggcatcgggtctccagttcgccgggatgacgtctttggcgatgaccttcttgccggactcgctggtgaggcggatggagaaagggcccttgatcgccttggcagtgtccatcctccagatggcgccccaagagagcttcatgggctgtcactcagacgacaacttgtcctggattttcatcagcacgatgtcgcccgcgtacgccacatac

SEQ ID NO: 16476 - DNA, 346 bp, Zea mays
  Clone ID: cC-zmpo148046f07d1
agaactactagcctatcgctccctaccacttggacttgagcggctaggccttcggctccctggcaaagcccgggctcaacgacaagattcgtcactgcggcatcttggacgtcgtgttcagaagggtgcgaagcatgtaccccggcgggcagaagatcgcgttccacatcgagatgggctgcaaccccaactacctggccgagctggtgatgtatgtggcggacgacggcgacatcgagctgatggaaatccaggacatggtgtcggctgagtggaagcccatgaagctctcttggggcgccatctggaggatggacactgccaaggcgctcaaaggccccttctc

SEQ ID NO: 16477 - DNA, 286 bp, Zea mays
  Clone ID: cC-zmpo148046f08a1
ggcgagatctgatctttctcatttggcgaaaagcaatgttgtttgatgtggcacatcagaaacccataccataccatacaaaaaatttgccgagaatcatgggtaagtacatagtccggactcagggaaagacctaatttctgcacggtgacatggccagcgaagttgtatcaccacttattagaaggcttacagcaatgcgcagatgacaagcagtaagctcgctgcgattttttgagattgtggggcttgaggctacatttgctgaaagggcatctgcagatgt

SEQ ID NO: 16478 - DNA, 532 bp, Zea mays
  Clone ID: cC-zmpo148046f10a1
aatcacgtactgcacaccctttattgaatcatcatttacggccaaagtttcccatcgctcgtgatcagtacacgcacacggtataacgaatccaatgggatcaataggatcacacacgacgtgggaataaaagaaaaggaccccaaaaaagtttacacattcagataatgttacaagtgtaagatcaaacagcacgaaaaaccacaaaaaaaaggggagacgatatatcagaaggccgctcccgctccagctcgtctcatgaagctttcttcgtcttggcaatgctcaggaggtcaccgaaaagcttgtcttcgggcttcgtcggcttcataggttgccccgtggagggtggcgccgtcgtagtctggtaagacgacctcatccccatggacgagttgtcctgcaccgagaggccatacatgctctgtgacagcccgttcgcaccggggtagccatacatcccctggttgttgtagtagtgtgcggcagccacagcaggatgctgcatgtaacccgccaatcgaccaccata

SEQ ID NO: 16479 - DNA, 403 bp, Zea mays
  Clone ID: cC-zmpo148046f10d1
gcacgcgtccgcacaatgcctgccaatgtattgtaaccaacctttgcatcccggtcaggttgccgccgcaacacagttgcagtctggcttcggtaacctgcagttcggttcgctaccaccaacttccatgctgggcatgcaattcggaggcatgcagcctccgcagatgtatggcggttcgcagcctggcatgatgtacccgcaacatatggctgtggcccagtatggtgcaatgccgcggctgctgccgacgtatggaggtcgataggcgggttacatgctgcatcctgctgaggctgccgcacactactacagcaacctggggatgtatggctaccccggtgcgaacgggctgtcactgtgcatgtatggcctctcggtgctggactactcgtccatgggg

SEQ ID NO: 16480 - DNA, 470 bp, Zea mays
  Clone ID: cC-zmpo148046f11a1
gaaaaaaatgcctccaaaaatggcatgtatatttaaccttttgcttgttttccactctttggaattcgatcatgaacccgaacaaaaggattacatatactagaatttggaagtctcagtagtatataaggttagcggggcatgctgccaacttaattagcttgctgctgaaggtccatagcccgctgtgccggatgaatcgaagggaattcaaagtctagtaaaattggacgttggaagtgtaaacggcatcgggtctccagttcgccgggatgacgtctttggcgatgaccttcttgccggactcgctggtgaggcggatggagaaggggcccttgagcgccttggcagtgtccatcctccagatggcgccccaagagagcttcatgggcttccactcagccgacaacttgtcctggatttccatcagcacgatgtcgccgtcgtccgccacatactttaccagcacg

SEQ ID NO: 16481 - DNA, 464 bp, Zea mays
  Clone ID: cC-zmpo148046f11d1
cgattaacacaggtgagcgcgacgatgggatccctcgctaataacatcatggtcgtgggcgccgtccttgcggcgctcgtcgccggcgggtcgtgcgggcccccgaaggagccacccggccccaacatcaccaccaactacaacggcaagaggctcaccgcttgggccacctggtacggtcagcccaacggtgccggcgctcctgacaacggcggagcgtgcgggatcaagaacgtgaacctgccaccctacagcggcatgacggcgtgcggcaacgtccccatcttcaaggacggcaagggctgcggctcatgctacgaggagagatgcatggaaaaacctgagagctcgggcaatccagtcacggcgtacatcactgacatgaactacgagcctatcgctccctaccacttcgacttgagcggcaaagccttcagctccctggcaaagccctggctcaacga

SEQ ID NO: 16482 - DNA, 566 bp, Zea mays
  Clone ID: cC-zmpo148046f12a1
ggtaagaacagcctactccagattacaagcgagacattatcaagtatgtcaagaatgaaataaaaaacaaggttaacagttcatgtctcgattcaggacaaacacctggcgagaggctgtggtagtcatcatctcttgtatgttgcagagttacacgacctgccttcggaatcgttcagaccaaacacgttttagcagcttaatgggaaatcctttcacaaattagcaactactacctattgtgaatgtgctgctattttttttggtggtgtagataccggaagatcataggatgtacggtaccgaaggccatttccaacagtattcaatacagggcagagccagcaaaatatgttaggcccaagaactgaaataagattctcatagacaccaaggtcatatggatgatgatagagatctccacctttttctgccaaccacatcgctctaactccttcatggtaaatggatgttcgagaagaatcgctgcctggctgctcatctttaggaacactgtgcaaaacgctccctattaatcattactccgatcccgaaggccacacaat

SEQ ID NO: 16483 - DNA, 348 bp, Zea mays
  unsure at all n locations
  Clone ID: cC-zmpo148046f12d1
cggacgcgtgggttccggtcctatagagtaggccttcggcatcggagtaatgatttatagggtgcgttttgcactgtgttcctaaagatgtgcagccaggcagcgattcttctcgtacagtcggttgccaagtaggtgttggtncgttgaggtaggcagtaataggagtagatctctatcatcatccatatgaccttggtgtgtatgtgtatcttatttctgttcttgggcctaacatattgtgctggctctgccctgtattgaatactgttggtaatggccttcggtaccgtacatcctatgatcttccggtatctacaccaccaaaaaatattgcagcacattcac

SEQ ID NO: 16484 - DNA, 468 bp, Zea mays
  unsure at all n locations
  Clone ID: cC-zmpo148046g03a1
atcgcatccggtgttcctttgcaagttttgactgaatttgtaaatgcagttctaatatcccaactaattcgaaacgattttctgtccgcagcaggcgtacaagcaagcgtttctcccttttgccgacactagtcagtgccaagcgcggggcccgatcacatgtccttgcagagcctgcggctgaggctgctgaagttggccctggagtactggcgggagccgttcctccagtcggtgccggacttcatcatgagctcgaactcctggtagctgatccggccgtcccggtcggtgtcgacgtcgcggatgatgtcgaggatggcctggtcgttggggcccaactcatcccgcagctcctcgggctcgatgaagccgctgccgtccttgtcgaagtacctgaacgccgacgccaggtactcgtcgttgctcatcttcttgaggtgcanggacaccgtcacgaactcgtcg

SEQ ID NO: 16485 - DNA, 638 bp, Zea mays
  unsure at all n locations
  Clone ID: cC-zmpo148046g03d1
ggagccatggccgagagtgtccgccaacgccaaggacctcatccggcggatgctcgacccaaacccctccacgcgcctcacggcgaggcaggtgcttgagcacccgtggctgaagaacgcggacacggcgccgaacgtgtcgctgggcgaagccgtgcgcgcccggctgcagcagttctccgccatgaacaagttcaagaagaaggcgctgggcgtggtggcgcggaacctgccggtggaggagctggacaagtacgtgcagatgttccacctcatggacaaggaccacaacggcaacctcacgctggaggagctcatggacggcctccacatcaacggccagcccgtgccggagtcggagatcaggatgctgctcgaggccgccgacacggacggcaacggcaccctggactgcgacgagttcgtgacggtgtccctgcacctcaagaagatgagcaacgacgagtacctggcgtcggcgttcaggtacttcgacaaggacggcagcggcttcatcgagcccgaggagctgcgggatgagctgggccccaacgaccaggccatcctcgacatcatncgcgacgtcgacaccgaccgggacggncggatcagctaccaggagttcgagctcatgatga

SEQ ID NO: 16486 - DNA, 452 bp, Zea mays
  Clone ID: cC-zmpo148046g04a1
atcgcatccggtgttcctttgcaagttttgactgaatttgtaaatgcagttctaatatcccaactaattcgaaacgattttctgtccgcagcaggcgtacaagcaagcgtttctcccttttgccgacactagtcagtgccaagcgcggggcccgatcacatgtccttgcagagcctgcggctgaggctgctgaagttggccctggagtactggcgggagccgttcctccagtcggtgccggacttcatcatgagctcgaactcctggtagctgatccggccgtcccggtcggtgtcgacgtcccggatgatgtcgaggatggcctggtccttggggcccagctcatcccgcagctccttgggctcgatgaagccgctgccgtccttgtcgaagtacctgaacgccgacgccaggtactcgtccgtgctcatcttcttgaggtgcagggacac

SEQ ID NO: 16487 - DNA, 640 bp, Zea mays
  unsure at all n locations
  Clone ID: cC-zmpo148046g04d1
ggagccatggccgagagtgtccgccaacgccaaggacctcatccggcggatgctcgacccaaacccctccacgcgcctgacggcgaggcaggtgcttgagcacccgtggctgaagaacgcggacacggcgccgaacgtgtcgctgggcgaggccgtgcgcgcccggctgcagcagttctccgccatgaacaagttcaagaagaaggcgctgggcgtggtggcgcggaacctgccggtggaggagctggacaagtacgtgcagatgttccacctcatggacaaggaccacaacggcaacctcacgctggaggagctcatggacggcctccacatcaacggccagcccgtgccggagtcggagatcaggatgctgctcgaggccgccgacacggacggcaacggcaccctggactgcgacgagttcgtgacggtgtccctgcacctcaagaagatgagcaacgacgagtacctggcgtcggcgttcaggtacttcgacaaggacggcagcggcttcatcgagcccgaggagctgcgggatgagctgggccccaacgaccaggccatcctcgacatcatccgcgacgtcgacaccgaccgggacggncggatcagctaccaggagttcgagctcatgatgaag

SEQ ID NO: 16488 - DNA, 508 bp, Zea mays
  Clone ID: cC-zmpo148046g05a1
atacgcgatggttaaattgaattgttgaactggtccagacaaatggcaagcaatggtacaggtgtcgatccctctctcgagggaaagaacaaataacggggcaccaaattaaactggtacatcagcgataccaattagttaaatgaaaatcagaaagaggaaaggaaaaaaacaaacaaaaggaagacgaaggtgtgccactgccgtgcccaatcagagcacacccacccacgcatcgggaatgcgcgggagcagcagagcagcgcagcgcagccaagtctctcccccccttggtctcttccctccggcagtccggctcctcgtccggcggctcagtgaatgtagtacgcgaagaaggaggccacggcggccccgacgatggcgggtgcgaccgcggaggagccgctggtgggggacggagccggcgcctccgcggccagcgccacggtggccgaggcggcgactaggacggcgcaggcgatcttcttcatctccatccctggatgcg

SEQ ID NO: 16489 - DNA, 593 bp, Zea mays
  Clone ID: cC-zmpo148046g05d1
gcaggcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtcccccaccagcggctcctccgcggtcgcacccgccatcgtcggggccgccgtggcctccttcttcgcgtactacattcactgagccgccggacgaggagccggactgccggagggaagagaccaagggggggagagacttggctgcgctgcgctgctctgctgctcccgcgcattcccgatgcgtgggtgggtgtgctctgattgggcacggcagtggcacaccttcgccttccttatgtttgcttgtttcctttcctctttctgattttcatttaactaattggtatcgctgatgtaccagtttaatttggtgccccgctatttgttctttccctcgagagagggatcgacacctgtaccattgcttgccattggtctggaccagttcaacaattcaatttaaccatcgcgtatt

SEQ ID NO: 16490 - DNA, 470 bp, Zea mays
  unsure at all n locations
  Clone ID: cC-zmpo148046g06a1
atacgcgatggttaaattgaattgttgaactggtccagacaaatggcaagcaatggtacaggtgtccatccctctctcgagggaaagaacaaataacggggcaccaaattaaactggtacatcagcgataccaattagttaaatgaaaatcaganagaggaaaggaaaaaaacaaacaaaaggaagacgaaggtgtgccactgccgtgcccaatcagagcacacccacccacgcatcgggaatgcgcgggagcagcagagcagcgcagcgcagccaagtctctcccccccttggtctcttccctccggcagtccggctcctcgtccggcggctcagtgaatgtagtacgcgaagaaggaggccacggcggccccgacgatggcgggtgcgaccgcggaggagccgctggtgggggacggagccggcgccttcgcggtcagcgccacggtggccgaggcggcgacgaggac

SEQ ID NO: 16491 - DNA, 252 bp, Zea mays
  Clone ID: cC-zmpo148046g07a1
caacaatggaaacgcgtgtcagtacttaggcaagaaaaaatgatcctcgtccagtacagtgtgccatgaatcaaaattcagcgttacaagatgtgtatacatgcatgcatgcttgatcgatccagcagtcgatcgtcggatcagtagtagtacgccggcagccagtccttgccgttgatgaagtcgatggtgaggtacttggccgcgtcgtcgggagagaacctccgcgaccatggcacgcggttcgtcacg

SEQ ID NO: 16492 - DNA, 81 bp, Zea mays
  Clone ID: cC-zmpo148046g08a1
ggcgagaactgatctttatcatttggcgaaaagcaatgtggtttgatgtggcacatcataaacccataccataccatacat

SEQ ID NO: 16493 - DNA, 343 bp, Zea mays
  Clone ID: cC-zmpo148046g09a1
agatgggcttgtgcctgggccaagccggcccacatgttatgttaagaacggggaatgggtgacagcagcaagtgaatcaagcactctgatacattttttattttccttttcttccttttctttccgtagatactgctatccatgccatgcgttcgctctgtatcgttgtagttttgtgcagcatgtccgcgacgccgccgtggtatagtttactggtcgtcgtcgtcgtccgagtccagctgcttgagcagcgcggcgcagacggggagcggcacgtccttgaagtagcctaacgggttggcggggcgcaagctgtcagagatgccaacgtttctggtgagca

SEQ ID NO: 16494 - DNA, 368 bp, Zea mays
  Clone ID: cC-zmpo148046g09d1
gtccctccctcacacatataataaggataggtcccgtccttttcttccgacatccacatggggggaggggaaaactcgtacattcacccggcggctatattggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgtgtacatcgcgggcgccaaggcgaggctggagtgcaagcacttcggcaccggcatgctcgagcgcgccatcgacggggtctccgacgcgaccggcacctacac

SEQ ID NO: 16495 - DNA, 437 bp, Zea mays
  Clone ID: cC-zmpo148046g10a1
agatgggcttgtgcctgggccaagccggcccacatgttatgttaagaacggggaatgggtgacagcagcaagtgaatcaagcactctgatacattttttattttccttttcttccttttctttccgtagatactgctatccatgccatgcgttcgctctgtatcgttgtagttttgtgcagcatgtccgcgacgccgccgtggtatagtttactggtcgtcgtcgtcgtccgagtccagctgcttgagcagcgcggcgcagacggggagcggcacgtccttgaagtagcctagcgggttggcggggcgcaggctgtcggagatgccaacgttcctggtgagcaggacgccggcgcggtccctgagcgcctggacctcgtcgcaatccttgcgcgggcttgccaccagcaccacctggcagatgtcctcctcgtggct

SEQ ID NO: 16496 - DNA, 294 bp, Zea mays
  Clone ID: cC-zmpo148046g10d1
gtccctccctcacacaaattataaggaatggtcccgcccttttcctccgacatccacaaggggggaggggattactggtacattcacccggcggcaataatggcctcggttccggctccggcgacgtcgaccgactgcgccatcctatgcctatgcgtcgttctatcctgtgccgcggctgacgacccgaacctccccgactacgtcatccagggccgcatgtactgctacacctgtcgcgccgggttcgagacctacgtcaccgagtacatcgcgggcgccaaggtgaggctg

SEQ ID NO: 16497 - DNA, 278 bp, Zea mays
  Clone ID: cC-zmpo148046g11a1
aaaaggtaatatcatatatattccatcacacgagggcagggcgacttgacgcgaacacatgaattttaaatagtaatgtctacgtaataataataattaaataacacaacccgttccatgcatgcatagatattcatatcagaccagtattactatatgggaacagcgttgcaagtgacgtcatgcatgcatgcatagatgttcaacagttcatgcatgccaatgccatgcgcgcgtccgttcgttcgttcgattagtgcaagtagtatgcgaggagg

SEQ ID NO: 16498 - DNA, 381 bp, Zea mays
  Clone ID: cC-zmpo148046h01a1
cgtaaacatgtaacccccgcttgtctctcatgatgaatgtaagccttttacagagtgggtatatactccaggataatcagggactgaagaactgaaatagacctgacacaggctaggcaggtgagctacctgcttcttttgttacatacagagaaatgcatgcatggcctgccccttcaattgtggagagatagagaagagagaacgaatcaatggacgcgatgcacgacagctgaggaggcattgccattattattataatagacctctccgtctttgctgatggggatatgatgggtgtgggacttgtccttattgaacctcatcttcccctttcagaggaccatctaccagatgtactcctgcatgagcacgttgccc

SEQ ID NO: 16499 - DNA, 456 bp, Zea mays
  Clone ID: cC-zmpo148046h01d1
gccacgcgtgcggtcgtgcctggtctttaggaagctgccgtggggatggcccggcatcttggtccacgtgctcatgcgggagttcatctgggagatcgaccacagaaaggggaagatgaggttcaggaaggacaagtgcatcacccatcattttcacagcagcgaaggcggtgaggtctataataataataatggcactgcctcctatactgtcgtgcatcgcgttaattaattcgttctctctcctctatctatacaaaattaatggaccagatcatgcatgcacttcgctgtatgtaacaaaagaagctggctggtcagctgccttgcctgtgttatgtttatttcactgcttcatttgctgattatctcggcgtatatacccactctgtatgaggattacatacataatgagagagcagcgggggttacatgtttaagaaaaagaagaacaat

SEQ ID NO: 16500 - DNA, 239 bp, Zea mays
  unsure at all n locations
  Clone ID: cC-zmpo148046h02a1
actgccaggaaaattctctagcatgatctcataaatcaacagcacggacagctacatcacagggcttaatggggggggggggggctnctccgccanncttctganctaacgccaaagcctccaacgtggggcctacgtaccgtaccccactcctggtacccattagcccaccccacaccctaccttcgctcgcagtcgcagcttccggtgtacgcacactactgggcggtgcacgcacc

SEQ ID NO: 16501 - DNA, 636 bp, Zea mays
  Clone ID: cC-zmpo148046h02d1
cgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacatccaaagttcatcactgataccaaggctgctatcgccgaaacttacaacctcacagattcagaatttctgaaagctgatagctgtcaaactcgagatgctggctcaactgcctcaacagctattattgtaggtgaccgtttgcttgttgcaaatgttggagattctagagccgttatttctaaaggaggacaggcgattgcggtttcaagggatcacaaacctgatcagacagatgagagacaaagaattgaggacgcagggggctttgttatgtgggctgggacatggcgagtgggtggtgttcttgctgtctctcgcgcatttggtgataaactcttgagcagtatgttgtcgctgaccctgaaatcaagaagaggtggtcgacagc

SEQ ID NO: 16502 - DNA, 420 bp, Zea mays
  Clone ID: cC-zmpo148046h04d1
cggacacgtgcgcgacctgacggcctacacaaacaatgcgatcagatccttgctgctactggtactcttttgcgtagggcatggtgataaggaagagtcaaagggcatgcatgctaaagcccacgcacctggggggtccttggacatcacataccctacgcgcctccggaattggcactacacacagcacgaaggttgagcaggaagcatgaccatccgcgggcgatggcactggcaagcagacaattctaatgccgaagggcgacttccttgttgaacaactcaacttcacatgcccttgcctgggcgacgtgactcatccacgaggatcgcaatctgctggccaccacaggcctactccaatgcaaggaccatgttaattggatcgagattctacgcgtggataacctgcttatgacc

SEQ ID NO: 16503 - DNA, 521 bp, Zea mays
  Clone ID: cC-zmpo148046h05a1
agcactgcaagacgtgttagtattcctcatagacaactgtacatacaccaagatttttggattttgaactctccgtccaacaaaagaactctccccatcagaagctcgctctctaactgactcatggccacgccgtaccacccgctagctctccgccgttctccatgaaccacccgccgtcggcgagctcccgctgacctggtcattactttcgccacttccactgttggccccgacggcgctcatgcgtgcctcgtacgcgtggccgaggttccttaaccggttgagctccggcagtacgacggttgcgaggtccggccggtccctccgccgcatctccgtgcacttgagcgcgagctttgcgtagccgagcgcctcctcgacgggccagtccttgacggtgatgtcgagcatctgcgcgaaggtgcccgcgtcgatggccttctcgacgtggtgcgtgagccccatgggtggccgcgcggtgaccacctgcagcaggagcacgccgagcgagtagatgt

SEQ ID NO: 16504 - DNA, 572 bp, Zea mays
  Clone ID: cC-zmpo148046h05d1
aattcaagaacgcggacgtgccgtcgaccctgatgaagtgcgcgccggactactgcaacatctacgtcgtggccaagggcaagtccgtcaatgtccggctcgccaagtgcggcgtcccgcccatgcacggtggcgccgacagcccttcggacaccgactccgtccgggaatccgggctgtacattcggcgtggctccaggggacacggacacctgccgccggtgatgcctgacgccaggcgctccatggacgggcgcagcaccctgccggagctcaccacgcgcccaccgttccgcgagcgctcgctcccgtcctcggccaccaagaacgtcgtcgtcctgccgggaaaggactactccgaggcgccctcccgctccgcgaggcacgactcgttcggcggcgacctcgacttcggcccgagcacgcgcttctcctccatggacttcggcgacaacctcgacctcaccgccagccccgctcgggagcccatgtcaccggccaccggcgcgcaacgggatattgaggtcgagatgcggcgcctccggctggaactcaagcagaccatggacatg

SEQ ID NO: 16505 - DNA, 580 bp, Zea mays
  Clone ID: cC-zmpo148046h06a1
aaacttcttgaattctttttttattttaatagttgaattatatactttagtacgcaaagtcagtactctagtttattaaaaatttcattcgtttatttattttgattagttcacacattttgcaaagaagtattttgtggttcttttagtttataatatgcacattgttttctaaaattatatataagcatatatttagtactattatctctttcagtcatgtgaaatttttttaaaacaatagcctaaagagtctactgtcttgtttgtccgggggcccttaaaatcatagatgcacaccagggaagcctagagctaccatgaagaagtaattaatgcaatatgtgcctttttttgcaatacatcccatcatttatctatcctataactccatactttcaaacagtcgcatggaaatataacccgcatgtgaaatctcctccactcggagaggggataagcatgcgaaagaaaaaaaatcatctccctcgttttgcttgctgtctcatgttaatcacgtcaagttgccaaactagctctacggaggagaaatgatagggagaaaagaatttaaaataga

SEQ ID NO: 16506 - DNA, 392 bp, Zea mays
  Clone ID: cC-zmpo148046h06d1
acgaagaggagattggtaaacagaaatggtttgccggttaaggtgctttgagtgtaaatgttgaccatgttggtcttgtgggatagccagcaatatcgcactcactccgactcaagtgttcgggactgtttggttgtcgtacgagaactttgtctatagcctatgcaactgattctatacgtccttttcgtctctgttagacaacatccaagtagtcacttcacgcgttacttcccttttttcgaaagaaatatggaaaactacaaaaaccgttgcggttattgtgttttttttttttgcgtgtgaccgatttaacgtgttcgttcgccgcgtttacgtttctaagtgctttgaatggtgttttcgccttttaggattgatttggtgacaag

SEQ ID NO: 16507 - DNA, 444 bp, Zea mays
  unsure at all n locations
  Clone ID: cC-zmpo148046h07a1
aatgaaaaccctgagctttcattagctcgtctatatatatatataagcaaaacatctcatcagtaaagagattagagattcgcgtctctcgcttttgcttcgtactcaaatagatatatcgtgtggcatgcgtcgctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccacctnnctccccatcttcgtgtacgagtagacgaccccgggaggagtccccccaggcgcgggccaggtagatctggccggcttgacgccgccgatgct

SEQ ID NO: 16508 - DNA, 247 bp, Zea mays
  Clone ID: cC-zmpo148046h07d1
gccacgcgtccgcccacgcgtccgggtaggtgcatagcttccgtggtccaccatggcgctgcgagcggaggcctcgaggacgtctaataagcccctcctgctcctcgccctggcgttcgtgctccttggtgcggcgccggccgcctggatcgcgcccggcggggcgttctgcaactgggtggcgatgaacctgcagagctacgcgctgtacgcgcagtagtccgcctgtgtcgggggctaggagccc

SEQ ID NO: 16509 - DNA, 436 bp, Zea mays
  Clone ID: cC-zmpo148046h09a1
actctcaagcatgccctttattcatcgaatcaacgagacaaaaaattaccgcaaatgcttatttgcgtgacgttacattaattgggctgctatatatgtgtatgaagcagtcgacgaaactatacatcgtcggtcatcaaattggtaggtatacccatgcatgcatgcatcaaatcgtcatcgcatcccatgcatgcatgtatgatgtatcagtgattcagtgtcacgcaagcaggcagaagacgacgaccggcgggcgtgctctgcgttcaggaaggaggaggggtgcaggacctcctgcagttctcgctgagcagaggctgcttctccttggcgcaggtggtgttgcaggccttggtgacctcagccgccttgaccacgtagtccttgtcgcacgcctcttggcacaccttcatctgcggcgcggtgatgccct

SEQ ID NO: 16510 - DNA, 384 bp, Zea mays
  Clone ID: cC-zmpo148046h09d1
gctcgacgctgagcgagggcaggaaggggatggacctggaggcgtgcatggagtcctgcgacctctcacagcgctgcaacctggcgctgcacggccgcatccagtgcaagggcacgtgcaccgagcagaagggcatcaccgagccgcagatgatggtgagccaagaggcgtgcgacaaggactacgtggtcaaggcggctgaggtcaccaaggcctgcaacaccacctgcgccaaggagaagcagcctctggtcagcgatgaactgcaggaggacctgcaccccttctccttcctgaacgcagagcacgcccgccggtcgtcgccttctgcctgcttgcgtgacactgaatcactgatacatcatacatgcattgcatgggatg

SEQ ID NO: 16511 - DNA, 446 bp, Zea mays
  Clone ID: cC-zmpo148046h10a1
agtgaataacaatctattgatccatataccaataccaagttacacggataagttcagtacgaaagcgaaagagacaataaacatcaaagttgaatcaggagacatgcatgtacatatacataaatataaagaacaatttttggctgagggacttattagatagacaggattatatatcatcatatacttaactcctacaatggttcgagacggcgtctcgatgtgtttacgcatgaatgcatttgcagctgaccatcgcctcttaatttccctggtcgcccgcccctttggttgattattattcctcggaagcggaaatgaaccggacgacgggacgacgagagaacaaacgagctagggggacaaagctagagaagaaggaaacgagagaagccgctgccctcacgctcctttaaattgtgtatacagcaccgcggacgcgtggg

SEQ ID NO: 16512 - DNA, 400 bp, Zea mays
  Clone ID: cC-zmpo148046h10d1
cccacgcgtccgcggagctgtatacacaatttaaaggtgcgtgagggctgcggcttctctcgtttccttcttctctagctttgtccccctagctcgtttgttctctcgtcgtcccgtcgtccggttcatttccgcttccgtggtataattatcaaccataggggcgggcgtccagggattttatgtggcgaaggtctgctgcaaatgcattcatgcgttaacacatcgagacgccgcctcgaaccattgcaggtgttacgtatatgatgatatataatcccgtctatctaataagtccctctgcctaaaattgttctttatatttatgtatacgtacatgcatgtctcctgattcaactttgatgtttattgtctctttcgctttcgtactgtacttatc

SEQ ID NO: 16513 - DNA, 384 bp, Zea mays
  Clone ID: cC-zmpo148046h11a1
gcaaagccaccgtaacagaataccagtcaaatataggtcattctaaacaacaacgctgcaacaagggcaggtctttttttccctggaagaagcagcaggcttggagcacgaaaaccagcatccagccatcatttatcaactttgagaatcgaaacatagcatgcgggcataacatctagagtgtgtgcttaattaaaaacagcggcaatggcaatggcaggcagcttcagcgcacacgcaccggcgccgtgacgaagagaacaacacgaggtgtactagaagataagctatcagaaatcaagaacggcacagtcctggtaaactccccgacatcagcagacacgcatcaggtcgggagatcggatccgtcttactggccctcgg

SEQ ID NO: 16514 - DNA, 247 bp, Zea mays
  Clone ID: cC-zmpo148046h11d1
gcctgttagtcggttccgatctcccgacctgatgcgtttctgctgtagtcggggtgttttccaggtctgtgccgttcttgatgtctgatagcttatcttctagtactcctcgtgtcgttctctttgtctctgcgcctgtgcagttgctctgatgctgcctgtcattgccattgccgttgtttcttattaagcactcactctagttgtgatgcccgcatgctatgtttcgattctctaagttgttatt

SEQ ID NO: 16515 - DNA, 58 bp, Zea mays
  Clone ID: cC-zmpo148046h12d1
cccacgcgtccgcccacgcgtccgttttaaaaaaatttaatttttttaatttatattt

SEQ ID NO: 16516 - DNA, 59 bp, Zea mays
  Clone ID: cC-zmpo148047a01a1
aagaaccagttcattacttcattttattggaaaatttcagtatcgggaaaaatattcca

SEQ ID NO: 16517 - DNA, 517 bp, Zea mays
  Clone ID: cC-zmpo148047a01d1
gagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggacatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgagcagtgcaacatggtggtggaaaggctgggcgactacctgcttgaacagggcatgtgactactacgtaccagctggaatgcatgtcgacgacgatggttttgag

SEQ ID NO: 16518 - DNA, 405 bp, Zea mays
  Clone ID: cC-zmpo148047a02d1
cttcttcttccctgacggcttacacctgactcgccggaaccgtttcaactgccatgtgctcgtgcactaccaagggcaggacgtttgaggggtatgcccctacttatgccgccgtattaactgttaggcgtgccgctggacggcatttcaatctgtggtgaggtctgcgactgttgaacacgtcgcttacatggtcacatgttgaggagcgcgaaagctaccgactacgttggtgatcaaacggcttatgaggtgggctctccttaggcgttcatagccgcgacatgacactcgggggattaaacggatgacataacctgcttgatggatgagaatccatggacgtgcgcgaatgcaaatgaaaatgctggctgtgctaccgagaccaagaggactgtgactgct

SEQ ID NO: 16519 - DNA, 382 bp, Zea mays
  Clone ID: cC-zmpo148047a03a1
gaagctcaaattagcatgttatagaatcatatatatgggctgccctacacgcgtgcctcttaacgagccgcttcatcccacggtctcatgacatgtgccacgccgcaagaggcaacaccgataagaaggacacgcgctaggtccgcatgaagtcgggatgcgtgctgcctatcgtgagacagacacacgcgaccagcatcaaattacatatgctttaggccggacgacgacgactacgacgacgacgacgttaccgaacgtagtagggggtcgggttatagaaactgtcaaatcaaaggacttgttcgtaagggatcatgtaggagagcgtgcggtagatctcggacatcttgatgagcgacctgtcgaggtcctccatggg

SEQ ID NO: 16520 - DNA, 551 bp, Zea mays
  Clone ID: cC-zmpo148047a03d1
gctagctagcgatggctggagcctgggcactgctcatcgtcctcgcggctgccgtcgcggtcctggccgcgcggccggcgtctgcaggcgggggagccgcggcggtggcggacatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctcttcaacatgatcccttacgaacat

SEQ ID NO: 16521 - DNA, 534 bp, Zea mays
  Clone ID: cC-zmpo148047a04d1
gtcatcgtcacgtcctcgctcgtccttctcttcctcttcttgttcaactacaactggtccgcctggctcctggggtgccgattctgcctggggagtctccagggtatggaattcgtggtatcttctctcgttggcagactatgccagcggtgtcgcgaggccaaagtgaagcttcctgctctaggaaacgtgaaggtggtcacgctagtggtcctgccgctggccttcatcttcgccggcacctgggctggacaccacgactcgccggttgcttggcttggtcagaacctcatgggcatatgcatgatgatactagtactgcgagtggtgcacatgccacatgtaaaagttgcgttggcgctccttgtctcggcctttttatacgacattttctgggtcttcatatcacccctcatattcaagaaaagcgtcatgatcacagctgctcgtggcagcgatgactggccgcgcctccgcatggtactcgatatgccgtaggagttcgattccgggaatgggtacgacatgattggg

SEQ ID NO: 16522 - DNA, 547 bp, Zea mays
  Clone ID: cC-zmpo148047a05d1
atcaatcagcacttgcacgcgcgcggtcggccgcaggtggaggaagaagatgggcctgtgctcgtgctgctggcggtgcctggagctgctgtgctcggtcctcctcccgcccctcggcgtctgcctccgccacggctgctgctccatggagttctggatcagtgtgctgctcaccatcctcggctacctccccggcgtcctctacgccgtgtacgtcatctgctccgtcgacccccaccgccaccgcgacaacgacgactacgtctacgtagcatgacaagatggaccggtccccgtggtgctctggtccgtgtctctgctgctacctccgtcctctgtgctgtgtgcatctttttgtttggtttagtaaactaaatccatcctgtggccttctgtaaactgtaaattcgtatgtcgaatctgacaatctggacggattcattccataaactaagatctggtgttgcgggatctgtggagttagttagggttactttgctacctcgttcagttgggctcgtgaaatgaaactgcagatggttattat

SEQ ID NO: 16523 - DNA, 462 bp, Zea mays
  Clone ID: cC-zmpo148047a06d1
gttattcattgcagccgtctcatacctgaccccaccatatagctacatcacagagggtatcgtgcgctgcaaaggtgaggacctttgagggatagtccccaactgtggcctcacggtgaacaaggaaccgtgccgagtgacgtgcatttcaacattcctggacggggagactcatgaacacgtaacgcagatggtcactgtaggtgcagccaaggacactacgagtctgctgtgacgagaactggcttcagtgaggggactctacttaggcttacacggccacgatatgaatctcggtggacgagagcgcttagaaaacctgcatcacgtgtcagactcactagacatgcactctatgccaatgactatgacggctgaggagttgagaccatgaccacggggattgatacaaggagggacgtacactgggcatgcagggagagatgagcgactgaaaggtga

SEQ ID NO: 16524 - DNA, 577 bp, Zea mays
  Clone ID: cC-zmpo148047a07d1
cccacgcgtccgcccacgcgtccgtgcgtgcctagcatgcatgcatgtgacgacctctcctcctcgctgtctctgtgtatctgcaactgcaagcaaggaaattaattaaaagaagatcggcgccatggcggcaacgacgacggggatgcagatgatgcaggtgcagcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaggcgccgccgccggcgtgtccgcgctcagagggttcaagctatcatcaccgacgacccgtggccgtggatgaattaattaaggccccatgcatcatgcatgcatgcctaagctaccttccatttctttgcttctacaatgcatgcatgcagatattaattaatcatcatcaatcagcatg

SEQ ID NO: 16525 - DNA, 549 bp, Zea mays
  Clone ID: cC-zmpo148047a08d1
ggcgcaaccaataatagcaagtgtgatcatccgttgatccatcttgctaataaccctgcgtgcccttcgttctcggctcgatcccgacgacgctcccttcggctccggcaaaccacatcaagtcgcgatggagatgaagaaggtcgcctgcgccgtcctcgacgacggcgcctccgccaccgtggtcctcgccgacgaggccccggcgcccgcccccaccagcgcctcctcggacgcgttcccggccgtcggcgccgtgctgggcgcctccgtgctctccttcttcgcctactacctgcggtaaaattaaaggagggtcggagggagatgctgctggctgccattgcctgtattcggatggagtccgcttatatatatatgtaagtactttaatttgggtctgaacatgtcgattgatccatgcattttatttgctttgccatttctcccctttctgatgatgtcgatatgtaaagaggggagaatgggagacactattcgtttggacatgacaatagggaattaatcaatacccatttgttaggtacc

SEQ ID NO: 16526 - DNA, 360 bp, Zea mays
  Clone ID: cC-zmpo148047a09d1
ggggaggggaaaacacgtgcattcacccggcggcaataatggcctcggttccggctccggcgacgacgaccgccggcgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccgagtgaggacatctgccaggtggtgctggtggc

SEQ ID NO: 16527 - DNA, 486 bp, Zea mays
  Clone ID: cC-zmpo148047a10d1
agcatccatcgcgtgcgtacattaatctaagcgatcttcatccatccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgtttgttaaggcataatatataaactgccaaattcacatgtattttgggatatttgttatcatactatgacatgactgtgaatcgctgttctgat

SEQ ID NO: 16528 - DNA, 410 bp, Zea mays
  Clone ID: cC-zmpo148047a11d1
gcgacgagtacgacatacggcttgacttagggagagatttcacctaatgtaaagcccacctcgaaacagaaatggcgaatgggatggtcaatcgggcgaaaccactcaagagatcatggaggggctaacggagtgcaacaccgactgcatcgaagacagtatctactccagtcgctacttaacacgcagctgtcgaaatgcatggggtactgcaaggcttcacgacaggttaaatgatagcctacctgatgcacttcgacatgcaccttgccgtgagcgagcacgaggatgctcagcttgctgcccatcttgctgcacaaggccttgttgctggtctcggtgctgatgccctctacgacggcttctacaatcagtacccagatcagccgcttatgcactacatcatgtac

SEQ ID NO: 16529 - DNA, 439 bp, Zea mays
  Clone ID: cC-zmpo148047b01d1
cttcttcttccccgccgccttaaacctcactcgccggaaccgctacaactcacatgtgctcgtgcacaaccaagcccaggacgcttgaggggtaggccgcaactgtatgccgctcgtgttcacacctcaggcggtgcacgcccgacggccatctttcaaatcttctcgttgtgacggctagcaggactcgagtgagagcacgcgtccgcgtctccatagcgtcagacgtgttggaaggaatccagatagctccgactacgtttatcatccaacggcttctgaggtgggcgctccataggcgttcattgacgcgacctgtcactaggtgcaatcaacggatgacataacctgcatcaaggaggcgaatccatggacgtgcgcccatgcaaatgaataggctggcagtgccacctagaccaggaggacggtgactactaaa

SEQ ID NO: 16530 - DNA, 441 bp, Zea mays
  Clone ID: cC-zmpo148047b02d1
ttcttgggttgacccacccgtccgcgccttcttccccgtccgcttggaactaacgcgccggaaccgcttcattacccaggggctcgtgcactaccacggccaggacccttgaggggtagcccccagactgacgccgcggtctccacacccagcgttgcagcccgtggccactgtcaatcttaattgacgacaccgactgatgaacacgtcgcgctacatacgtaaatgtggaggaggcgacagctgccgtctacgtttattattcaaaggctaataaggtgcgctctccacaggcgtgcaatgccgcgaccaatcacactgggtattgaaccgatgatattacctgcgtcgagtatgcggaatctatcgacgtgcgctactgccactgaatatgctgacacctgcacctaaaccacgctgacggtgaatgcgaaaaataag

SEQ ID NO: 16531 - DNA, 335 bp, Zea mays
  Clone ID: cC-zmpo148047b03d1
gaccacgcgtccgctcttcatccatgaccgctaacaccttaatcgtcctaaccgcttcaatatccatgtgctcctgcacaaccacggccaggaccccttaggggtagctcgcaacttaagccgccgaatgcacacgaaatgttgacacccgatgccattgtcaatctctgttggatgctgcagactgatgaacacgccgcgcacatgcgtaaatgagtaggagccaggagttcaagcctacgtatatgcttaaacgggttatgaggtggtcgaaccacacgcggacgttgccgctgaccctaacaaggacgacggaaccggttatattacctgcc

SEQ ID NO: 16532 - DNA, 466 bp, Zea mays
  Clone ID: cC-zmpo148047b04d1
atcattcttccatgaactctagcacctgactctcccgaatcgctttaatatccatgagcacgtgcactaccacggccaggacattctcaggctagcccccaacttacgccgggatatccacacctactgttgaacccgatgccatcgtcaaagttatcgaagacaccgagttatgaacacgccgagcttatggtgaaatcttaaggatccagaagctcctgtctccttacatcaataacaggcctatgaacagacctcactacaggcgtgcaatgccgcgaccacaaacaaagacctctctaccaacaataaaacctgtgtggggtatgaaaccctcgtgccgtgcgcccttgcagatgaaaaacctggctcttagaccaagaccacgcttatggtggatgctaaaaataactccctcgtccatggaacctgctacaagctggctcgttcaatgtgaccctctgcg

SEQ ID NO: 16533 - DNA, 557 bp, Zea mays
  Clone ID: cC-zmpo148047b05d1
ctccttcttccccgccggccaacaactcagccgccggaaccgccacatcatccatgggcgcctgcacaaccaagcccaagacgcttgaggggcaggccccaactgaggccgccgtatccacacccaacgttgcgcccgacgccacttcaatctccgttgaggcagcggctgatgaacacgtcgctcacaaggtggcggtggaggagccggctgctgcggccgacgttgagcatcaaaaggctaatgaggtggtcgctccataggcggccgttgccgagcccgatcacacggaggaggaaaccgtggagaagacctgcaggaaggaggagaagccatcggcgggcgcctatgcaaatgaaaaggctcgcaccgccaccgagaccacgacgacggtggatgcgaaaaagaaggacgtcgacgaggccatcacggagaagcatgcgcattaaagttgaccgactgtccgtgcatgcgcgtgccaactaatataaccattggctgatgatacccgatgagctgtgcgtgatctatcaaggagaccacacttgaattctcta

SEQ ID NO: 16534 - DNA, 514 bp, Zea mays
  Clone ID: cC-zmpo148047b06d1
gccccggctcctcgagctgcagctcaatggcaacaagtttcattggaagatccctgacctgaaacaggacgagctgacggcagtcaacctcgcaaacaatgagctcgagggggagatcccgccgagcctcaaattcacgccgcctgacatgtttgccggcaacaccaagctttgcggcccaccgcttggtgtcaaatgcgaggcccctccgccgccgtcagcgtcgccgtcgccatcaccgccgccgtcaccgaagacaccgcctccagcctccgtcaaagaaggcaccacgccatcccaaccagcagcagacaccgtggcgtccacaggcgcgtcgtcagctgacgatgcgaagcaagacgagggccataagcccgtcgagggctccacctccacgtcgttcggcgtcctcgccgcattcattggcacgcttgggatcgccggcgtggcgttcgtcgcgctgcggaggcgacggcggtacaagaccaagaacttcggcccgaccgcgtcgtcg

SEQ ID NO: 16535 - DNA, 503 bp, Zea mays
  Clone ID: cC-zmpo148047b07d1
ggcatagggtgataaactcttgacgccgtatgttgttgctgatcttgaatttaaggaggacgcggtagacaggtgcctcgagttactcatccttgctctcgacggactctgtgatgtccgcactaatgaggaagcatgatgccatgctcaaagcctatccacgagccccaggaagcagcaaacaagcttctcgaagaaccttaccgaaggggaagctgcgatacatcacacatatcatcgttcgctgtatacacgggactaccggtgagaaatcacgcgacgacaaagagaccaccaacgaccaacactcctaggtgtctcgtgtagggatccatcgcgctgtgtgttcttatggctgatgtacctgatgctcagaaaacaacgctcgctgctgatacgcaaggaaactgactcccacgaccagcgacatgctgctggctggctggctcggtggcctgctgatcggaactctgccgtagaatgactacaggggctggtgttgt

SEQ ID NO: 16536 - DNA, 620 bp, Zea mays
  Clone ID: cC-zmpo148047b08d1
ggaacaggaggtcgacgagctgctgatgcagttcgacgagaaggagagcataagcacctcctccattgaggagcgcctgcaagaacggctccctgaccctgtcgatctgaaatccgtggatctcgacagcagcaagacgacgtcctcctcctccagtcaggaggagtgcaaggatcaagaagagaacacgggggacattctggaggagaagcgtgacgggaaggacagcgaagacctgagcagcacaggcgacaaggcttgtgtcgggctcgggagcagtgatataaacatcccgatggaagaagcggttgatgaacctgttaaaccggcggaagctgtggacgaagctgggctgaagagagatgtctgctgttcaccagctgagccaaacgaagccgttggtcagaacgagctcaatgaggctgctgtcgtcggtgaaacgacgactgaaccgaaggaggctgaggatgaagccaagataataaagcaagtcgactgcgaaactgcatcaaaagaagctgctagtactggggccgagtcaagggacgatgccgctactatggaacgcgagccgctggtagcagcagcagcagcaccacaaggagagaatgccaaagctg

SEQ ID NO: 16537 - DNA, 595 bp, Zea mays
  Clone ID: cC-zmpo148047b09d1
cccacgcgtccgcccacgcgtccgcccacgcgtccgcccacgcgtccgggaaaaggagcgaagagagagagagacgcaggcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagaaaggaatggccaagtccggcaagcctctatggtacaaggggtcgacgttccacaggatcatcccggggttcatgatccagggaggcgacttcaccaacggcaacggcacggggggcgagtccatctacggcagcaccatcttctccgacgagaactttaagcacacccacgctaaagccggtacgctgtccatggctaactacgggcccga

SEQ ID NO: 16538 - DNA, 489 bp, Zea mays
  Clone ID: cC-zmpo148047b10d1
acgcgtccggcgcagctacgatttcaccggagtcacgtcgtggtttgcggccaagtgcgacctcatccttctcctgtttgatccgcataagcttgacatcagcgatgagttcaagcgtgtgatcgggtctctccgcgggcatgatgacaagatacgcatagttctcaacaaggccgaccaagttgatgcacagcagctgatgagagtgtacggagcactgctgtggtcgctcgggaaagtcctgaacacaccagaagtcatgcgtgtctacataggttcattcaacgacaagccgatcagggagacagcggctgggccgctgggcatggagctgttccagaaggaacaagatgacttgctctcggacctgaacgacatccccaagaaggcctgcgaccgtcggatcaacgagttcgtgaagcgggcaagggcggctaaagtccacgcgcacataatcagccatctgaagaaagagatgcctgcactgat

SEQ ID NO: 16539 - DNA, 478 bp, Zea mays
  Clone ID: cC-zmpo148047b11d1
gcttcccggatgacgattgcggcgccagcgaccgggtatacaccgtggacgccattcatggggcacccctggcgggtcctgagggctcctacgccggtagcacgcccatggggagcgattgctacggcggcgctccgtgggcagaagacgaggaggtgcgccgcctcagcgtgcggatgcaggcgttggaggcagaccgtgagtccatgaggcaagccatcatgtccatgggagccgagaaggcgcaggtgatgctgctcaaggagatcgcgcagaagctctgcaaggacgcgacaccaccggttccagcggcagcagtggcgcagcacggcttttacaaagggggcaacacgcagccggccatgaccatcactgtgcgaccaccacggcacccggctttgcttatgcaaaggaaactggtgaagaagaagccatcactccttgctgtagtggtcaagtgggttacatcaatcatgtg

SEQ ID NO: 16540 - DNA, 549 bp, Zea mays
  unsure at all n locations
  Clone ID: cC-zmpo148047b12d1
cccacgcgtccgcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaggtgactaagctggcggacggaacgacgacgatggcgaggagcggcggcgggatggaaggcagcggcgggctgaagaaggggccgtggacgcaggcggaggacaagctgctgagggaccacgtgcggcggcacggcgagggcaactggaacgccgtgcgccgggagacgaggctgcagcgctgcggcaagagctgccgtctccggtgggccaaccacctncggcccaacctccgcaagtgccccttctcccccgaggaggagcgtcagatccttctcctccacggcctcatcggaacaagtgggcgcgcatctccaagcacctcttcaggaggacggacaacgagatc

SEQ ID NO: 16541 - DNA, 480 bp, Zea mays
  Clone ID: cC-zmpo148047c01d1
ctcatgcgttcctgacctctaagaactgactcgccggaatcgccacaatacccatgtgctcgtggactaccaaccccaggacgttttaagggtagctcgcaactgacgccgccgcatccacactcaatgatgcagcctgatgccatcttcaatctcgaggggaggactgcgactgatgaacacgtcgcgctagatggtgaaatttgaggagccggaagctaccgtctccgcacatcattaatcggctaatgaggtggccgctccacacgcgtccaatgccgcgaccagtaacaaggcggcataaaccgatgatattacctgcatcgcgtatgcgactcctggacgtgcgccaatgcagatgacaatgctggctccgccagccagaccaggctgacggtggatgctaaaaagaactacctagacgatgcatggaactagaagctggcgcattagatgtgatccgctgtccgtgactcagcg

SEQ ID NO: 16542 - DNA, 413 bp, Zea mays
  Clone ID: cC-zmpo148047c02d1
acgcgtccgctcctgggacccagacctctaggacctggctccccgtaattgccaccattcccatgtttgcctgcactacaaatcgaaggacgctttagtggcagctcgccacttatgcctgcatatcctcacttaacgttgacgccttaaccctcggcagtgcgatgggaggcacccttctattaacacgccttgataaatggtcaaagtcgaagaaaccgtgacctacagtctcatcgctactttcatcgggaactaagtgagccgatccttatgcgttcaactccgcgtccaggaactctgctgtatcaaccagagatactacctgctgtgcgtaagagaaaacatcgacgggcaccattgcaaatgacactgctgcatcctcaagcactaccacgatgactgtggatact

SEQ ID NO: 16543 - DNA, 315 bp, Zea mays
  Clone ID: cC-zmpo148047c03d1
gtcattcgttcatgacctctaacaccataatcgccggaatggccataatttccatgatcacgtggactaccaatgccaggactccttaatgctagctcgcaactgacactggcatgttcacattaaggttgcacctgatgccattgtcaatctctgtgaggacgcggatgtggaagcacgcgcgcttatacgaaaatgtgaaggagccagaagctactgtctcatttcatccataacaggctcatgggtaggccgaacaacacgtatccaatgccgcgacctgtaacacggcggcatcaaccgatgatactacct

SEQ ID NO: 16544 - DNA, 432 bp, Zea mays
  Clone ID: cC-zmpo148047c04d1
ttcctggtttacccacgcgtccgctccttgttccttgaccgctaacaccttactctcccgaatcgccacaatttccatgtgctcctgcactaccactcccaggacgtttaaggggtagcccgcaacttacgccgccatattcacacctagcgatgaagccggacgccattgtcaatttctatcggaagacagcgactgatgaagcacgcgcgcttattcgtcaaatgtgaaggagccggaacctactgactacgttcatccttaaacggcttatgaggaggcctcaccacatgcgtacattgccgcgacctgtaactcggcggattagaccgctgatattacctgcatgaggtatgagaatctctggacatgcaccattgcagatgaataagctggcaccgccactcagaccacgctgacggtggatactaa

SEQ ID NO: 16545 - DNA, 471 bp, Zea mays
  Clone ID: cC-zmpo148047c05d1
ttctgggtcaccacgcgtccggcattggtccatgaactcttgagctgactgtcgtggatcactttaatatccatgaggacgtggacgaccacggcgaggagattcctcatgcttgctcgcgactgactctgggatgtccccactaatgatgaagctgatgccattgtcaagcttatcgaggacccccactttgaagccgacacgcttatcgtaaaagctgacggaaggggaagctcccgtcacatcacagctataatcggccgctggggagaccgaactaccggtgtaaaatgccgcgaccacagacaggacccaagcgaccaacactattacctgtgtcgtgtaggggaccatcttgccgtgcgctcttgtggatgaataagctgacgcttacaccacaagcttgctgatggtcgatacggaaaataactcccccgaccatcgttcaagcttgtagctggctcgttcgct

SEQ ID NO: 16546 - DNA, 628 bp, Zea mays
  Clone ID: cC-zmpo148047c07d1
agcatttggtgataaactcttgaagccgtatgttgttgctgaccctgaaatcaaggaggaggtggtcgacagctgcctcgaattcctcatccttgctagcgacggactctgggatgttgtcactaatgaggaagctgttgccatggtcaagcctatccaggacccccaggaagcagcaaacaagcttctcgaagaagcttcccgaaggggaagctccgataacatcacagttatcatcgtccgcttcatagacggaactaccggtgagaaatcaggcgacgacaaagagaccaccaacgaccaacactcctagctgtctcgtgtagggatccatcgtgctgtgtgttcttctggctgtcgtacctgatgctcagagtagacgctggctgctgctccgcaaggaaactgactcccccgaccgccgttcatgctcctggctggctggctcgctggccgcctcgacgggaacgctgccgtagaatgacgactggggctggtgttgttgttacagtatggtcctttttttctttcttctgtcccctttcatccattaagctctgtgatgtaactgcccgtgctgttgattcatgaaatcatgctagagatcttttcctggcagtaagtgcgt

SEQ ID NO: 16547 - DNA, 550 bp, Zea mays
  Clone ID: cC-zmpo148047c08d1
cggacgcgtgggcggacgcgtgggcttcaaccacttcggcaaggggctggtgcaggggatgccgcgctgccgtcacggcgtcttccacgtggtgaacaacgactacacgcactggctcatgtacgccatcggcggcagccggaaccccaccatcatcagccagggcaaccgcttacgcgccgacgacgacagcaagttcaaggaggtgaccaagcgggagtacacgcagtacagcgagtacaagaactgggtgtggaagtcgcaggacgacctgtgcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggctgtgttgtatataactcttgtgtttggaatgccgcccgtaattaatggtcaactctaacact

SEQ ID NO: 16548 - DNA, 496 bp, Zea mays
  Clone ID: cC-zmpo148047c09d1
cggacgcgtgggcgcggagcctcctcaacccttcagacctccgtctcccaccgcttccgtagcctcgcgccctcgcctcgcctcgcctcgtccttctcctccgtcccaaccatgagggagatcctgcacatccagggcgggcagtgcgggaaccagatcggtgccaagttctgggaggtgatctgcgacgagcacggcatcgaccacacgggcaagtacgccggcgactccgacctccagctcgagcgcatcaacgtctactacaatgaggccggcgggggccggttcgtcccgcgcgccgtgctcatggacctcgagcccggcaccatggactccgtgcgctccggcccctacggccagatcttccgccccgacaacttcgtcttcggccagtccggcgccggcaacaactgggccaagggccactacaccgagggcgccgagctcatcgactccgtgctcgacgtcgtccgcaaggaggccgagaactgcgact

SEQ ID NO: 16549 - DNA, 622 bp, Zea mays
  Clone ID: cC-zmpo148047c10d1
gctcgcgcacatgccgctgtcgtccaagatggacttctgcgggttctgcgtcgcctgggcggggacgcacagcaggctggacggcgccgacaaacagcggctcccgcccgcccccgccggcggcgacgcggagaaatggcagcgggtgccgctgccgtgggagctcttccagccggcgctgcacatcgtggcgcactgcctgctgggcaccacgggctcggacgagctgaaggcgcaggccgcccgcgccgcggaatgcctgtattggagggccaccgagacgatggacgcgcgcgcggtgctggccaccaggagcctcgtgaggctgtcgcagatggtggaggaaccgatcccggagccctctttctctggcgccatcgagaatacggcggagctggaggccatgagggccaacattctcaactcgaacaactgatagactggtgaatactgacaacgtattcagctaatgcaacgagtatttatttattatgggtagcattacctctggcattcggatagaagtactccagtctctcttgtattgtgcagcagagagattacgcgcaataagtgatgtaatcgtttgaaaactgaaacaaactatcagaatgataagttt

SEQ ID NO: 16550 - DNA, 575 bp, Zea mays
  Clone ID: cC-zmpo148047c11d1
cccacgcgtccggaggatttaaagatctggccccacagttttgaatttcgcttgagagtttctcttggaccttctggagatctgagtctcacatcccgaatcaggaataccaacacagatggaagacctttctcttatacatttgcatatcacacatacttctctgtctctgacataagcgaggtgcgtgtcgaagggctggaaacaatggactaccttgacaacttgaaggcaaaggagcgtttcacggagcaaggcgatgctattgtttttgaatcagaagttgataaagtttatcttgccgcaccctctaaaattgccatcattgatcatgagaagaaaagaacatttgtcgtgacaaaagaagggcttcctgatgctgctgtttggaacccttgggacaagaaggcaaaagcaatgcaagattttggggatgcagaatacaagagcatgctgtgtgtggagcctgcagctgttgagaggcctattactctgaaaccttgggaagagtggaaaggaaagcttgtgctttcagctgttccttcgagttactgtagcggacagttagatccatc

SEQ ID NO: 16551 - DNA, 584 bp, Zea mays
  unsure at all n locations
  Clone ID: cC-zmpo148047c12d1
caatccttgcacccctcccctccgtcaccccaccacatccggccagcccaacgaaaatgtcgcgcgccacagctggggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctggcacgagaactgcccccgctaaggcacctnaagccgcctacacccccgccgttgccgctgccccatcgtgggcggcgtgtagtgaagtctggtccagctgccgcgccgaccaccgccgcctctacaccgtcttcttccacggacgaggagttgagcccttccccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccanagaccgcgtcgtccagggtgggcacgtagttggct

SEQ ID NO: 16552 - DNA, 392 bp, Zea mays
  Clone ID: cC-zmpo148047d01a1
gacgtattatccatggctattatttagtatccgagtttacatggattcaataagccccaggatgttgtattatcagaaccccatggtgggataacgggtgatcttatagtgttagctcagttacaaggagaccgagtctctctcccgacttaaacatgtatgccatttagtggactatctctttcttgcacattgttcatctggcttcagccttttgacttgcagtcaattagcttatcgatggcttctccttctccatctatatcttctcctcggtagtctttcttcaattttagcgtgggctcggctgcctccttgttggaggccatattttcctctgcaaggacttgctgatgagctttctttgtcgatgacggtcttcgtcacatctt

SEQ ID NO: 16553 - DNA, 626 bp, Zea mays
  Clone ID: cC-zmpo148047d01d1
cccacgcgtgaacctcctcgtctcctccattgaccaacaattaagcctccccgaccgccacatctattaggtgcagccatgggtgcctgtgcaacgaagcctaagacgcttgaggggaaagccccagctgaggccaccatctccacacccaaggtggcacctgagaccactaccatccacattgaggttgcggcaaaacatgcagtacttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaggagatatagatggagaaggagaagccatcgctcagctaattgactgcatgtcaattggctgatgcctgatgatcaatgtgcaagaaagagatcgaccactcatttgcatacatgcttaagtcgggagagagactcggtcacct

SEQ ID NO: 16554 - DNA, 466 bp, Zea mays
  Clone ID: cC-zmpo148047d02d1
ggccgttgtgccagaggctttggacacgcaaccaccggagggttatgatgtaaaagctacgtgggaaccgaaccgaccggcctacatgtggtgaacccgcaactgagaacgctacgctggcgcgatattcaaaccggacgcctgtggattatctttacacggcccatgattatacacctctcggaggatcttcttatgagcagcgacaagaccatccattgtcgtagcgcgcatgggcacatagtcaacagcgctcagatcacggatcagctggcgcaaaacgtcaccatgcacaatctgcacgtgcaccactctaagcacactatgggaggccatatgcgcgactccttgacgcagataggctgcccaaccagggcctaaggagacggcatgtcgctattatatgtgaccaacgtgtggatcgaccacatctgcatgctcaactgctaggactgcctcattgacg

SEQ ID NO: 16555 - DNA, 324 bp, Zea mays
  Clone ID: cC-zmpo148047d03d1
ggtttacccacgcgtccgcgctggcgttcatgacctgtgggaccatgaaggcaggcatggcctcatactttccgatggtgcgcgctgcgacgaccaactgccagggaccacgaaaggccttgctcgccactgagaccgccatgtgccagagcgaggcgcgcccccgatgccaggtcaatctctggacatgacgcagctgaggaccaaggcccactgaaagtcgaacagaaccacgctggtagctcacggccgtcgagcacgcttaccaggtaacggggcagccgaacatcatgattcccaatggcgaacacctgacgggcgcgc

SEQ ID NO: 16556 - DNA, 535 bp, Zea mays
  Clone ID: cC-zmpo148047d04d1
ttcacgactcttaagtcgaccacccctagctttggagattcgaaccatttgatctctgcaaccatgagtggagtcacctgctgcctaaggatccctggtcagctgaactccgacctcaagaagctggcagagaacctaatccccttgcaccgcctccacttcttcatggttggcttcacgccgctgacgtcccgtggctcccagcagtaccgagcactcaccgtccccgagctcacgcagcagatgtgggacgccaagaacatgatgtgcgccgctgaccctcgccacgggcgttacctaaccgactcgttcatgttccgcgggaagatgagcaccaaggaggtcgacgagcagatgatcaacgtgcagaacaagaactcgtcctacttcgtggagtggatccccaacaacgtgaagtccagcgtgtgtgacatcccgtcgaggggcctgtccatggcgttcaccttcgtcggcaactcaacttccatccaggagatgttccggagggtgagcgagcagttcactgccatgttca

SEQ ID NO: 16557 - DNA, 428 bp, Zea mays
  Clone ID: cC-zmpo148047d05d1
gggtttacccacgcgtccgcttcttcttcccggcccgctaacatcagacgccgcggaacagctacatcttggatggtctcctgcactgccacacccaggacgcttgaggggtaggccccaccttaggcccccgcatgcacactgagcggtgccgcccgacgcgctcatcaatctgcaggggaggcagtggactgatgaacacgtcgctccacaaggtgacctgtggaggagccaatacctgccgcctacgctggtgctaaaacgggttcagaggttgtctctacttacgcatccagcgccacgacatgacactcgggggactaaacggctcacataacctgcaggacgggtgagaatccatggacgtgcaccaatgccaatgactatgcgtgcagcgcgacggcgaccacgaccacggtgactgctac

SEQ ID NO: 16558 - DNA, 592 bp, Zea mays
  Clone ID: cC-zmpo148047d06d1
ctcctcctcccccgccggccaacaactcagccgccgcaaccgccacatcatgccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcacaaggctaatgaggtggtcgctccaaaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaggccacgaaggagaagcaggcgcagcaaagctgaccgactgtccgtgcatgcgcgtgccaactaatataattattggctgatgatacctgacgatcagtgtgtgatcgagcaatgagacgacacttgaattctctacagttggcatagcggcataggtcgggagagacac

SEQ ID NO: 16559 - DNA, 436 bp, Zea mays
  Clone ID: cC-zmpo148047d07d1
agcgaccgtagacctgatattgtggcggtttgcagaggcggcctatagcttgcaggctgaggtcttgcacgggaagtttgattatcgccaccatattcagaacatgctttaactcgctggtattaggcaccaaacgtcttgcttcagtcatctcgcataagaacctgcaggagacatgtggccaacgggtgccataatggctgagctggggacactccattctctcttcactggatccagtgcactagatgagatgcacaacatatgcaaagtcatgcgacgaccaaaagaccactatcgacctacacgactgtctgttgcgtaagcgaagacatctcactgcgcacagaccagacgcgggcacctgactgtggtgatgaccactggttgttgctaggcaatggaactgatttcatcaatatgctcatgtgatcct

SEQ ID NO: 16560 - DNA, 591 bp, Zea mays
  unsure at all n locations
  Clone ID: cC-zmpo148047d08d1
gtggagatggaggggtcccacaccatgcagaacgactacgactcgctggacctccacatcgggcagtgcctgtcgttcctggtgaccgcggaccagaagcccggcgactacctgctggtggcgtccacccggttcatcaaggagaagagcagcaccacggccgtgatccgctacaagggctccagcgccccgccgccggccaagctgccggagggccccagcgggtgggcgtggtccatcaaccagtgcaggtccttccgctggaacctgacggccagcgcggcgcggcccaacccgcaggggtcgtaccactacggccacatcaacatcacccgcaccatcaagctcgccatgggccgcggcaaggtcgacggcaaggagaggttcgccttcaacggcgtgtcgcacgtggacccggaaacccccgtcaagctcgccgagtactttaacgccagcgacggcgtgttcaagtacaacctcatcggagacgtgcctgcctacacacgggccccaccaagatggcacccaacgtcatcagcgccgagttccgcacgtncattgacgtggtcttcgagaaccccgagaagagca

SEQ ID NO: 16561 - DNA, 457 bp, Zea mays
  unsure at all n locations
  Clone ID: cC-zmpo148047d09d1
attctcgccacgcgtccggggaatgatttttgtgaatggcgaaggagtgggtagatactgggtctcataccgaactcttgctggaactccttctcaagcagtgtaccatattccgcgtcctttcttgaaatccaaggacaaccttttggttatcttcgaggaggagatgggcaagccggacggcatcctcgtgcagaccgtgacgagagacgacatatgcctgtttatctcggagcacaacccgggacagataaagacgtgggacacggatggtgacaagatcaagctcattgcagaggatcacagcaggcggggcaccttgacctgcccccctgagaagacaatccaggacgttgtctttgccagcttctgcaacccggacggcatgtgcggcaacttcactgtangcacttgccacactcccattgcaaagcagatcgttgagaaagaatgcctc

SEQ ID NO: 16562 - DNA, 475 bp, Zea mays
  Clone ID: cC-zmpo148047d10d1
gctgcggcaaggtcgtcggactgccaatgccgccgtcctacctctccgtctagagcatgcacgcatctcgctcgggttccccttccttccatcacgtgcgcacggtgctgtatacacaatttaaaggagcgtgagggcagcggcttctctcgtttccttcttctctagctttgtccccctagctcgtttgttctctcgtcgtcccgtcgtccggttcatttccgcttccgaggaataataatcaaccaaaggggcgggcgaccagggaaattaagaggcgatggtcagctgcaaatgcattcatgcgtaaacacatcgagacgccgtctcgaaccattgtaggagttaagtatatgatgatatataatcctgtctatctaataagtccctcagccaaaaattgttctttatatttatgtatatgtacatgcatgtctcctgattcaactttgatgtttattgtctctttcgcttt

SEQ ID NO: 16563 - DNA, 596 bp, Zea mays
  unsure at all n locations
  Clone ID: cC-zmpo148047d11d1
ccttaccctcgaagccgaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagccccaagaagagagccatcgcggctgctgatgacgattgcaagcctgccgatgacgagtcaacgtcgtggaagcgcctcgtggacggtatgcgcccgctccgcctccgcgggcagctggagtactacccgncgncaccgncgncaccgncgntgggccacgccgatgtgtaccatgacgtgatc

SEQ ID NO: 16564 - DNA, 613 bp, Zea mays
  Clone ID: cC-zmpo148047d12d1
ggctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtactgctcaccaggaacgttggcatctccgacagcctgcgccccgccaacccgctaggctacttcaaggacgttgccgctcccgtctgcgccgcgctgctcaagcagctggacttggacgacgacgacga

SEQ ID NO: 16565 - DNA, 88 bp, Zea mays
  Clone ID: cC-zmpo148047e01a1
gccgtcctttttttttttttttttttttttttttttttttttttaactcctgatttttttcgttttttatagtagtaattttattccc

SEQ ID NO: 16566 - DNA, 595 bp, Zea mays
  Clone ID: cC-zmpo148047e01d1
atcacgacaagatggcatgcacaaacaatgcgatgagagccttgttcctcctggtcctcttctgcatcgtgcatggtgagaaggaacagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttgcttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcatggcccagtcgtgtgtagcaagaactcctgcaccaagacgtacgactgcaagatcctgtccaactcgctggtgatggacttcgtgaacaaggtgaggtgtacggtgtcacgctgttcatctgcagtttttccacatgaacatgtaccggtgccaggacatgc

SEQ ID NO: 16567 - DNA, 319 bp, Zea mays
  Clone ID: cC-zmpo148047e03a1
gctataaaaccgcttcaccatttgatacgaagtgtccctctatttaagtgttgggttgcgttcttaaacttgtactttgcaatgtcctctgaggcttgatactgagatcatgtatatattttgaatggtattatagaggggagtctggtagtatgtattagtaagttcgcagattgccagaggcctaaaataagactggcgagtgtgagaatgagatgtgagacgaagagtgtgtgacggatgcaagtaggttcagacgcaagcgagcttcttcgccatgccaatggacttgccgatggcgttcttgcagacggacatg

SEQ ID NO: 16568 - DNA, 527 bp, Zea mays
  Clone ID: cC-zmpo148047e03d1
cgatggcgttcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtctgtgcccgctggctcgctggacatcgcgcagctgggcgccaagggcgacggcaagtcggacagcaccccgatggtgctcaaggcgtggaagcacgcgtgcgaggcgacggggcatcagaagatcgtcatccccaagggcaactacctgacgggcgcgctggacctggtgggcccctgcaagttctccatcatcatccgcctcgacggctacctgctcggcaccggcgacctcaacgcgtacaagaggaactggatcgagatccagaacgtcgacaacctgtccatcaacggccacggcaccatcgacaggcagggagccctggtgtggaacatgaacgagtgccagcggtcctacaactgcataatccttctcaacagcctggtgctggac

SEQ ID NO: 16569 - DNA, 476 bp, Zea mays
  Clone ID: cC-zmpo148047e04d1
ccacgcgtccgttcaggactcttaagttgaccacccctagctttggtgatttgaaccattcgatctctgcaaccatgagtggagtgacctgctgcctaaggttccctggtcagctgaactccgacctcaggaagctggcagtgaacctaatccccttcccccgcctccacttcttcatggttggcttcgcgccgctgacgtcccgtggctcccagcagtaccgagcactcaccgaccccgagctcacgcagcagatgtgggacgccaagaacatgatgtgcgccgctgaccctcgccacgggcgttacctcaccgcctccggcatgttccgcgggaagatgagcaccaaggaggtcgacgagcacatgatcaacgtgcagaacaagaactcgtcctacttcgtggagtggatccccaacaacgtgaagtccagcgtgtgtgacatcccggcgaggggcctggccatggcgtccacc

SEQ ID NO: 16570 - DNA, 560 bp, Zea mays
  Clone ID: cC-zmpo148047e05d1
cccacgcgtccgccgggccccggggaaaattttgcccccagaaaccctagcgcgtcggatcagcaagggcaaaattttctgcgactccggctgaaggacgctgcggcacctatgtcggacgacactggccgcactatacccaagttcggcgaatgggacgtgaacaacccggcctctgccgacgggttcacggtgatcttcagcaaggccagggatgagaagaaagccccggcccaaggccacatcagggacaggtcggcgtcggccgacagcaaggactccaggtccagggacgagaagatgacctcctacagctccaggaccaacgcatcgaagaaatggttctgctgtgtctcgcccagtcccacacagtcttgaggaagctaatgagccgtgcagagctgcagtttctgtgatggctatgcgtagctcttcgaattcaatcctatactgcttgccagtgacaggggctctatgtatagccattgcagatgagacaattactctgatgggtgtctgcttatagcgttcttagctgtggataccatcaattcaagctg

SEQ ID NO: 16571 - DNA, 510 bp, Zea mays
  Clone ID: cC-zmpo148047e07d1
ccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccagcgtcctgctcaccaggaacgtcggcatcagcgacaacctgcgccc

SEQ ID NO: 16572 - DNA, 484 bp, Zea mays
  Clone ID: cC-zmpo148047e09d1
gcggcgccacgacctctcctattgccgctgctggtcgttatgctagcggtggtcgccgatgtcgccaacgccggccacgccaagcccctgacgcctggcgggcgcgtggtacacgacaaccacggcaagttcacggccgggccgtggaaacctgcccacgcgaccttctacggtgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacaacgtgcggtgcgtggacagccccagcgggtgcaagcccgacgcggcggcgctggtggtgacggcgaccgacctgtgcccgcccaaggacaagtggtgcaagccgccgcaggagcactttgacctcagcatgcccgcgttcctacagatcgcgcaggagaaggccggcatcgtgccca

SEQ ID NO: 16573 - DNA, 478 bp, Zea mays
  Clone ID: cC-zmpo148047e10d1
cgccaacggggccgggccccggcggcgggggtgggcgcgggcgctgatgcggcggtacagcgaggcgtccacctggggtctgccgccgccgccgccgccgccgcaggaggcggcggagtcgtcgtccgggggcaggaggcgagggcgcaaggtggcgccggagcccaaggagccggcggaggaggggaccgccgcgctgccgccgatgcccggctcgcccagcttcaggtactactgccagaagaagacggcggccgtcgacaggatcgtggccgacgccgacgccgccgacgccgatgactccgtcagggtcagagcgacggcgcgtcagctgagcaacaggtgcgaaatcacggcgaccaaggcacacgattctaccgaggttgctcaacctaaagagggaaccagatggcttacgttcagtggcctgtccctcgtcgctaccgcttggcacaacttgatcagccgacaaagaagc

SEQ ID NO: 16574 - DNA, 491 bp, Zea mays
  Clone ID: cC-zmpo148047e11d1
cccacgcgtccgccgttgggtggctgcgctccctgttcctggacctgacactgccgccggaggccaccgatgacgacctgcgcgctgcggtcgccaatggtaggctgctctgcgcgctcctgcggagactcttgcccggcgcgctgttggacgacgcggccacggacaatgtcggcaggttccgcgccgccatccagcggatgggcgtgcccaccttcagcgcctatgacctcgagaggggggagatgtcagctgtcgttacctgcattcttgctctaaaggatcggttctcatcacgcctcggcgaagaccaccgcagctcttccttcctcaccagatgtgaaagcgaaggtggcaggaggaacatggaaggcaagctgcaaagggtactcacaagccccattatgtcagagccatactctccttcctttggaggcgatgcctattctccatcacaggtatttcaacccgaacatggatattctgatcta

SEQ ID NO: 16575 - DNA, 499 bp, Zea mays
  Clone ID: cC-zmpo148047e12d1
cccacgcgttcgcccacgcgtacgagaccgacctgtgcccgaccaacgaccagcagaccgcggacagcgggcgctggtgcaacccgacgcgggagcacttccacctcagcatgcccacggtcctccacatcgcacaggagaaggccggcatcgtgcccatctcctaccgtagggtggcgtgcacgaagcacggtggcatccgctacaccatcaccgggaacacgtacttcaacatggcgaccatcaccaacgtaggcggcgccagcgacatcacggccgtgtcggtgaaggggagcaagcgcgtttagtggacggagatgaagcgcaactgggggcaagtgtggcagaccggggaggacctcacctgcaagacactgacgttccgggtgatgaccagcgaccaccgcaaggccacctgatggcacgttctccccgctgactggaagcttagcgttacgtaccacgcgttcaataacttttaagaaaccacttgcccttc

SEQ ID NO: 16576 - DNA, 469 bp, Zea mays
  Clone ID: cC-zmpo148047f01d1
ctagaccagaacatccatccgagctaagtaattaggtcgaaaatgacccgtgccagcagcagtagcagcagccggcgtgtgacgctggtactgctcggtctccgcctgctgcttctggttggtgttgcgcaggcggcagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaagatggccatcgaccacgccgacagcaccgagtccaagatcgacgacctcgcggagctggaggcggcgtcgtccgattcgcaggcgcgcgccc

SEQ ID NO: 16577 - DNA, 329 bp, Zea mays
  Clone ID: cC-zmpo148047f02a1
aattgtaactgccagcatgcctttttattattatccgttcaatcgatgtttaacacacatttgcgtgacattacatttggagttccatcgacggtatatatatttgaacaaaaacaattagcttagaaaatgccagattaataggaatacaatatattgttgcgtccatatcagatggttatcgcatgcgtggccagccggtgacgaggtacgtatagactcgctcagcgcctgagctgaacgccacgtcaccccggcgcatgcatacatgcatgcatgcatgcatggttcattcatttcaaggggcttcgcttcaagaaggaggaggg

SEQ ID NO: 16578 - DNA, 474 bp, Zea mays
  Clone ID: cC-zmpo148047f02d1
gacccacgcgtccgtccacgcgtccggagggcaagaaggggacggacctgttcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgtggtcaccaaggcctgcaccgtcacctgcgccaaggagaagaacccgcgcctcagcgagaactgcaagaggacctgcacccctcctccttcttgaagcgaagccccttgaaatgaatgaaccatgcatgcatgcatgcatgtatgcatgcgcctgggtgacgtggcgttcagctcaggcgctgagcgagtctatacgtacatcatcaccgggtggccacacatgcgataaccatatgatgtggacagaactgtctattgca

SEQ ID NO: 16579 - DNA, 381 bp, Zea mays
  Clone ID: cC-zmpo148047f03a1
gtggtataatatttttatattgcagtcggtccatccatgtttgtccgtttctgggattgtctatttggcagcacatcgacgtggttaaggcactatttgatgctactagggttcaaaatagttgtttgatagtacatccttatgcgttacactcagtatcgcagcttgctggcatacgcaagcaccagctcgcttgcatcacacgcaaaaccttttttctcgtgggcgtgaacaagtcactgctgtttgcttctaccaacgaatgtaacgctagcttttcttcttcttatctacgtatgcaacgttctccaactgacgctcaagagtctcctgcaaggtctttctttggtgctgcaagctcctattccagtgcacttacgc

SEQ ID NO: 16580 - DNA, 550 bp, Zea mays
  unsure at all n locations
  Clone ID: cC-zmpo148047f03d1
gaaaatttcccgtggccggattgaacatcctcacgtgtcacctcttcacgaggaacttatccccacttcaattcatacccctggatcaccctattcttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggaggaggttctgcaggctgctgtctnccgcgttagtgcactggaagaggagcttgcagct

SEQ ID NO: 16581 - DNA, 562 bp, Zea mays
  Clone ID: cC-zmpo148047f04d1
ctcaaagtttattttgacatctgatgtggagttgtctgttcgagatgcaaaattggatcttagtaattggttgcatatggctgacttaggccttgttgatgacttggagaaacttccatttgtttctgctgctttggagcaactggaagagaagacgaaatattggattgattacagaaattatggtggtagtcctccatcaaaagatagcttctctcctggatctagtttcaagtctaggaactcttttgatgtgaatacttctcagcagatgagtgagcacaagatctctctttcagatagagatatggtcaatggtatttcagaactctccatgtctcccgagttgagtaaaacctctggtaaaggaacaatatctaaagtaaatgagaaatgtaccacaaccattgattcaaatgaacatgacccatacacattttaccaggtgtcagatggccaacacctaattctccatccactaaacatgagatgtcttctaaaccattttggaggttctgatatgcttccacctagaataactgccaaaatattggagctggaa

SEQ ID NO: 16582 - DNA, 360 bp, Zea mays
  Clone ID: cC-zmpo148047f05d1
tcctgttcccttccgccaatacctcaccccacccaaccgtttcatttttcatgctctcctgcacaaccaagggcaggacctttgttgggtaggccccacctgtgacccccgtatgcacacctaaccttgcgcttgatgccatttcaatctccgttgaagtagcgaccttgaacacgtagctcaaaaggtaccgttgaaggagccaagtagcgcgcgtctctttgatcattaaacggctaatgaggtggtctcttcatacgcatacatcgtcgcgccctaatactaggtggacgaaaccgttcacaaaaccttcatcacatatgagaatccattgacatgcactcaatgccaatgaaaatg

SEQ ID NO: 16583 - DNA, 548 bp, Zea mays
  unsure at all n locations
  Clone ID: cC-zmpo148047f06d1
ggaaaaggagcgaagagagagagagacgcaggcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagaaaggaatggccaagtccggcaagcctctatggtacaaggggtcgacgttccacaggatcatcccggggttcatgatccagggaggcgacttcaccaacggcaacggcacggtgggcgagtccatctacggcagcaccatcttcttcgacgagaccttcaagcacacccacgctaaagccggtacgctgtccatggcntactacgggcccgac

SEQ ID NO: 16584 - DNA, 531 bp, Zea mays
  unsure at all n locations
  Clone ID: cC-zmpo148047f07d1
cccacgcgtccgcttcctctcctccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgctccgagggccgtcttccccagcatcgttgggcgcccgcgccacaccggtgtgatggtggggatggggcagaaggatgcctacgtcggcgacgaggcgcagtccaagaggggtatcctgaccctcaagtaccccatcgagcacggaatcgtcagcaactgggacgacatggagaagatctggcatcacaccttctacaacgagctccgtgtggctcccgaggaacaccccgtcctcctcactgaggcgcccctgaacccaaaggctaaccgtgagaagatgacccagatcatgttcgagaccttcaacacccncgctatgtacgtcgccatccaagccgtcctgtctctgtatgc

SEQ ID NO: 16585 - DNA, 358 bp, Zea mays
  Clone ID: cC-zmpo148047f08d1
acgcgtacggccacaccaccgacgggtcgttctaggatcaccaccatttgtttatttcaaacttctactaaaagttgaggaatgggtaacaaatccctaacattccaacattcctttatatatatatatatatatttcttagccctgttttgctcataccatgtggagaagcagaccattccaaccatactatgtaaccactatttattgatgacagaagactaaaagtcaccctggactttagcgcactaggcaacctgttttgtctaacgctccttagccgtgatataaacatccacctggaccaacccgtttcttgcaccttgtcaacctacggaagctctttacctaagctggt

SEQ ID NO: 16586 - DNA, 528 bp, Zea mays
  Clone ID: cC-zmpo148047f09d1
ccctccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaatgaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacagggcgacggcgacgcggtcgcggtccctggcgcacagggcgcggggcccctgcacggcgaccaacctcatcgaccagtgctggcggtg

SEQ ID NO: 16587 - DNA, 518 bp, Zea mays
  Clone ID: cC-zmpo148047f10d1
gtggcgcccggtcgggctcagctccccctcgccaccgcaaccggtcgccggggtctccgccccgtcccaaattttgaaggcagcgaggctcgatcgtgtcgcgggccgggagggacgctcatgcagatgcagtgacgagccagccggccggcggggcgcacgcgtgtgcctgcacggaaacgggagacgcctgccccgtcgcgcgcggcagggggttccctccttcctctggtatgccggtcggctgcctaccggcctcgtagtttgccggctgctgctgatccgcggtcgtgcctgccttttctcattctcatcgtccgcggcggtgccagccgcgcgtgcgtgttcgggaggtggtggaatgctgctgcgttggaagcgggatttcgggggctccgaaccacccgtgtcgcttgcattcgttggaaccaggagcagtggtagaagcggcaatgaccaatttctaatccaatggctttacgttcaaattcatccatatgatccaggtatcacaaaac

SEQ ID NO: 16588 - DNA, 354 bp, Zea mays
  Clone ID: cC-zmpo148047f11d1
gaggaggtggtccccgtgggctgggacggctggcagatcgccaagccggagagcagcggcatctactacggcgagttcaagtgctttggccccggcgctgacgccaagaagaagaagagggtggggtgggcgctggacctcaccgaggcgcaggccaagccattcgtcggcacacactacgtcctcggcgacacgtggatccagccaccgcccaagtagcgacgcatgccacacgatatatctatttgagtacgaagcaaaagcgagagacacgaatctctaatctctttactgatgagatgttttgcttatatatatatatagacgagctaatgaaagctcagggttttcatt

SEQ ID NO: 16589 - DNA, 431 bp, Zea mays
  Clone ID: cC-zmpo148047f12d1
atcgtccccgtcgacggcgtggcctggttcctcgacctcttcgactactacatccgcaccgacgagcgcgacgctttcagcaaggagctgcgactccagaccaaggtgttctatttcgatatcggggagaacaagaggggccgattcctcaaggcttctgaggcctctgtcaaccgaaaccggagtaccataattgttccagctggcagctctggtgaagagggctgggaagcattcaggcgtgtactgctggagataaataacgaggctaccagattgtatgtcctaccaaatcatccaaatcagcaacacatggagccgccagagcgtcttcctggtctgtccgatgatgtgggtgccggatttatagcaagacatggtaaccagtctgcttctggaccagaggtagatgtccaacgctcggaagatct

SEQ ID NO: 16590 - DNA, 262 bp, Zea mays
  Clone ID: cC-zmpo148047g01a1
agcaagaatccagctctcagtattaggttcagccacgctgttacatttttgttttcctttcctttctcagttacatattttgaatccaggtgaagaggatttgaggtttagtgcctgccagtctgcgtcgactgcggtcggtcgtcgacgtcgtgctattacatatcgatcgtcgtcgtcgatgtgctattactgatcgtcgtcgtcggccgagtcctactgttagagctgcgaggcgctgatgggcagcggcacgtccttg

SEQ ID NO: 16591 - DNA, 592 bp, Zea mays
  unsure at all n locations
  Clone ID: cC-zmpo148047g01d1
gacccacgcgtccggccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctgcattacanatactgtactgagaaag

SEQ ID NO: 16592 - DNA, 249 bp, Zea mays
  Clone ID: cC-zmpo148047g02a1
gctacttcgtcacgccatgttttcaggttgtgttttctggagctacttacttggtgggtggaggtcagtttcaattctttccggtgtttttgtttatacgtacgaatctttacaaatatatttatgcgtgtggtttagatttgtctgcaaatatttgcttttttttaaactgtgtcgagtttacacggtgttgctctgctgaatggtgtctatgtcgaagcccttgagcttgacgacggactcgtctgt

SEQ ID NO: 16593 - DNA, 602 bp, Zea mays
  Clone ID: cC-zmpo148047g02d1
cccacgcgtccgcccggagcgcgtcggacatcgtgctgacggatcccgggctgagcgtgatcgtgagcgccgtgctcaccagccgcgccatcttccagcgcatgaagaactacaccatctacgccgtgtccatcaccatccgcatcgtgctgggcttcctgctcgtcgcgctggtctggaagttcgacttcgcgcccttcatggtgctcatcattgccatcctcaacgacggcaccatcatgaccatctccaaggaccgcgtgaagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggag

SEQ ID NO: 16594 - DNA, 88 bp, Zea mays
  Clone ID: cC-zmpo148047g03a1
gtcacatgcgacttctagtttgacggtatcgatgctattcgtttttctgaatttccaccatactttcgttgagttccatgatccatcc

SEQ ID NO: 16595 - DNA, 526 bp, Zea mays
  Clone ID: cC-zmpo148047g03d1
cttctttcttcctcctcctcgtcctctcgaattccgtctcttgtctctgtcctcctcgctcggcttccccggttcttgagaggggaaagaggaggcggaggagagggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcacgtcaaatctgcatcggtgcatcgattgaacaataatgtgcacaacaaatgtttgattctttgtctgcgatttcaataccaaatgacactggcgtttgtggcaatggaacagttgattggtggctgcagctctgcatggaattagttagcggttatctcgtgatctgggatggatcatggatctcaacgatagtttggtggaaattctgaaaaacgtatagcatggatcccgtgaacttgttgtcgcttgtgtcaatcg

SEQ ID NO: 16596 - DNA, 591 bp, Zea mays
  Clone ID: cC-zmpo148047g04d1
cttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggggttccggaacgacgcgccgctgggccaagcccgcgcc

SEQ ID NO: 16597 - DNA, 540 bp, Zea mays
  Clone ID: cC-zmpo148047g05d1
cgcggttccctcgggcgtgcaagcggtggagatatcgggggcgggcggcggtggtgccccgaggtgggtgaccgacgccgacgctcccgaggcagcgggcaggcagcggaggttctcccctaagactgagtgatggcgacgctccagaggcggtcggtcaagcggcgacggcagtcccgagtcgaacgagtggcggcgtcgcaccctaggctcggtggtaacggtgattgtgcgaggcacgataggcttcggcagtgacggtggtggccatgggacacgcgggtagctccgacgggtgcgtgaggcgcggtcgtctccagcggtggtggccacatgaggcgtggatggctccggtgtccttcgatgaccaactccttcgatctgatggcctcggcggcggcgtcctccgatgaccttctccaattctttgtttatgcatgcggctgttggttgagcccatactaatttttcattacatatgacgtacggtgtacgtgtttatgcaactttatgtaacgatttatgttttgcatgatatca

SEQ ID NO: 16598 - DNA, 602 bp, Zea mays
  unsure at all n locations
  Clone ID: cC-zmpo148047g06d1
gcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtcaagcccaagccaggaacctacgttacaaggctcacccgcttctccggcacactgtcctgctgcacgggcaagccgtgctgaaggccggccggtgggcgtcagaggctgcttcttctagctcatggcctggccatgccaggtcgcgatggctgcgtttcatttcatggaagaaagcaaggatggatcacaggttgtcgttctgctaattaatctacgtttgccttcaagtactgtgttgtggcatcgttacacatcacagtacagtttggtcattttttttcccacagaggaagtanggattgatttaatcccacac

SEQ ID NO: 16599 - DNA, 535 bp, Zea mays
  Clone ID: cC-zmpo148047g07d1
atcaaggagatgccggtgctgcaggacgggccgccgccgggcggtttcgcgcccgtgcgctacgcgcgccggattcccacctcgggccccagcgccactgccatcttcctcacggccttcggcgccttcgcgtatggcatgtaccaggtcggtcaggggaacaaggtgcgccgggcactcaaagaagagaaaattgctgctcgtagtgctatactgccgatgctccaagctgaagaggatgaaagatttgtcaaagagtggaagaagtatcttgaggaggaggcgaggattatgaaagatgttccagggtggaaggttggcgagagtgtgtacaattccgggaaatggatgcccccggccaccggtgagctccgccctgaggtgtggtaagggcctgttgtaggcattgagaatgcaatcatgtcatgagggcatgaataaggctatcagacatgggcatccttctttgttcactaaggatcagctgttcaaatacctggatctattttactcttatgaaatctggctggttaat

SEQ ID NO: 16600 - DNA, 532 bp, Zea mays
  unsure at all n locations
  Clone ID: cC-zmpo148047g08d1
cccacgcgtccgcccacgcgtccgcagctagctagcgatggctggagcctgggcactgctcatcgtcctcgcggctgccgtcgcggtcctggccgcgcggccggcgtctgcaggcgggggagccgcggcggtggcggacatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctncaagaaccccatggagggaccacacaggtcgctcatcgagatg

SEQ ID NO: 16601 - DNA, 566 bp, Zea mays
  unsure at all n locations
  Clone ID: cC-zmpo148047g09d1
gtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctgcggccctggccacggcatcagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggacgtcaccttcaagaacatcaccggcaccttctncaccccggaggccgttagcctgctctgcactgccaaggtcccatgcaccggcgtcaccatggatgacgtcaacgtcgagtatagcgggcacaacaacaagaccat

SEQ ID NO: 16602 - DNA, 573 bp, Zea mays
  Clone ID: cC-zmpo148047g10d1
acagcccatgctgggatcctcccaaaaaccagaaggaagcgtctctcactcacagaaggtcaaggacttcgctggatggttacaggccagtgagcatgctggatgatctcagcgaacatgatgatgagaagtttacacacagcaggtgctctacgagtgtcttagaagatccgcgtctttaccagtacatcgaggagcgcgtggaagaagaaactcccaagaaaggaagtctgttccaaagatggttctgctcctctaaactaaggagcaacaggaggacacatgcacaggacactgtgccactatctggtgagaagaagaatgctcatccaaagctggagaagtggctgaccttcaaattctgagatggtgttgctgattctgtctatacacgctcctccgttcggcgcgtccagctgagaagaagacggcatggttccttgtgaactcattattgacggctcacctaggcaccatgtatcgctgagtatggtccgagccatgcttccttctaatgtcatgcgcctatgcagcggtagtatgagcaaatctgtctgtctcatgactgatgag

SEQ ID NO: 16603 - DNA, 417 bp, Zea mays
  Clone ID: cC-zmpo148047g11d1
ggccatccgctgcggtcagtgtaggtttctgaatcatagcttggcgatgcctgaggctagacaaatactgagctagccttcagaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaatattgatccgcttttttgtggacatgttatctcgttcaagatttcgtatataaactaatactttgggcgggatatataaatctgtctcactcatttatatcatatgtattatatatgcgtttttgttatgcaatatatatatgcagctcaatgcgt

SEQ ID NO: 16604 - DNA, 369 bp, Zea mays
  Clone ID: cC-zmpo148047g12d1
gccacgcgtccggtgccactacctctgctgctgtcgctgctggtcgccgtgctagcggtggccgacgatggcgacaacgccggccacaccaagcccctgacgcctggcgggcgtgtggtacacgacaaccacggcaagttgacggacgggccgtggaaacccgtccacgcgaccttgtacggcgggcgggacaggtccggcaccacggcggacgcgtgcgggtacaaggacacgcgcacgcaggggtacggcgtgcagaccgcggccgtgagcacggagctgttcggtgacggcacgggctgcgacgggtgctacgaggagcggtgcatggacagccatagcgggtgcaagccccacgcggcggcactg

SEQ ID NO: 16605 - DNA, 249 bp, Zea mays
  Clone ID: cC-zmpo148047h01a1
tttttttttttaatcttaacggcacgaggttccattacttctcaaaatagctgaggcctgtagcttctttcattgtttcaaagcattacaacttaagcagcaaaacctgaaactgccctcataagcaccacttattagggctgtacaacacaaacgatatgcgcggtgcacatcaagaatgaaccacaacatagagaagccatataaaagcatgattaagcacagcagaccaccaaaagcttcttactg

SEQ ID NO: 16606 - DNA, 602 bp, Zea mays
  Clone ID: cC-zmpo148047h01d1
agacccctgagttgatgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctttccgtgttcgtcgacacgtacggcaccggcgcgatccccgacagggagatc

SEQ ID NO: 16607 - DNA, 214 bp, Zea mays
  Clone ID: cC-zmpo148047h02a1
cagagccacttgaacttttttcccacagttctgttgaccacacaagtgagctgcccttcaccgtgtagttatatattatttgctagctgcgcagagttcccatcactcactcagacacatatacactcacgtactgcacattgtgatgtctgcgccgaatactcgtgtccagatatacaatggttgggcatcatgaggttgtcgtgagcggctg

SEQ ID NO: 16608 - DNA, 515 bp, Zea mays
  unsure at all n locations
  Clone ID: cC-zmpo148047h02d1
tgtactcggtgttccagttcgtcgcgctcgtcgagctcatgagtgaggaacaagcatttgatcccccatcgcaagcgtggtctcttcgacttcaccatggaccaggtgctagcataccttctgatatcgtcgtcgtcgtccgcaaccgctcgagtgagcgacctgatcgacaactgggggagcgaccctttcccgacgatggcgaacggctccatcgccatatccttcatggcgttcgcggcgttcggcgtctgctccctcatctccgcgtacaacctgttccgccgagacatgtagccgccagccgctctcgtcaacctcttgttgcccatccattgtatttctggacacgagttttcggcgcagacttcacattgtgctgtacgtgtgtgtatatgtgtctgtgtgtgtgatgggaactctgcactgctagcanataatatatatctacacggtgaagggcagctcacttgtgtggtgaacagaatgtgggaaaaaagttctagtggctctga

SEQ ID NO: 16609 - DNA, 553 bp, Zea mays
  Clone ID: cC-zmpo148047h05d1
gatccccaagaaggggtcgacctcctcctcctcctcctcccgcggcggtcgcgccgcgcccaacgagtgctgcgtcgtcgtggtcgagttccagcacggcggcacgctgaagacgctgctgtacaaccaccgcgacaagaagctttcctacaggaaggtcgtccggctcgcgctggacctcgccagagggctgagctacctgcactcgaagaaggtgatgcaccgcgacgtgaaggcggagaacatgctgctggaccggaagcggacgctgaagatcgccgacttcggcgtggcgcgcgtggaggcgcagagctgcgaggtgacggggcagacgggcacgctgggctacatggcgccggaggtgctgcaggggaagccgtacgaccacaagtgcgacgtgtacagcttcggcatcctgctctgggagacctactgctgcgccatggcctaccccaactacagcctcgccgacatctcctaccacgtcgtcaagctgggcatccggccggacatcccgaggtgctgcccgcggcgctggtggagatcatgacgc

SEQ ID NO: 16610 - DNA, 590 bp, Zea mays
  unsure at all n locations
  Clone ID: cC-zmpo148047h06d1
cgagccccacccgacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatccaccatggccgacgaggcgcttgctgtggatgaggggcccaaggttgacgaaccactcaaaatcaaagacggngaggagaagacggntgagagccaacacatcgaagaggagcatccgatgaatgaggatggngattcagccacggaacccctggaagcgagaccggcggtcgacgagca

SEQ ID NO: 16611 - DNA, 565 bp, Zea mays
  Clone ID: cC-zmpo148047h07d1
cccacgcgtccgcccacgcgtccggtcgccagcagccagcccatgtctggtggcgctcccgacgagcttccaccggtggccaagacctctgccacgcccgaaccgtacgcatctctgaacgtcgccggcggcgggcagcccaacgagccggcggcggggaggccgccgaagctgtcgatggagacgttctcggggatgatcaagaggccgttcgccaagttcctgagcccggtgatcaagagcgtgtgcgccaagacggagtacccggaggactgcgagtcgtcgatcgggggcctcccgggggccgcgtcggcggcggccacggacagcgtgggcgtgctgaagctggccatggaggcggtgcggcagaaggccatcgaggcgatgaacgcggccacggacaggatgaacgcgccgggcacggacccgacgaccaaggaggcgctcgactcgtgcacgtcgtcgtacagcgacatcaagacgagcctggagacggtggacgacgcgctcaagcgcggcgacgtcgacacggcgcacaccaacctcgactcggtggagacggaca

SEQ ID NO: 16612 - DNA, 392 bp, Zea mays
  Clone ID: cC-zmpo148047h08d1
agcacgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaaggccggcaccacctataagaccacactcagcatctaatcagcctctgatgatgaattatatttcaaaagagctcacctggcgctcacgttagcaagacaatattttttctatggttattttgtggcgccaaaccacccaagaaatatgtgatgctacatgtcccttatgatgccttgttgtgttgggttgatattattacataaactaaataaattattcatttaagatttt

SEQ ID NO: 16613 - DNA, 543 bp, Zea mays
  unsure at all n locations
  Clone ID: cC-zmpo148047h09d1
cccctccccttcccctgttcctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcgcggccgtgcggnggcggcacactgcagggaacggcagggaatgatagctagcgctcttaantgatcagctgatcagatgatctgccgncacgcacacgtcgtcttgtatgggc

SEQ ID NO: 16614 - DNA, 526 bp, Zea mays
  Clone ID: cC-zmpo148047h10d1
ctctacgagacggcgacctcgatcgcgttccctgtaatgccaccaccaccgtcatcaccatcgctcgcccggatcgtcaacatggcagccgccctccgtgtcgtcatcgccgtcctcgccgtcgtctcggtctctctccggcgcgccacggcggccacggtccccaccgtcgacgaggcgtgcaagcagtacaccaagtacccggagctgtgcgtcaagtccctgtcgtccgcggcgccggaggcgaaggcgaaggcggagcggggcgggctggcggggctggccgggctggcgctggcgcaggcggcgcagtgcggcgccgagacggtggcgttcgtcaagggcctggagaaaatgccggggggcatgccgcccgtgtgcctgaacgagtgcgtggccaagttccagggcgcgctggtcgacctgcagcggtccaaggtggcggtgcagaaggccaaggacgaggccgtcgtcgacacgtggctcacggcggcgaggctcgacggcgactcgtgcctgagcgact

SEQ ID NO: 16615 - DNA, 630 bp, Zea mays
  unsure at all n locations
  Clone ID: cC-zmpo148047h11d1
cggacgcgtgggcaagcacctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaggccaggaaggagaagcaggcgcagcanagctgaccgactgtccgtgcatgcgcgtgccaactaatataattattggctgatgatacctgatgatcagtgtgtgatcgagcaaggagacgacacttgcattctctacagttggcatagcggcatacgtcgggagagacactctcgactggccacaccatg

SEQ ID NO: 16616 - DNA, 612 bp, Zea mays
  unsure at all n locations
  Clone ID: cC-zmpo148047h12d1
ctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaacatctggcatcacaccttctacaacgagctccgcgtggctcccgaggagcaccccgtcctcctcaccgaggcgcccctgaaccccaaggctaacagggagaagatgacccagatcatgttcgagaccttcaacacccncgctatgtacgtcgccatccaggccgtgctctctctgtatgccagtggccgtaccacaggtatcgtgctcgactcgggagatggtgtgagccacaccngtcccatctacgagggatacgcnctnccccacgccatcctttcgc

SEQ ID NO: 16617 - DNA, 257 bp, Zea mays
  Clone ID: cC-zmpo148048a01a1
gctcgcccttatttttttccaataatttacaatttttccaagcgacacacaaataaaagggacgggttatatttttcatactatccaccccacacccaaaatacaaaccaaaaaattatatattttgaacacactaaacaccatctcaaaaataaatattatacaaacacccactatatatataatacaaccatttaacttaattagatcacaaacagatactcccactttcttattatacccacatatctacatcc

SEQ ID NO: 16618 - DNA, 177 bp, Zea mays
  Clone ID: cC-zmpo148048a02a1
aaaacaccggggcaagggtttcactttaaaaaagcagatcaaccacccccaaattgggaaagcttgatgcaagctttagcactttacaaaggaatttgcaaacccattctaatatttctcaactcagcgaaactgaggttattgcaaatccacacaaccatctttggtcaaaccctc

SEQ ID NO: 16619 - DNA, 200 bp, Zea mays
  Clone ID: cC-zmpo148048a02d1
cggccggagcgttgcccatcgatggttgtgcgatttgccatacctctcttctctgcgtcgagacatattagaggcggtgtgcaaattcctttgtgaagtgctacagcctgcatcaagccttccccacttccgggcggttgatctgcttttttcctgcgaaaagcttgcccccatgttttaataaacatgattgtgctatt

SEQ ID NO: 16620 - DNA, 398 bp, Zea mays
  unsure at all n locations
  Clone ID: cC-zmpo148048a03a1
ccccttcatatttatcttttccccccccctatctttatggggcttggtttaaatttttttaacctattgtccccctcctcttttttttttncaaaaaaaacttacaattttactctaatccaaactggtgaaaaaatttaataaaacacatttcttttatttttcaccccactttaaaaaaaaattttttttaaaattaacttctttaccctatattccaaataaattaacactttttttatccaaaccacccttcaacataaatacccaaccattttgaccatcctcttccaaaaaccctttttttcattttttccaaatttatctataccaccctttaccctttttaatttaaaaaaaccttttcccctcttttttaaaaaacctttttactaaaa

SEQ ID NO: 16621 - DNA, 515 bp, Zea mays
  Clone ID: cC-zmpo148048a03d1
cggcgtgattttgtgcagcgaaacagtctgaggagagactgatttttgtcgtgcagtgatcttgcaaagtggggggggggcatttcagagtctcctcaccgtatatcctactctttggcatgctagctgatcttccatccatcatagctgttctgcatcctgtgttccgatttgttctctcgtatttctagtgaaatgatttccaagatgaagtgcaaccaggttctccagcttccaaactgtcactggtggcttagctagatttaggagacatggacatcagggttttagaacgatgagcatcccaattgctcgtccatcctgttgcactgtggattggatagaccaaatgcttacttgattggaccataaggtcatcaagttgcctgtcacacaaatctccttcacaagtgaatgctaaaataacagaaatgtgtattatgcacatctcccacccatttgggatatgctaaacttgtaagttttgttcgaaaataaaaaaaaaaattcaaaaa

SEQ ID NO: 16622 - DNA, 448 bp, Zea mays
  Clone ID: cC-zmpo148048a04a1
atcgaccctatcactcgacttcaaggatgaggcttgttctcccaaactttacaaacccatcccgcattatctcccctacgatcgaatcgaagcaacatgaactaccctgaccccgtgcttaagagagttcctgttcctgccagcaggaggcaatgtcgacaggaacagcatctaccatccatcaggtcacctggttgttgcatcagcaggaacaggaccagaagggaagttcacccactgcacctgcagctgtatctccccgctctcgaccttcctgagcctgaagatcatgtcctgcgcgaacttgccgttcctccaacacacgtggctctcgtccgcgaggcacttcctggccctcggccgctcggacctgatgatggctccgttcctcagactctcctcccgcgggttcatgctcaccgcctccataagtggccccacgttcacc

SEQ ID NO: 16623 - DNA, 517 bp, Zea mays
  Clone ID: cC-zmpo148048a04d1
gtccggtggatgccggcgccacagcctctcctgctgtcgctgctgttcgcttttctagcggtggccgccgatgtgggcaaggccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctactaggtgcgctgcgtggacagccctagcgggtgcaatcccagcgcggcgacactggtggtgacggcgaccgacctgtgcccgcccaacgaccagcagtccgcggacagcggcgggtggtgcaacccgccgcgggagcactttgacctcagcatgcccgcgttcctccagatcgcacaagagaaggccggcatcgtgccca

SEQ ID NO: 16624 - DNA, 471 bp, Zea mays
  Clone ID: cC-zmpo148048a05d1
cggtggctgccgccgccggtgacagcggacggcgagctacctttcgttttctacgccgtcacgttttccttggtgggggcgtgcgtggccgccaccgtcgcgctcgcgtcgtccatgtgctcggcgtgcgaccgcaagccaaaggcggccaccaacgcggacccggctgggacggcctcctccatctccggtggtagcggcagccaggaggctggcgcggaggaggcagcggtagaggaggaggtggtgaggctgtcgccggagctggcgatgcacggcgccatcgagccggtggcgctgccgtcgtcgacctctaagcggcggctgtccattaacgtgagcaagaagctgagcctgaatatcccggacaagctgcggctgagccggcgggagcacaatgaccaccaccatcacaaggtggagtccgaggacacgctgtggaagaagggcatcatactcggtgagaagtgc

SEQ ID NO: 16625 - DNA, 373 bp, Zea mays
  Clone ID: cC-zmpo148048a06a1
atcaagcactctgatacattttgggtgtggctttacttccttttctttccggagatactgctatccatgccatgcgttcgctctgaatccttgtagttttgtgcaacatgtccgcgacgcccccgtggtatactttactgatcgtcgtcctcgtccgagtccagctgcttgagcagcgcggcccaaacggggagcggcacctccttgaagtaacctaccgccttggcggggcccaggctgtcggaaatgccaacgttcctggtgagcaagacccctgcgctttccctgagcgcctggaccttgtcacaatccttgcgcgggctggccaccaacaccacctggcagatgtcctcctcctggctgtccttgaact

SEQ ID NO: 16626 - DNA, 506 bp, Zea mays
  Clone ID: cC-zmpo148048a06d1
cgcgtctaccctcctccctacacaaataataaggaaatgtccttttttttcctccacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttctgcaccggcaagctcgagcgcgccatctactgggtcaccgacgcgaccggcacctacacgatcgagctcaaggacagccacgaagaggacatctgccaggtggtgctggtggccagcccgcgcaaggactgcgacgaggttcaggcgctcagggaccgcgccggcgttctgctcaccaggaacgttggcat

SEQ ID NO: 16627 - DNA, 391 bp, Zea mays
  Clone ID: cC-zmpo148048a07a1
attatataaattttgaaataaagttatatatataactgccatggcaatgattttttttagaacccccctccaatgatttgaaagggcatccatatcaaaattacatatatccattcatttgtactccttcactacactactatcgtatttgttcttatgaatttgcatttgatggtcataccacgaggaaaaaactaggccttcatcatcttaacgtgcggagccgtaatacagcagcatcaacaaccccaccaccttgccagaacggaaggcgttgaccagcatgttgtactcattgcacagtgatctcaccggcgagaccacacttatatataactgctttcccaaggtaataccgctcccaaatgttgaaatgcacgctacacatgcc

SEQ ID NO: 16628 - DNA, 267 bp, Zea mays
  Clone ID: cC-zmpo148048a09a1
aaagttaaaacccttattctcgcccccttttaacatttttttaaccccaaaaaaaacaccctaacaaaaactttttaaaaagaaaaataactccattatcccaaaaaacattaaaaaactcgaaataaattcctaataaaaccccaacttccaaaactttttttattttaaaaccacaacccttcttttttaaaactcctacaagtccacaaaaagggctttttattttaagaaaacattttcaccaggaaatttggacaccctttt

SEQ ID NO: 16629 - DNA, 355 bp, Zea mays
  Clone ID: cC-zmpo148048a10a1
agccagacgctgcatgaagaggctcggttaagactcttcttggacaatgaaccatctgtttttatgataataaatacaatcgtgacgaagctgacagccatggtgactctcaagtctcaacccaccaaaaaaaactcgatcacttccgtgtacttgtatgaagggaccattcactgccttgacagtagtattattaaaatcttcatttttttcctctctcacaagaattacttacacagccattctgtcaattccgatgaagtggcacttgtatcacaaagacgatcagaaccgtgctccctagttcctgccgtgcttgcctcaagctattaccctgaccgtttaagtaagccat

SEQ ID NO: 16630 - DNA, 314 bp, Zea mays
  unsure at all n locations
  Clone ID: cC-zmpo148048a11a1
acccnccccancttttttttttttcacagaacaaaaaaaacnggagccgcgtttttttaaaatgtgagaccgggcccaaaaatggttcccctatcttaccaggaacgaaaaattggccgaggaaccacacttttcggtccgtaattcgaagcatgcatgcatagcataagattgaccaaaatgcgtgtgtgccgccacgatatcattactcatgcattcgaagcagtgctctgccccaaggtcggcgctggcgctggtacccttgcgccataagctggggcatcaagaaaccggcccccctaagcgggggcgcc

SEQ ID NO: 16631 - DNA, 261 bp, Zea mays
  unsure at all n locations
  Clone ID: cC-zmpo148048a12a1
cttctaataaaaanaaaacgccattcacataggccncgtttgttattatcgttacatacgccacaaccaacatattcaataataaactgcttgcaagaatgcaatggaaagaacggatccctcttttacaataaaaggcatcgtattttgagtggcaccggtaacccaaacccgcgtcatcagacaagctcaaactgacccatcctcatatgaatcagaatcctatcctgaccatgttgctctgggcgctggacgtgccat

SEQ ID NO: 16632 - DNA, 367 bp, Zea mays
  unsure at all n locations
  Clone ID: cC-zmpo148048b01a1
aaacacaaccaccaacacaaaaaggganaggtttttttgtacaatcaaaataaacccttcccctctcgaccacgcaacgcgaatacattcctggatacgttaaatacagcgcgcgttgctcaaatacaatacactatagaattaataacgtaccacccaaactaaaacgcacctgactaacagattctatttattataacaaagaataaataaataaagcccagaagccggaacatgacctcgtgcccaaacggtgtgcaaccgcatcaaccacccttactgctgttgcttgctgccggtcatgccctatcaaaccttttttcaataacacttgcccatgacccccttccattttgcactccccgcc

SEQ ID NO: 16633 - DNA, 573 bp, Zea mays
  Clone ID: cC-zmpo148048b01d1
gtccgcgacaccaccgtgtggtcgacaaaataaaaaggagagagagtgagatggctctgtcgtctcgccgtatgggggccggaccattcttcgtcgtcgtccttctcgtcctcgtggcggcagagaggacgatgggcagggtggtggtggaagagacgctctgcttgtcgcagagccatgccttcaaaggcgtgtgcctcagcaacaccaactgcgacaacgtatgcaagacggagaagttcacacgctgcgagtgcaagatggacggcgtcatgcgcaagtgctactgcaagaaggtctgctagggcatgaccggcagcaagccccagccgtacggctggttgatccggttgcacaccgtttgggcacgcggtcatgttccggcttctcggctttatttatttcttctttgttataataaatagactctgttagtcaggtgcgtcttagtctgggtcgtacgttattaattctctagcgtattgtatttgcgcaacgcgcgctgtacttaacgtagccaggcatgtattcgcgttgcgtggtcgagaggccaacgatttatcttgatttgac

SEQ ID NO: 16634 - DNA, 405 bp, Zea mays
  unsure at all n locations
  Clone ID: cC-zmpo148048b02a1
ctgnncactngaaggcgtttacaaancgctagggatatgattttaatcccagggggagtccttccttctttgggagaaaagattagaagggcacattcctattcaaatttgaatagcaagaggattttatcctcctcaatccccttcctcacaaacgtacccttatgttttcaaactagacatgaggatttcatccttggtgttgatgagcttcgtggtgtgtcctacttgacgctgatgagcttaagggcgcattgtctgatgagaacctgcacttgcaagaggttgcatctgtacactttgttgctatgtcgcacaaggtaacttggtgctgcaaaaccatcatcagttcatcacatcacatatcatggaagaacttgcacgttttgacccctattcatgcaa

SEQ ID NO: 16635 - DNA, 548 bp, Zea mays
  unsure at all n locations
  Clone ID: cC-zmpo148048b02d1
gccgcacgcgtcggagtggtgtacaagccttaaaattacattttttgttgaatataagactgagggcagggaggaggatcaggagttcctcaatcaggcattgagttcgctccaatgtggtagtgatgggctgcagtgtatacaggagataagcaggcacttagcagagttgcgaagagttgtggctcactaaaatgaaaatggttttgccccgagttcacactttttggccgtcatgaggttctcctttgtaacggcaaacctatttgcagtcatctagatagcaggctgctttcagacgaagaagaacaggagctgcacatccttcctgtgccttctgacatacacgtctgcatacatggatatgatcaccgtcatcttcgtagcaatgctcttctctggggacttcgtatcagtctgctgtgcagatgggttctttaccctatggactttgtgctgcctgcaatggcacttatcaagacaaacgatgactgataacctanggttgcagtgtgcttggaagatgctccgctctgctgtcgcaatct

SEQ ID NO: 16636 - DNA, 558 bp, Zea mays
  unsure at all n locations
  Clone ID: cC-zmpo148048b03d1
cggttggcaagagaggagggccggcgtcggcgtgcctagctctttctttaaccatagctagccagcatggcggccaggggcagcatancagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcatgagatggagaaggcggtcgcggcggagaaggctgcccaacaggagctgctcaagtacgccaaggagaagggcatcgtgtcaccgaccaacggcacggggtggtacaagggcatcgcccgggagttcgtggacgcccacaacgagctccgcgcgcgctacggcgtgccggccatgaagtgggacaggaagctggcgcggcatgcgcggcgctggtccaaccgcatgcgcaaggactgcgagctcgttcacagcggccacaagtacggcgagagc

SEQ ID NO: 16637 - DNA, 397 bp, Zea mays
  unsure at all n locations
  Clone ID: cC-zmpo148048b05a1
agncaaactttgcaatattgggtntcggatggtactgactacacggagggactgttacaccttactcaccgagcatctgtactcaccgagcactgtttaaagtactttacatggagtaagagaacactggcaccggcagtgcaaaaaacggcacacgggtacatgcagaggccgccggtcgatacaagacaaacagcttttgtctttccggggcatgcatggcgatcgcgcgagcggatgcgcgtctttctcttcaaagagctcgcgccctgacaatgtccatgctcatctcgctggggtcggtggcctgcaactccagctggatgccctccaactccctcatgaaccggtccttggagctcgcgtacagcatcttgctcctgaccctcgaagtgtc

SEQ ID NO: 16638 - DNA, 611 bp, Zea mays
  Clone ID: cC-zmpo148048b05d1
cccacgcgtccgccccgtgtcccctccttctcgcccggcaccgtcgagctctgttgttttaacagaacaaacccatcaaccagtggcgggctcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtcagggcgcgagctctctgaagaggaagacgcgcatccgctcgcgcgatcgccatgcatgccccggaacgacagaagctgtttgtcttgcatcgaccggcggcctctgcatgtacccgtgtgccgtttt

SEQ ID NO: 16639 - DNA, 346 bp, Zea mays
  Clone ID: cC-zmpo148048b06a1
atagcaaaaaacaaccacgaatggccttgttataaaatcatatatataccctgccctacacgcgtgcctttcaagtcttaacgagccgtttcatcccacggtctcaagacatgtgccaccccgcaagaggcaacacctaaaagaaggacacgccctaggtccgtatgaagtctgtatgcgtccagtctatcgactgacagacacacgcgaccagcttcaaattacatatgttttatgccggacgacgacgaccactaccaccttacctaacctaataaggggttcggaaaaagaaacaaacaaatcaatggacatgttcgtaagggatcatgttggagagcgtgcc

SEQ ID NO: 16640 - DNA, 567 bp, Zea mays
  Clone ID: cC-zmpo148048b06d1
cgtccgctgaacctctgcaagacctactacctggacgccgccgactatctctttttcctgcaagcgcgccatcggctggcgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtttctttttcccgaccccctactacgttcggtaacgtcgtcgtcgtcgtcgtcgtccggcctaaaacatatgtaatttgatgctggtcgcgtgtgtctgtcagtcgatagactggacgcatgccgacttcatgcggacctagcgcgtgtccttcttttcggtgttgcctcttgcggcgtggcacatgtcttgagaccgtgggatgaaacggctcggtgagacttgagaggcacgcgtgtagggcagcctatatatatgattctataacatgctaacttgtgcttctttattactatt

SEQ ID NO: 16641 - DNA, 448 bp, Zea mays
  Clone ID: cC-zmpo148048b07a1
ctcatagatacataactcatagaggcaagggttattataaccaggagacaatgttctgagcggcgaaataccaattatttcgcccgcacgcacacctttaatattctaaaacaccgctctttccaacgtgtgagtttcaggccttcgtcgcccgtcggagcagcaaacccgcagcgcatttacacacatcatttacagatcgaggcgaggatgcgacgcggtggctcgaacgagcgccgggagtgcaggacggcccaattgtcgataaggaggatgtctcctctctgccatggcacggccacggactcctcctctaggacctggccgcacgcgtctattacgtcagcaggcaggggtgagccatcgccgaaagtcaccgtcttcgtggggtcgttccgggcgtccttccacccaatgtaagcggcgacaatgctgttgaaccacatct

SEQ ID NO: 16642 - DNA, 242 bp, Zea mays
  Clone ID: cC-zmpo148048b08a1
cttaacgccgccttttttttattttttaccatccacagagccatgacgttgtttaaaaactcccaaaatatgaacatcaaaagtattgtacagctgccatcaagtttctcgacctatcccttccaacttaaaatcaatgtcttctctctaccacatcatagatataccaatatttatactgcaccgctcacgcagcgcacttgctccctctttccttctgcctctacgtctttttccctcac

SEQ ID NO: 16643 - DNA, 282 bp, Zea mays
  unsure at all n locations
  Clone ID: cC-zmpo148048b09a1
aaccaacaaactaaaccatggnacgcacagtttaatgccacgtcatatcgacaacccaacctgccgatcatatatcatcttccttagatgtcagtgtatcctgcccgattgctgctgcggcaacagccccggaatgaatggcacgcctagctgtgggagccagtgctggccctggatgaaactctcgacggtgtacttctgcagcgcgtgctggtaggtgatgttcttgatacccctccacttgacacgtctggtcattttggcgcccggcccgttgctttt

SEQ ID NO: 16644 - DNA, 217 bp, Zea mays
  unsure at all n locations
  Clone ID: cC-zmpo148048b10a1
agtaagttctatctagnaaatattatacaggggaaagcggttcaatctacaggtggtcaaacaccccaatctacaggttggtcaatgtacacattatttctttctttcggcggtacagagcagacatgcctaaatgatcactctcgcaatgacaaacagtacagctttgtcaattgtcacagactaacaagaacatgtatgtattggtacagccgcc

SEQ ID NO: 16645 - DNA, 449 bp, Zea mays
  unsure at all n locations
  Clone ID: cC-zmpo148048b11a1
gagcggccgccccnnnnnnnnnnnnnntttttgttttatanaagaaccagntcattacggcatggtataggaaaattacagaaacgggacaaaacttccacattccaaaggccattggagcgttgcatgtccatgcaattcacgctacagcaaaatggtcgagtcaacctaaaaaccaagcgaactaattaaggcgagtcaccaattgctagatatcttaaggcggggaggaaaaaaacccaaacaaattccccgggaagaaaggccttgccttcgtggtacctataatggaaagtcaaaattaaaacccttcttcttaaacatgcattccagctgttacttaatatttacatgccctgttcaagcaggtagtcgcccagcctttccaccaccatgttgcactgcccaggccttatcggctcgtcgtagatgccaaccacgagtgcctg

SEQ ID NO: 16646 - DNA, 212 bp, Zea mays
  Clone ID: cC-zmpo148048b12a1
ataaccaaaacctctcaccccccaacccattaaagattcgtgtctcttccctttgcttccatctcaaaaagaattatcctgtggcaattcctccctacctttgccggtggtttcataccactttttcacccaggacttattttttcccaacaaatgccttggccttcgcctctgtgaggtccagcacccaccccaccctttttttctttttg

SEQ ID NO: 16647 - DNA, 305 bp, Zea mays
  Clone ID: cC-zmpo148048c01a1
ggccggcttgtccttcttgtatatcatgttggcgcccttcttgcccttctccgtcctgttttacttctactcggcgccaccctccccccctgtagtgtcttccatggaggaggtggccgaaccgcgagagcagtgctgacgtctcttcctgcgcgtggctgaggacggcggtgagtccactcccccgcccgcctcgcttttcgtgtccctgaaggaggtctctactatgcttgctccgtccatgaatatttttaagagaagcccaaagaattacagtagccgtgcccccactctcactcctaaat

SEQ ID NO: 16648 - DNA, 445 bp, Zea mays
  Clone ID: cC-zmpo148048c01d1
cgcacggatgtaaaacatgtggcgcacatcggttgggatggtttttgtttcaccaacagcggcagcagcaacagcaataaggccggtaggagctcctagctggatgaaggattaccactcggcgccgctcgactcgtcctcctttaggagcgagagtgggggcacggctgctgcgaatccctgggcttctcaagagatagtcatggacggagcaagcatcggagagacctccttcagggacacgaaaagcgaggcgggcgggggcgacgactccccgccgtcccccgccacgcgccggacgagacgacagcaccgctctcgcggctcggccacctcctccatggacgacaccaccggcggcgagggcggcgccgaggagaaggagaagaggaaggagaagggcaagaagggcgcccgcaagaaccgcaagaaggacaagccggcc

SEQ ID NO: 16649 - DNA, 545 bp, Zea mays
  unsure at all n locations
  Clone ID: cC-zmpo148048c02a1
ttcaaacccttcatatatttatctttccacccccaaattatcaatgggcanagtttaattttaaattaccgttcccccccccccccgcgaacaaaacctaaacaaaaaacaaaaaaaagtgccccccaaacattaataaaccccctaaaatatccaaaaaaaaaaaaaaacttcccaacccaacaaaaacaacccacaaccaaatgaaaaatccatttttaaaaaaaaaaaaacacacccaaccccacccaaaagccctaaaccctcaccccccaaaaaaaaaaaactttcccccccaattcccaaaaaaaaataaaaacccccaaaacaccctaaacaacattcaacccccgttaaaaatcttccccatctcaccctcaaacaaaaccccttatccccaaatttttaaaaaatattccccaaaccttttccctaaaaaaaatataaaaaaaaccaatccctttaaactaaaacccccccaagccccttttttttaaaaaagacacaaacccccccccaaaaaaaacaaatcccacaaattcctc

SEQ ID NO: 16650 - DNA, 556 bp, Zea mays
  unsure at all n locations
  Clone ID: cC-zmpo148048c02d1
cggaaccaccaccgtagcaccacacgcaggtacgaagaaggttacgtttatggcgaggctggccttggtaggggcgggggttctgtgccttctattagcgacagggccgcagggggccgtcagcgccgaggggatggtgtcatttgacaatttgatcagctgcaaggtactgggcaactgcgataagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggccttagcgtgtggtgccccctgtgtgtatatattacacacatgcattatacattggtcgtcgatcgttactgtatgcatggcaactgatgtttcttgcttcgcatatctgaggtgtatactgatgtatggtggctcaacttttgatgattaaggataagtatgccccccnnntaaaatttataacaattttaatttttaagattaatttttttttattttt

SEQ ID NO: 16651 - DNA, 323 bp, Zea mays
  unsure at all n locations
  Clone ID: cC-zmpo148048c04a1
gtataatcttatcatgcacnagaaacccatctcgggacagggttcttttacattagcaggatctctccctacaatcaaagcaacacaagtggccttaattttggcattctttcaattcaccatcatctgaaaaagagcaccttttatataattaaccatgcacacctttgctttcttaacaaacaacacacatctatctgattgatggatcgtgcactgagtccttctcctcttcatccatcaaaattcaccatggccctctgcggctatctctttcatctggcctcttttttctatgacaaccttggccttgggcactcctt

SEQ ID NO: 16652 - DNA, 294 bp, Zea mays
  unsure at all n locations
  Clone ID: cC-zmpo148048c04d1
gggaaaaggtagcgaagagnagagagagagacgccaggaccgcccttcgacgtttcgaggaggganggaacccagatacggcggcggcgggccgtatcgatggcttgccgcgcacgctcactccggcggcgaccgtgcccctgtgcctcgcttcttcgccgcggccacgccctgtgcgctggcccanncggggcgccaaggggaggaggacccatctggtcatnncggtcggcggaccctgtgaccaagggtcaccggctccgagaccctnttcttggacccatcgacgaatcg

SEQ ID NO: 16653 - DNA, 300 bp, Zea mays
  Clone ID: cC-zmpo148048c05a1
ctgtatacttcgccttcttttctttcggataagagattcatcttcatcagaatcgtcacatccttcttcttcttcttataagatgtatacaccttaaaatcatcatacttctccttcttagaagacgtatctacatcaaaatcatcagactcgtccttcttttccttctttaccatcttcttcttcaccttcgccttttcgtcaggaactatagcttccacatatttatcgggaaattcctccgccttctcgtcaggaactagagcttccacttattcttccccttgttcatcggcagca

SEQ ID NO: 16654 - DNA, 354 bp, Zea mays
  unsure at all n locations
  Clone ID: cC-zmpo148048c05d1
gagaaacccttggtcaagaacaagctgaaacggccacggctacgctgctgccgatgaacaacccgacaggacgtggaagctctagttcctgacgagaaggcggacgaatttcccgataaatatgtggaagctctagttcctgacgacaaggcggaggtgaagaagaagatggtaaagaaggaaaagaaggacgagtctgatgattctgatgtagctacgtcttctaagaaggagaagtctgatgattctgaggtgtctacatcttataagaagaagaagaagaaatctgacgattctgatgaagatgcatctcttgataagaaagaaaagaaggcgaagtctgcancatctggc

SEQ ID NO: 16655 - DNA, 452 bp, Zea mays
  unsure at all n locations
  Clone ID: cC-zmpo148048c06a1
actcatcacaaggnccccctttttttgcttcgtcagtataaacattcaatataccatcctacaatcagggagtgtgcagtgctaatcactacacacgctgttaagtaacaacacacaagtatacaacaacggtttgctgaaggccttcagctacagatatatataaatccccatacggggataacaaagtcagaaagaaaaacaatcgtttatgtgaactcctcatgtcatgtgagcgttcctaaaagggcgacagcagaagaatgtgacagttttctccctctctctctctctctcttccctagcttggnccatccacaccattgctcaaactatcattgtgacctttctattgctgattatctgttccagtctctgctgtagaataacatcaatacagggtggcacatgcattttctcggactgctggcagaaatatacactccttgtgc

SEQ ID NO: 16656 - DNA, 544 bp, Zea mays
  unsure at all n locations
  Clone ID: cC-zmpo148048c06d1
tccggcgggagcggggcgggcaccagaagcagacggcgagcgatcttacatctctcatctgcccgcccctctccgccggcgagcctctccccctctcctctcctctcctcccaaaacaagagcagcgagacgcgcgcgcgcgcgccacgagctggtggaacctcgccgcctcccgcggcagatctcgcgccgagccctggtttcgacgcgagatccgcgcccgccgtccgccgctcgccgcctccgtcccggagcattaccaggattatacttccaccttgaagatggcgatcggattactagcgtttgagagccaccaggggctctggaacagcggatactattcacagttgtttggaattggaggagttctcatcactcttaccattcttatgttatccacgggctactttgggggaattggtgccccatttgctccatatttctggccgtatctaggacaagttccaaagaagagggaacgcanaaggcctgtgagagtgtacatggatggatgccttgatctcatgcactacggccatgc

SEQ ID NO: 16657 - DNA, 297 bp, Zea mays
  unsure at all n locations
  Clone ID: cC-zmpo148048c07a1
aaccaccaaangactttgtatgggaatgggaatccattaacagtatcatcgatacttcaactgtgaaaaatcatgtattggtactgtacgtgtccatggatctttaatggccacaggtgccatgaaaataataccgcacaggattagagggggtttcaatgagtgatcgacatgccgacggacacattgatcattggccgcaaccgttcatccttcattggccggcgaggcatccaggacgccatgcgacgcatctgttcgcgcctattggcagtccgccaacaggcactggcaata

SEQ ID NO: 16658 - DNA, 237 bp, Zea mays
  Clone ID: cC-zmpo148048c08a1
atacgaatgttgggagcacctgggacatacatggataggtacacatttgagatggagacgattatctctcgacaatggtacatcttcaaaagaatatactactacctaccaccttctttctttcctttttttttaaagaagaacaacagcgatgcgctatctacccgcctggtgagcaagctccaatcaatgaacagaatggtacactttcctagacaagtctgctaacagtgtgtg

SEQ ID NO: 16659 - DNA, 456 bp, Zea mays
  Clone ID: cC-zmpo148048c10a1
atcacaataggataacatcccgtggggttagacaaaacatgggcgcgtctacggcctcaaacagatcgattaccggcgtatatgtattctgacttgcgaaacagttgctgcgactagggctctaaacgaggagccgtccccagccaacgccaacttaacttgttgctgaagcctgcgacatttgcctcttcacagcttttttgtatgtcttgtgctggtacgtcaatgttgtcttcagcacatccttgagaggcgtctttgggttccaacctagctggtggtggattatagtcatgtcaagaattcttttatcactgtcatcgtatccttcaccgtagaactgactcgaactcacgtcgatcataggcttattcaacggcgcctctcctgagacgtttgcatagacctctttcatcatttgggccaacttcctaaccgtaaccttattgttaggat

SEQ ID NO: 16660 - DNA, 454 bp, Zea mays
  unsure at all n locations
  Clone ID: cC-zmpo148048c11a1
cttcacctgtatatgnaaaccnnatatccacgggtcggatctattgaacagtgataatgccccccccacagagagcaggaatatatggagcatctgaaaagaagttgatattggtcacaaacgaacagctgctattcagactagttacatcaggaggaacagattggatgaagctagagtttacaaaaatcatattgctccatgggtctgattacgagacagcgagcaataccagtgatttggcaggtaggattaggaataccatgccaccggatgacatggcatcggcttagattaagagacaacgaggtgctgtctcattaatcttaatattattcatgggcaaaaatcccatggcgacggaccagggtttgcacattatcttcgccctgcttgcctcacaactttgaaagcgcaatgtccataacctcaatgaagaaatctgaattctctt

SEQ ID NO: 16661 - DNA, 308 bp, Zea mays
  unsure at all n locations
  Clone ID: cC-zmpo148048c12a1
catataatcgangaaaggatccaaacggatgggttgcttttaaatgatacaagtgcccatccctcttttaggggaagaacatcatctgcatgcatcaattccttaaattaaggataaagagggaacatacaaaaatatgacaaaaggtgtgtctaatcaaaaaacatgcccactcattgtaatgcgcacatccatttcactctctctccccttcatctcttactcggcctccaggcgccccggcctgctcacttaatgtattatgccaaaaaagatcctacggcggccccgagggcggctcctactgc

SEQ ID NO: 16662 - DNA, 328 bp, Zea mays
  Clone ID: cC-zmpo148048d01a1
atcattaacattatgtaatgtgaagacaggtttactctatcataatgaataacttccaacattgtgaggctttggtttaataataattacatttgttggttttgagattatcctaagaagaaatataatacataccaccgaattatatattcgacggagacttgatagttcgttataaagaaaaaggttacaaaaagttattatatatataatatatgcatgttagacaatcttttcacattcagacgatcttctttgccaagccgatggacttgacaatagctttcttacagacggccatgttcttattgcctcatccatatatctt

SEQ ID NO: 16663 - DNA, 571 bp, Zea mays
  Clone ID: cC-zmpo148048d01d1
cgggacgagaaggacgtggaagacgtgcaggtgacggggttctttatcttcggcaccacgaacggcctgcgcggcaaggcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaactacgtcgtcttcaagaacatccacggcacctccaacacgccggaggccatcacgctcaactgcgccaacaacctgccatgccagggcgtgcagctcgtcaacgtggacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactcttaagtctccaccgaatatataaatccgctggtttgcatcttctttcttccttggatcatcacaaa

SEQ ID NO: 16664 - DNA, 434 bp, Zea mays
  Clone ID: cC-zmpo148048d02a1
tcctcttagcgcccgccctttttttttttttgatatatgtttttcttcatttcttatcccaaaaaagaaagagctcaatctctttaaaaaattaatcacaaacaactttttcacttcattattatcacccttttaatatctcctccaaacaataactagccaacaacttcctccacatcttgcacctcatttcaatacccttctacaactgcttcgaatcaaaactcgcggtccaaccccttcggcccatacttcgtcacatccttaccctcaccaacgtccatcctggccaccgtcaccgttagctttctcttcacccgtacttatttcatcctcaccatacttttccgtcgacacctacctttacccgcgcaccgcctcgccattccttatcatcctttctctcccaactggctctcccctctgttctttca

SEQ ID NO: 16665 - DNA, 577 bp, Zea mays
  unsure at all n locations
  Clone ID: cC-zmpo148048d02d1
cgggcggcgtacgtgctctagctaaccgtancgtcggccgtctgtcgtgttggcagggcagcgggcaacggggggcggcaccggcttggacaggatcctggccatgtccctcgtcggtgcggggccaggcaacgtcttcggcccgggcatgagcgccggcgcgctggagagcttcgcacgccccgcggggcgcgccaggacggagcgcagcggcggcaggggtggcgcggcggcgcgcggcgcaaggtcggcgtcggcggataagtgcggcgccgaccacatcaggacgggtgcggcggaggctgaccgtgccggtggccaggagggacgcgccggcggtgcggacgcgacacggtacggcccggcggcgttggaccgcgggttctgcttcgacgccgtcgtcgcaacgtactgacatgcgcgccgccacgtggcgcaagttctcggcgagttcttgtttggacgcgatattaagaggacgacaataccgacgccaactacttctttctcattaatttctcaagcaggtcgggttctttttttttgtgaaaagaaatgaagagagtcctttttaaaa

SEQ ID NO: 16666 - DNA, 381 bp, Zea mays
  unsure at all n locations
  Clone ID: cC-zmpo148048d03a1
gcacacatatacgcganggttaaggtgagttgtttaactggtccagacaaatgccaagcaatggtacaggtgttcatccctctctcgagggaaagaacaaataacggggcaccaaattaaactggtacatcagcgataccaattagttaaatgaaaatcagaaagaggaaaggaaaaaaacaaacaaaaggaagacgaaggtgtgccactgccgtgcccaatcagagcacacccacccacgcatcgggaatgcgcgggagcagcatagcagcgcagcgcagccaagtctctcccccccttggtctcttccctccggcagtccggctcctcgtccggcggctcagtgaatgtagtacgcgaagaaggaggccacggcggccc

SEQ ID NO: 16667 - DNA, 544 bp, Zea mays
  Clone ID: cC-zmpo148048d03d1
cgcgtccggcaagcgatcgtcggagcagagagagacctccttttctccatcccatcccgccgccgccggctcggcggtcgctaataagccgccgcatccagggatggagatgaagaagatcgcctgcgccgtcctcgtcgccgcctcggccaccgtggcgctggccgcggaggcgccggctccgtcccccaccagcggctcctccgcggtcgcacccgccatcgtcggggccgccgtggcctccttcttcgcgtactacattcactgagccgccggacgaggagccggactgccggagggaagagaccaagggggggagagacttggctgcgctgcgctgctctgctgctcccgcgcattcccgatgcgtgggtgggtgtgctctgattgggcacggcagtggcacaccttcgtcttccttttgtttgattttttcctttcctctttctgattttcatttaactaattggtatcgctgatgtaccagtttaattttggtgccccgttatttgttctttccctcgagagagggatcgacacctgt

SEQ ID NO: 16668 - DNA, 516 bp, Zea mays
  unsure at all n locations
  Clone ID: cC-zmpo148048d04a1
ttctttttttttaatttgcttttttncggncagnggatcgcatgnaggcgggggcatcctttacatctggctatgtctaacccatgtattctattggaatagtaaattttacttccagagcaaaggacaatgccagagggcttgctacttgacgaactttgtcaagcatgcaactggtatatgtgatctccttcaacccttatttccaccacatccagtaatcctgcttttgcgttgtctttgatgctgtttacttgacgttgagggtgtggtacttcagtcagtaattgctgcttggaaactactttcttgtttcataaagtatctttgcacactttttgactgaggctgctgaaattctctgttgagtaacgtctagaagcgttcctccagtcccatccacttttcatcatcaattcaaactctgggtaactgatgcgaccatccttatcctcgtcaacctcttgaataatgtcgttaaccaaatgctcaatangctttaattcaccattactt

SEQ ID NO: 16669 - DNA, 566 bp, Zea mays
  Clone ID: cC-zmpo148048d04d1
cgcttgacccacatccttgtacacggttgacggcaaagcaagttcttgttctcccttggctcaagaatgctgagaaggcgtcaaatgtgtcactcggagaggttgttccgtcgaggctgaagcagttgtcgtctatgaacaagcttaagaagaaggcacttggagtcgtcgccatgaatttaccgatggaagagattggcaaattcaaagagatgttccatacaatggacaaaaacaaggacggtagtttgtcacttgaagagctgaaggagggtttccggataaacgatcatcctgttccagaggaagagataaagatgttgttacaagcgggcgatatacatggaactgacacattatattgtgaggaatttgtgacagtcttgcttcacattaaaaagatgagtaatgacgagtatctacctaaagctttcgagttcttcgacaaagacgggaatggttttattgaaatgtccgagttaatggagactctaagtgatggtgaactaaagcctgatgagcaattggttaacgacattattcaaaaggttgacaaggaataagat

SEQ ID NO: 16670 - DNA, 278 bp, Zea mays
  unsure at all n locations
  Clone ID: cC-zmpo148048d05a1
ccccccccccccccctttttttttttcgacacnnccaacacgaaaacnggcaggggcagatacccaatggaactagtgtccctccctagagataaacaaaaggttaaagcaaggctaaacaccatggctgaaataattaatgccttccatcgcgtctcggcgctcccatcatcctacatcacttgaactgcttcacaatccgttctcctttcaagtcagcacagcaccacaacaagcttccattcatcatccacagaaggcccacttcttctctttgt

SEQ ID NO: 16671 - DNA, 522 bp, Zea mays
  unsure at all n locations
  Clone ID: cC-zmpo148048d05d1
ctccctccctgccagccatggcgacnccggacaacatttggcatgttcatccgctgcccaagtttngggaggggtacgtgaagaatccggccacgtcccatggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatcgaagctcgctgtgctgctgtgctgactcgaaaggagaacggatcgtgcancatctcaagtgatccaggatgatgggagcgccgagacacgatggaaggcattaattatttcagccatggtgtttcgccttgctttaaccttttgctcatctctaccgaggaacactagttccatcgggtactgaacctgcaaatcttcatgatgaaactgtcgcatcattaat

SEQ ID NO: 16672 - DNA, 405 bp, Zea mays
  Clone ID: cC-zmpo148048d06a1
ataaaaaatatttgcttaataatgggagggtgttgttcaagcgattgacgctacacccaaatgatcgaaccaacccccaaaaaaaaagaaactgaactaaagcgggtcatcgtaactgaatattcccagcgcaacaattggtatcttgtggcgcggacaagagccgctcaagcaaatagggtaggtaggagggtcttcgctttgttgttattattactgaaaacgaagttggaaccagcaacatcatcaacatgcattccaggggaaggggttgtcattacatcccctgttcgagcaggtagtcgcccatcctttccaccaccaggttgcactgcccgggagtcatcggctcgtcgtagatgccaatgatgagtgactgccctgttttcttcacagtgatgcccc

SEQ ID NO: 16673 - DNA, 426 bp, Zea mays
  Clone ID: cC-zmpo148048d06d1
agaagggatccgggggcatcactgtgaagaaaacagggtattcattcatcattggcatctacgacgagccgatggctcccgggcagtgcaacctggtggtggaaaggctgggcgactacctgctcgaacaggggatgtaatgacaaccccttcccctggaatgcatgttgatgatgttgctggttccaacttcgttttcagtaataataacaacaaagcgaagaccctcctacctaccctatttgcttgagcggctcttgtccgcgccacaagataccaattgttgcgctgggaatattcagttacgatgacccgctttagttcagtttctttttttttgggggttggttcgatcatttggctgtagcgtgaatcgcttggacaacagactccaattactaagcaaatattttttcttctgcatat

SEQ ID NO: 16674 - DNA, 369 bp, Zea mays
  Clone ID: cC-zmpo148048d07a1
atctaaaatttagttacgctatattaaacattccgaaggagtttttattgttacatctggaaggacatcctcctgttgggcggcttgtagaactggacggtcctgccgttgagcggctgcgtggggcgcgcgtcgctcccgggcagcggcgccttgagcagctgcagctggtcctggctgatctggcgcaccttgccgaggacgctccagacgaccttctctgtgcatggcggcacggtgagggagcccgtgtagcggaagtagctgccggtgctcttctgcagccagcgcatgtggatgaggccggccttcacccgcgacttcttctccttggggaagtcgcaccggtcctgggccatctcgcccagc

SEQ ID NO: 16675 - DNA, 305 bp, Zea mays
  unsure at all n locations
  Clone ID: cC-zmpo148048d08a1
atgtatgaatctacaacactngagtgacttggncggcatggtatgctttccccaactgtacattaatatgcaacacatgaactaccctgactgacccagaccccattaagtttacaatccgacattcacaagaggtgaaaatgcgattgcttcgcgtcgcctgttcttccttccttcacctgctggctgcaacaggagggatgctgacccactgcagctgcagctgaatctccccgctctccacgttcctgaggcggaagatcatgtcctgcgcgaacttgccgttcctccaacacacttggctc

SEQ ID NO: 16676 - DNA, 401 bp, Zea mays
  unsure at all n locations
  Clone ID: cC-zmpo148048d09a1
gttccccnccacccngaacagangaacaagatctttttacacacaatgtttatatctgcacaagacatcagtaagctccatcacatgaacatgaaattagaaagaaaaaagaaactacgtgttccagcctccagtagcacgagatgtccaatccattaaacgcgcaaaaaaaaatgaagtctgtttgagtcagtggacaagcccttgcatcgtactgtatagagttcagcttactgtcaatcccaaatcacgaaagctccattctaatttccagcaatagcagtcaatgtcaaataatcgtcatcagaagcgccactattcccagacgcgcagcggcctttatcctgccggcggctgaaccttctggcgcgtcaaccgcctcgtcgctactcttcttatgc

SEQ ID NO: 16677 - DNA, 496 bp, Zea mays
  unsure at all n locations
  Clone ID: cC-zmpo148048d11a1
ataaagtaccanncattacttcattttataggaaagatacataaacgggaaaaaaaaatcccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcttcgacatgcatggcagctggtacgtagtagttacatgccctgttcaagcaggtagtcgcccagcctttccaccaccatgttgcactgcccaggcgtcatcggctcgtcgtagatgccaaccacgagtgcctgccctgtcttctttacggtgatgcctcctgatcccttcttgccacggatgacggcaccaggcttcgcctggatgaccatttactt

SEQ ID NO: 16678 - DNA, 418 bp, Zea mays
  Clone ID: cC-zmpo148048d12a1
cttcttctcttttaacttccgcgtcaacgcaggggcggttacctattacataagatatgcaccttacccaattggttcaaatgcacgccagctcctttgccaagccgatggacttgccgatggcattcttgcaaacggccatggtcttgttgccgcatccattgtacttgatgtcgaccttgacaaactgcaccccctggcatggcaggttggtggcgcattttagcgtgatggcctccggcgtgttggaagtgccctggattttcttgaagacgacttccttgacggccaccttggaggcgccggacttgacacaaattttgttggggcaatacttttggtcgatgatgatggggtaagagacattgtccatggtgatgccctcgaacaagaacttgctggcctttagcgacgactt

SEQ ID NO: 16679 - DNA, 336 bp, Zea mays
  Clone ID: cC-zmpo148048e01a1
agctgatccttaagcggcccccttttttttttttttttttaccccgaaccaaacaggatgggttcatttacaattctacacctacactcctaatcactaaaaacaactttaaaaaaatcatacacaaaggtcaccttttttatctttaaacacaacacaatacttaaagacatcaccatccaaattcttaagagtacagacgttgcccaacgtaaagctcacttctaccgaatttaagtggattctgaacacaaataagccaaagctatagcacacattttggctgacgcacatctttttcacaaaaacaatggcacaatggtccgttaaacatcc

SEQ ID NO: 16680 - DNA, 558 bp, Zea mays
  Clone ID: cC-zmpo148048e01d1
acccccgcgtccggcgccagatacctgctgagcaacggtttcaggtgcttcaactcgttcaagagcaactgcgaggactggggggtatactgcaagactggccttcttgtcgctgagcagggcgttgtcgggcagagcgggcaggctatctccatcatcggtggacctctcgccgcggtggtctcgaccccattccgcttggttaccacgaacatctatgggatggcggtgatggccgtcggggtgtactgcgcgagcaggtatgcagctgatattggcaaccgccgtgatgtggtgaaaatggaagtcgaggacctgacggccggactggccagcggcaggatatgtgctgtggaaaacatcgcccagctggtggctccggaggcagaaggcccggccgatgccacggccacggccacgctggctgcttaacggaccattgtgccattgttgctgtgagagagatgtgcgtcagccacatgtgtgctattgctttggctattttggttcagaatccacttaactcggtcgaagtgagctttcccgttcgcaacgtct

SEQ ID NO: 16681 - DNA, 540 bp, Zea mays
  Clone ID: cC-zmpo148048e02a1
ggatcctcttagcggcccccttttttttttttttctttattaaattaaagctcttgttatggggccagataaagaaaaaatgtactgtcctgtttgaaacaaatgaaccatacattcattttcatcagcaacccacttggtcaacaaaggaggtccagcatgttctagagataaattgcgtctattcaagaaactagaacattaaccgccacggcaaagtgcaaagttaaaatgttgcttaatatacccattggcatttggacatcatgactttagttgatcaaatgccgtcaaaagactggtcttgtaagtttggatctcaccatattcttgagagtcgggagtggaacttactatagcgtacgcgcctaccttgttcaaaaatcctgcatcttctttacattttgaaagcgcaccaagagcttttagaagttcttttcgtgttttatcatctttagcaccttccaatacattaagccagttttgagcttcccctattttaccaccttcattcttctttggtcatccttcaaaacaact

SEQ ID NO: 16682 - DNA, 607 bp, Zea mays
  Clone ID: cC-zmpo148048e02d1
cgtgcgcccacgcgtccggaagataatcttcctaggaactgtctgcttagttggttaccaattctttccatggatgggtgataacctgcttcaacaatctatctcgcttttgcgtgtcaaggatcccttgttcaagcggatgggagcttctcgtttagctcgttttgcagtggatgaccaaagaagaatgaaggtggtagagatagggggagctcaggaactgcttaatgtattggaaggtgctaaagatgataaaacacgaaaagaaactctaaaagctcttgctgcgctttcaaaatctgaagaagctgcaggatttttggacaaggtcggcgcctacgctatattcagttccactcccgactctcaagaatatgctgagatccaaacttacaagaccagtcttctgacggcatttgatcaactgaagtcatgatgtccaaatgccaatgggtatattaagcaacattttaactctgcactttgccgtggcggttaatgctctaacttcttgaatcgacgcaatttatctctataacatgctggacctcctttgttgaccaaatgggttgctgattgaaatgcatgtctggttcattgttttaaa

SEQ ID NO: 16683 - DNA, 396 bp, Zea mays
  unsure at all n locations
  Clone ID: cC-zmpo148048e03a1
gctaacnactttcaatcccatggganccgaatgaatttaaaataactaaacaagccttacccagtatttgcaataatttggcttcttctggcctcgccctcgattgaaattaagacatatgaaaacatcctagaagtagcaaggataagatgtgtgcatttttttccttttctacttgtggggccaaactgcatcgattaataatcgaacaccgttaatgacaccctcaattggcgccaaattacaaagcggatggttttaaaagagctgcttgtaggccgaggaggcttccaatgggtggatgaggtaagtgaggacaagcgccaccagcatgaggacgtaggccattccctggtctacacttgttccgacactggtaacacgtgctggggcggg

SEQ ID NO: 16684 - DNA, 616 bp, Zea mays
  Clone ID: cC-zmpo148048e03d1
taacttaagggccacccccgcgtgcgaaacgccaaacgctgctgcgctctctccttctcgttctgtttccccagagcgagagggaggggcagccaggggagcctgtcattttgatcggtgtctctgcccccgttcccgctaggagagaacaacctgtagaaaatggcgcccatctccggagccacggcagtccttgtgatggccgtcgtcgccacgctcgccgccgcggctaacgccctggcccccgccccagcacctgctaccagtgacggaacacgtgtagaccagggaatcgcctacgtcctcatgctggtggcgcttgtcctcacctacctcattcacccattggacgccttctgcgcctacaagcagctcttttaaaaccatccgctttgtaatttggcgccaattgagggtgtcattaacggtgttcgattattaatcgatccagtttggccccacaactagaaaaggaaaaaaatgcacacatcttatccttgctacttctaggatcttttcatatgtcttaatttcaatcgagggcgaggccagaagaagccaaattattgcaaatactcgttaagccttgtttagttactttcatttcatttggatt

SEQ ID NO: 16685 - DNA, 94 bp, Zea mays
  Clone ID: cC-zmpo148048e04a1
aaaaaagaaacaaccgacacaaagagacacacaccaagaaaagcaaagaaaaaacaacaacaacaacaacaacaacaaacaccaaggcaagcac

SEQ ID NO: 16686 - DNA, 583 bp, Zea mays
  Clone ID: cC-zmpo148048e04d1
cgggcgaacgaagcccccgacacacaaaaaagcaaaagctttatcatattaatggcccgcgcgtgcgtggggctgggtgtgcttctcctggccgccgtcgcggtggcgccgtttgcgggggctgcgcgcgtggatgtcgtggagggcaggtccatggcgtccgccgacgcgcctgaggcggcggctgacgcgcccgctcccggtcccgactccgtctcatccccggactcgtcgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatgaaaagcgtgcggcaaacgcatggaatgtgcttgcctagctaactgtcggtgatatcgttgttgtcgttttttctttacttttcttcatatctgtctctctctctcgggtgttaaatctttcttcatgcatgtaatataataatgtgatatacccaatatatgcaacgcgctttaattctgtggtgacg

SEQ ID NO: 16687 - DNA, 380 bp, Zea mays
  unsure at all n locations
  Clone ID: cC-zmpo148048e10a1
ccccncnctttttttttgacaaaaaaaanaannaaaaccggcccagggcacatacttttaaccaaaaggaaaagacagagagacaagagctaacacctgaatttggttggtatttagagaagaaattttataccctcaaattcagggtgttacaccgtcgaacataatatagctgtcggatgtctgtcgttttactgttgtgcgttaccaatggataacaactaatgggcaatgcatggacgagagaaaaattataactagagagatgggtcactctacggagggtctaaaagcatgcaagctccttgaggcaacccttggagctccccttggccttcgagcatataaccatggtcctcttgttggtgccgttatactcg

SEQ ID NO: 16688 - DNA, 364 bp, Zea mays
  unsure at all n locations
  Clone ID: cC-zmpo148048e11a1
attacttctattattcttataaanaaccaactacattccgggctcgtttattttaattatcccaaacccccccaaacccctacttttttaaggtaaaaaaaaacacacccaaaataaaaaaaccacccttcatcttgtccaaaacccaaaacaaattttcttaccaaacccattaaaactacccacccccccctgaaaccctaaaaaaaacaaaaattttacccccccttccaccccttttacacccccccccaaaatcccttattaaaaaactaataaaaaccccccaaaaccctttaattaaaaaaaaagaaaactcttcaaaaaaccttcaatcaatcccaaaccaaccccggaaaaacct

SEQ ID NO: 16689 - DNA, 298 bp, Zea mays
  unsure at all n locations
  Clone ID: cC-zmpo148048e12a1
actggaaacaccaattttctttagaangggaaaggtcacattttttatctttcaaacacaacacaatccttaaagacatacacgatcgagattcgtacagagtacagaccttgccgaatggaaagctcacttcgaccgagtttaagtggattctgaacacaaataagccaaaacaacagcacacatgttggctgacgcacatctctgtcgcagcaataatggcacaatggtccgttaagcagccagcgtgtccgtggccgtggcatcagccgggccttctgcctccggagccaccaac

SEQ ID NO: 16690 - DNA, 421 bp, Zea mays
  Clone ID: cC-zmpo148048f02a1
cccccccccttttttttttttccccccccccccccaaaaaaagaaaagattattttttttactaaaattaccctcaccccttttgggaacaaaaacccaaacatttctaccccttttacaaaatcaggtggaaaaaaattaaaaaccccccattctccaatcccttgaacgctttttattttttcattcaccttgtttttaacactatcccaacaacttatttgttaggtataaataaaaaaaacatcaggaactttctttaacgtcaccttaaacaatggtccaaaaggtccaccatccactacttttaaaacataaaaaccccccccttcccaatcttttatttgaaaaatttaactcctcttttaaaacctttaagaaaaaaacccttattattgaacctcctttttccaatcattac

SEQ ID NO: 16691 - DNA, 525 bp, Zea mays
  Clone ID: cC-zmpo148048f02d1
agggccacccccgcgtccgtggaggttgctgcatgggaggcaaatgttcctttgtatactagaacatggacaaggattaccatgccggggaccgatagtgcttttcatgcttttattacctgcacttgtctgctgtcagttgccagcgcacacctgaccgctttgcttgcttaaaccatacaaatcttctttgttcatgcggaatggacatgaaaatcacattctttcgatatagcatggaggagcttaatactcttgtatcacctctggagggtgatctgactgcagtttgttgctgggtacacgaccacctacgcttattttgccaaatcatgttctctgaagcacagcgaaatgcactcatgttaaatcacagaaccttcaggattagctattgatgccaatcatgtttctgtatttggtggtattcaaaatcactgccatgaccttcaaaagccagcaggattccatcaagaaataggaatccaggataattgtcttaatctcaacatagaagatccacca

SEQ ID NO: 16692 - DNA, 403 bp, Zea mays
  unsure at all n locations
  Clone ID: cC-zmpo148048f03a1
ccctccccccttttaacttttaaccccccaccnaaaaccaacncggggggggcggacttaaccaccaggggagggcccactagcaaacacggnacaacaagcatacaccaggacttgctggcgaaaataaacgcaaagataaaaatatatataactcccattacaatgattgttttttaaaccccattacagtgattttagagggcatctcaagattacatcaatatatatatccgtgcgttcttatttgtctcacccccacccaacgtcccttctcccttccctaagcttcctttgactttgatcattatgatgattttattttgcccaacactacaggataggattattttgactggatggtcataacaccaggtgaaaaactcgcctttttcatctttac

SEQ ID NO: 16693 - DNA, 508 bp, Zea mays
  Clone ID: cC-zmpo148048f03d1
cgtgcggacggcaagctccgctacggcttcaacggcatctctcactttgtacaccgagacccccctcaagctggccggtttcttcaacgtcaccgacggggtcttcacctacaaccagatgggcgacgtgccccccgccgttaacgggccacttcatgtcatccccaacgtcatcaccgccgagttccggaccttcatcgacatcgtcttcgagaaccccgagaagagcatacactccctccacctctacggctaccccttcttcggcgtcaggatggggcctgggacgtggtcgccggactatgaggaagacgtacaacctactggacacggtgagccggcacaccatccacgtgtacccgcggtcatggacggcgatcatgctgacattcgacaacgcgggcatgtggagcgtgcggtccaacgtatgtgagcggtactacctcggggagcagttttacataagcgtcatcttttctgcacagtcgatgcgcgacgagtacaacat

SEQ ID NO: 16694 - DNA, 401 bp, Zea mays
  unsure at all n locations
  Clone ID: cC-zmpo148048f04a1
tcgcgagggcgagtttgtactttcgngcagccacaaacaggcgnccgggcagcatgtctttcaccggcacgcaggacacgtgcacggcgagcgacaagaccgatcacttcatcgacctactcacggtcgacagctccatctaccataagacatgcttcaagtgcaatcacatgtaaaggggtcctctcgatagtgcaactactcctccatggacggcgtgctgtactgcaagacccacttagagcagctcttcaaggagaccctaaacttcatcaagaacttcacgccacgtggcaagtcatcagacaatggtgaactgacaagggccccaagcaagctgtcatctgcattatacgatacccaagataaatgcgcagcatgccacaaaacagtgtaccccc

SEQ ID NO: 16695 - DNA, 490 bp, Zea mays
  Clone ID: cC-zmpo148048f04d1
gacgcgtgggttttttttaatattaagggcacctctcgttctatcatatattcaaagaagtgggggtggttacaaatttacaatttttttccgctaggctaatacatgtccatgtcagattttccattgtcgtgagcctcatacgtaacgaaggcatctggcacacttgattgcatcgtgatgataaaccgggttcacagagagattaagaggaaaaaaaaggtaggagggaataaagaagcgtcgtcgtcgtaaagaaatatggcaaacgtgtagacttcagtctgcgtgatatatatgcatggttagttgttggtcgctccgatcctaggtgtcctcttctttctcatcttgcggtggcgctggttccggcggttgctcctggtcagccacctccggcataacctcctgggacgggctcttattgttcatgtggaaggagcttcccttttccatgaacagctgcgccaagtggatcttgcagtacaag

SEQ ID NO: 16696 - DNA, 326 bp, Zea mays
  Clone ID: cC-zmpo148048f05a1
acaaataaataattttctcatgttattatgggtacagattcaataagaaacatagtcaggaagaaacccattgcaagaatgcaatggaaagaaggcatccctcttttacaataaaagggatcgtattttgagtggcaccggtaacccaaacccgcgtcatcggtcaggctcaagctgacccatcgtcgtcggaatcagaatcgtcgccggacgatgctgctgatgctccggcgggcggcggccttatcccgtccctctagcgcaccatcgccatcttcttcgtttgagtcctcccacgcacctagcccatctttttgatttcacct

SEQ ID NO: 16697 - DNA, 355 bp, Zea mays
  Clone ID: cC-zmpo148048f05d1
ggacccacgcgtccgcccacgcgtccgctggaggtgttatcttattgatgggcctggtgcggcggagggctcgggcgactacgatggcgctggtgcgctagagggaccggatgaggccgccgtcgccggagcatcagcagcatcgtccggcgacgattctgattccgacgacgatgggtcagcttgagcctgaccgatgacgcgggtttgggttaccggtgccactcaaaatacgatcccttttattgtaaaagagggatcccttctttccattgcattcttgcaatccgtttcttcttgactatgtttcttcttgactatgtaacgataataacatgagaaaattatctgaatg

SEQ ID NO: 16698 - DNA, 454 bp, Zea mays
  Clone ID: cC-zmpo148048f07a1
gcgcaccagagaatattcatcgggtgagatttttaccgggtgcagtacacatccatctatcgatgtgttaacgtgcacgagacgatctcattcatattgccatgccacgtacagcgtgcagtgcgtgtaaagtttttacttacgaccggctatcgacctcacctcccctgcatgttggcaagctgttggaagatctcccctgtttgtgctgttgacactttttgcacggcacctcccgcggttactacatcgccgtcgtctcccgccatctcggttccttcctggtacttctcgtcgccgcccttcctcgcgcccttggtcggtttggcgttcttgtattgcagctcgtactcgaggttccacagtaccgtcccccatggataatccgtctctgtctaactttgttaggcactttttggctttatctgctaactttgttagctatttcgtttta

SEQ ID NO: 16699 - DNA, 298 bp, Zea mays
  Clone ID: cC-zmpo148048f08a1
tcctctaagcgcccccctttttcccttttcttatcttccccccacacaaagcaacaagccaggtctaaaaatattgtacagccacccccctacacttttatattcctttcctttctcacctacatattctaaacccattctaacaaaatttttttcttacagccatccagatatcaaccactacgtacagtcatctactacctgctattacatatccatcgtaacctgcaattttcaattactcatcgtcttcatcatcccactccaactttttcaacatcaaagcacaaattttcaa

SEQ ID NO: 16700 - DNA, 411 bp, Zea mays
  unsure at all n locations
  Clone ID: cC-zmpo148048f09a1
ccacacaccttttttttttttcncaccaccactaaaaaatancgctccgaaacccatatgccctgaagataccactcacaaaaacaagaaactatcccaaaacaaacataattgaagggttcctggaccattctacaacataattgatcaaccattgcgacagcgtataatttcaactaaatgaatgaattaaataacaaatggccttacagaacaagaatcatcacaatgatttcaggctactatgaacaatggaacctactgaaactgtggcttttcacttgtacgcctcaatagaaagatctactgctttcacttgcagaaatccaactgctttttaacttcacaaccagaggccccttcacaatgtccaaacccttcaaccttccaaaaaactttttctacattatt

SEQ ID NO: 16701 - DNA, 415 bp, Zea mays
  unsure at all n locations
  Clone ID: cC-zmpo148048f10a1
ctccctttttttttttaaacnngcaacaacgnctgcggaanggcactgtctacacggagtgactgtcacaccccactcaccgagcagttgtactcaccgagcactgtctagagtagcttacatggagtaagagaacactggcaccggcggtgcaaaaaacggcacacccgtacatgcagaggccgcccgtcgatgcaagacaaacagcttctgtccttcccgggcatgcatggccatcgcgcgagcggatgcgcgtcttcctcttcatagagctcgcgccctgacaatgtccatgctcatctcgctggggtcagtggcctgcaccttcagctggatgccctccaactccctcttgaaccggtccttggagctcgcgtacagcatcttgctcctgaccctcgaggtgtcccgggac

SEQ ID NO: 16702 - DNA, 302 bp, Zea mays
  Clone ID: cC-zmpo148048f11a1
atacgacccttttttcggttaagcccaattaaaacatgtcgtttcaccaaacacaactcctggagaaaaaaaatgtgagacaatgaaggttactttgttacatgccgtggcccgacaaaagtgtttctcccgacctatgccaaactgtaaaaaaatcaagtgttgtctccttgcttgatcacaccctcacacactgaacataaagcattcatcgccaattttattaattggcccccatgccccaacaaaacatcatctttttttctccaacttctccttccccgaccactgggctttttttt

SEQ ID NO: 16703 - DNA, 379 bp, Zea mays
  Clone ID: cC-zmpo148048g01d1
gcgtgcgcggacgcgtgggattaagctctatggagagatggtttaccatgaatgaattgaacaacaatatataagggggcatgcgcaaccaaacagctacatgtacattgcaggcgtgtgtgaaattgtttatttattttttgcatgtgcacgcgtgagtatttgcttctccgtacatactctatgtatgaacgtgtgcatgtgtgaactaactacatgagacgacaaggtgcaagagacatgtctggggcgtcatttgtatggctttaattttttttattatatatagataaggaaatattttccttaaaaaaaaaaaaaaaaaaagagaagggggggggggacaataaaataaattttaaaataataaatcttaatt

SEQ ID NO: 16704 - DNA, 586 bp, Zea mays
  unsure at all n locations
  Clone ID: cC-zmpo148048g02d1
ggacaagatggcatgcacaaacaatgcgatgagagctttgtttctcctggtcctcttctgcatcgggcgtggggagaaggaagagtcaaagggcatccatgccaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccacgtggatggcaatctgctggcgaccacggacctaatccagtacaaggaccatggtaattggatcgagattctacgcgtggataacctggtcatcaccggcaagggaaaccttgacgggcagggcccagctgtgtggagcaagaactcctgcaccaagaagtacgactgcaagatccttcccaactcgctggtgatggacttcgtgaacaacggngaggtgtctcgggtcacgctgctcaacttcaagttctttcacatgaacatgtacccgtgcaag

SEQ ID NO: 16705 - DNA, 484 bp, Zea mays
  unsure at all n locations
  Clone ID: cC-zmpo148048g03a1
gagaggcanaagcactgcaagagcgtgggttatttctcatagacaactgtgcatacaccaagatttttggattttgaactctccgtccaacaaaagaactctccccatcacaagctcgctctctaactgactcatggccacgccgtaccacccgctagctctccgccgttctccatgaaccacccgccgtcggcgagctcccgctgacctggtcattactttcgccacttccactgttggtcccgacggcgctcatgcgtgcctcgtacgcgtggccgaggttccttaaccggttgagctccggcagtactactgttgcgaggtccggccggtccctccgccgcatctccgtgcacttgagcgcgagctttgcgtaaccgagcgcctccttgacgggccagtccttgacggtgatgtcaaacatttgcgcgaacgtgcccgccttgatggccttctcgacgtggtgcgtgagccccatgggtgg

SEQ ID NO: 16706 - DNA, 557 bp, Zea mays
  unsure at all n locations
  Clone ID: cC-zmpo148048g03d1
gggccacccacgcgtncgcccacgcgtccgctggcactggccgagatggagaattcctattgccgcgcggccatggaggcaggggagggggggcagagactggccgacctggaggcgcagcggcgccgcaacgccgaggtgcgcgcgcgccgggaggccgacgagaaggtgcgcgcactggatgccatctccaaccacgacttccggtaccgcaagtaccacatcgacgagatcgagatggccacggagcgcttctccgacgagctcaagatcggcgagggcggctacggccccgtctaccgcgcctccctggaccacacccccgtcnccatcaaggtgctccggcccgacgcgcaccangggaggaagcagttccagcaggaggtggaggtgctcagctgcatccgccaccccaacatggtgctcctcctcggtgcgtgccccgagtacggctgcctcgtgtacgagtacatggagcacggcagcctcgaggaccggctgttccgtcggggcggcacgccgccgatcccgtgggcgcagcggttcccgatcgcggc

SEQ ID NO: 16707 - DNA, 365 bp, Zea mays
  Clone ID: cC-zmpo148048g04a1
accatgcatgtgtatatcacaagcggggcagtgatataattacatgaaccatgcatctccacatcgatcgccacttgctgccataacttaactatcgatcgccctcaaattagttaagagctctctctcgatctccctcgctcaatctaatttgcatgtgtgtatagactgtaacttcaatttgtgctagtaataagttgtcaagttgataaatcatcatggcctgcgcggcggtcggccaccaccaccggtggaggagtccgtgctgtaatccgagtagtctccgctgtcgaaggcgagctgccttaagcggtatatgttgtccgacccaccgcccgagaagagcaccctctgcccgggcttgc

SEQ ID NO: 16708 - DNA, 635 bp, Zea mays
  Clone ID: cC-zmpo148048g04d1
gcgtccggctacctggcgccggagtacgcgtccagcggcaagttcacgtacaggtcggacgtcttctccttcggggggtgctgctggagctgctcacggggcgccgccccatcgataccaccaactacatggaggacagcctcgtggactgggcgcgcccgctgctgagcgccgcgctggcgggggagacgggcttcgccgagctcgtcgacccccgtctgggaggcgagtactccgtcgtcgaggtggagcgcttggcggcctgcgccgccgccagcacccgccactcggccaagcgccgccccaagatgagccacatcgtgcgcgcgctggagggcgacgcatcgctggaggatctgcaccaggacggcggcaagcccgggcagagcgtgctcttctccggcggtggctccgacaacatctcccgcctaaggcagctcgccttcgacagcggcgactactcggactacagcaccgactcctccaccggtggtggtggccgaccgccgcgcaggccatgatgatttatcaacttgacaacttattactagcacaaattgaagctacagtctatacacacatgcaaattacattgagcgagggagatcgagagagagctcttaactaatttgagg

SEQ ID NO: 16709 - DNA, 100 bp, Zea mays
  Clone ID: cC-zmpo148048g05a1
tataaacctcttaacacttgtctccatcactggctctttcacataccaatggcgactcttgtccctcccctgtcactgtcttccgtgagatggactctct

SEQ ID NO: 16710 - DNA, 519 bp, Zea mays
  Clone ID: cC-zmpo148048g05d1
ggttggcaagagaggagggccggcgtcggcgtgcctttctcgttcttgaaccatagctagccagcggggcgcgcagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtgtcaccgaccaacggcacggggtggtacaagggcatcgcccgggagttcgtggacgcccacaacgagctccgcgcgcgctacggcgtgccgcccatgaagtgggacaagaagctggcgcggcatgcgccgcgctggtccaaccgcatgcgcaaggact

SEQ ID NO: 16711 - DNA, 455 bp, Zea mays
  Clone ID: cC-zmpo148048g06a1
aatgtgaaccctgaggctttatacgggccagcactcttacatggctccagacaatatcgctcaatgaaaaatactgtgacaaacaatgcacgttggtgacctgaatagttagcttagagctaaccgggcgacattaaactgtttgtggaaaacagagcccaaaatcactgaaacaaacactgcctggagcagctttttttctgcttgccaaatatcccccaagattatacacatggcaaatataataaatcctgactcaactttcatcttggtagcataacgccattcatatacacattccacctcttcattggaaacctgatcacaatgccatttcagcttgcattgcagcaagctcatcatcttcagctgtagctttctgtggagcaaggcgccctgcttgcttgttggctggggcatgccctggatgcacccgaagagcttccacaggcttc

SEQ ID NO: 16712 - DNA, 490 bp, Zea mays
  Clone ID: cC-zmpo148048g06d1
ccacgcgtccgcccacgcgtccgcttaagttctttttatgtcatttactcttgatatgctggaggggaaagaaaggtgctggagaaaaaagcagccgctgagcttgagagagccaaggagttctcaaaagctaagaataaaagagcggctatccaatccttgaagaggaaaaaactttatgagcaacaaattgagcagcttggaaattttcagttgagaatccatgatcagatgatcatgttagaagcagctaaagctacaacagagactgttgatgcattgagaactggagctgcagctatgaaagcaatgcaaaaagcaacaaacattgatgatgtagacaagaccatggatgaaattaatgaacagactgaaaatatgaaacaaattcaggatgctttgtcagctcctctcggagcttctgctgatttcgatgaggatgaactggaagccgaacttgaagaactggagggagcagagttggaatctc

SEQ ID NO: 16713 - DNA, 303 bp, Zea mays
  unsure at all n locations
  Clone ID: cC-zmpo148048g07a1
cggccccccccccccccccctttagacttactggccccaaaaccccnncaagggggagggattgccttctgaacaacttcaatgcacccccctgcatgcaaatacataagttccgttgcttgttgcaaaactgacaaacggcaaagcttctcgtgctgaagggaaaagagagaaagtatcatccacggttccttggtagctgcgcaaaaagcagggtgagaggcctggttcaatgtttgtagatagccgtggtaactgacctggtaacccatcctatgtataggcgtccccctcaccctgtaa

SEQ ID NO: 16714 - DNA, 393 bp, Zea mays
  unsure at all n locations
  Clone ID: cC-zmpo148048g08a1
cccccccccctttttttatattcccccccccccccccccacacggggnnggaagccttttacacaaaaaaacgcacccccccaaaagaaaaccaaccaacaccaccccggctctaacaactggcaagccggccaacccccacccggtaaaacccccttcctgtcccccccccccccctgcttgacaaccacaaaaaccttaaaaacctcgtccacaaagccgaaaacctcccccttcatggtcaaaaaagggcacccaatcccccgaaaaaccgcaaaagccttttcccaatctctatcccccttaacaggggccgacaacttcacaataaagcccacaccccgtcccaggaatcccccccccacccccatgaaaaaaaaactctcccccccc

SEQ ID NO: 16715 - DNA, 447 bp, Zea mays
  unsure at all n locations
  Clone ID: cC-zmpo148048g09a1
gcggccgcccccccccccccctttttnttttttgaaaaccccgnncatattactagggcggaaganaaagattaatacatgcatattatgcattccctgctgggagtaaaaggtgtctgaaaaccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggccgagacggtggcggtgcttggagcaggtgactcggacacggtatccttggccaccttacccttacccaccaccactgctttgacgggcttgcgcggcatcatgttggaa

SEQ ID NO: 16716 - DNA, 405 bp, Zea mays
  Clone ID: cC-zmpo148048g10a1
gtgacgagattattatgagtatcattgtgatggttggacttacagaaacaatagcacagtgacagatttggatggatcccccgcacgcgcccgcagacgtcgacctaatataatgaacaatgcgggggcggccggaatcaatgaatcatcagtaacggagtagaaatcatgtcatgtcagggaagaaacgaaacagcgggacacacacgcatggccatggggatagatcactgcgtggcgacgagctgcacgcctcggacggctagcgctgctagcgggccgatggcgagggagttgatgtacgtgcagggctcggtgtaagaggagttgccgcgcttgtccacgaagccgtcgttctttgtcggcccgccgacgatggcgccggtgagctccttggggttgggc

SEQ ID NO: 16717 - DNA, 240 bp, Zea mays
  Clone ID: cC-zmpo148048g11a1
cttctacctgaacaccaaatctcgatatcgtgcaggtttattacccaacaagcatcgcacctaccaggatgcgaacaagttacaagctcaaggcatcgattaatcgtacagaggtggcggcgcgccactgcctcctacttcttgccacctgccttgttcttgttgttgtccgtggaagtaccggtgccgccggccgctgcctgctgcgccttcttggccgccttctccttcaaagctttt

SEQ ID NO: 16718 - DNA, 365 bp, Zea mays
  unsure at all n locations
  Clone ID: cC-zmpo148048h01a1
ccccaccccttttttttttttttnagcatacaccaggacttggggggggaaataaatgttaaaataaaagtatatataactcccattacaatgattgttttttaaaccccattacagtgatttgagagggcatctcaagattacatcaatagatatatccgtgcgttctcatttggctcacccccacccaacgtcccttctcccttccctaggcttccttcgcctttgttctttttgatgattttatttcgccgagcagcacaggaatggattagttagactggatggtcagaacacgaggtgaaaacggcgccttcttcgtctttagcgcgcgggggcgtatgatggcggnagcggcagcccca

SEQ ID NO: 16719 - DNA, 626 bp, Zea mays
  Clone ID: cC-zmpo148048h01d1
gggcaacccacgcgtccggctccttttcacctggaacgggatgcagcacaggattaactcttggatggacgggatgccaggcacgcagggccccatcgcgcccaacaccaacttcacgtacaagtggcagcccaaggaccagatcggcagcttcttctacttcccgtccatcggcatgcagcgggcggcgggcgggtacggcgccatcagcgtggtgagccgcctcctcatcccggtccccttcgaccagccgccgccggagagcgaccacgcggtgctcatcggcgactggtacaccaaggaccacgaggtgctggcgcgccagctcgacgccggcaagagcgtgggccgccccgcgggcgtgctcatcaacggcaagggaggcaaggacctggaggccgccgcgcccatgctcaccttcgaggcgggcaagacgtaccgccttcgcgtgtgcaacaccgggatcaaggcgtcgctcaacttccgcatccagggccacgacatgaagctcgtggagctggagggctcacataccctgcaagacgtgtacgactcgctggacgttgcacgtcgccactgcctcttcgtgctggtcgacgccgaccaggtgcccggcgactactaca

SEQ ID NO: 16720 - DNA, 476 bp, Zea mays
  unsure at all n locations
  Clone ID: cC-zmpo148048h02a1
aatatattaaaggccaggataatttattccatcaaatgattacacccaattaaacatgcctcctccgcccaagcatatacccgtacgcacctaattaatccgtatgccgaccctactacctacatcaacctccggtctcaccgcggcgcggcgtctgcggcaccggcaccggcggcgaggactgcctctagcgtggtgacgaccctggccatggagggccggaccttggggttctggctgaggcagtcgtacgctaggcgggccacgcgctgcaggcccatctccgagcagacctcgcccatccgccggtccaggatccgctccaactttttgggccggataaggatgggccgcgcccagtccaccaagctgtcgtcgcggcctcccccccggctcggctccagcgcgcgccgtcccaccagcatttncagcaacaccacgccgaaaccgtacacgttgttcatcaccgtcaggtg

SEQ ID NO: 16721 - DNA, 637 bp, Zea mays
  unsure at all n locations
  Clone ID: cC-zmpo148048h02d1
agggccacccccgcgtncgcaacatcttgctcgacgcgaaattcaacgccaagttgtcggtcttcgggctcgccaaggaagggcggatggggggtgagacgcacctgtccaccagggtcatgggcacctacggctacgccgcgccggagtacatagccaccgggcacctgacggtgatgagcgacgtgtacggcttcggcgtggtgctgctggagatgctggtgggacggcgcgcgctggagccgagccgggcgggaggccgcgacggcagcctggtggactgggcgcggcccatccttatccggcccaaaaagttggagcggatcctggaccggcggatgggcgaggtctgctcggagatgggcctgcagcgcgtggcccgcctcgcgtacgactgcctcagccagaaccccaaggtccggccctccatggccagggtcgtcaccacgctcgaggcagtcctcgccgccggtgccggtgccgtcgacgccgcgccgcggtgagaccggaggttgatgtatgtagtatggtcggcatacggattattaggtgcgtacgggtatatgcttggngcgaggaggcatgtttaatttggtgtaatcatttgatcgaatcgattattcatggagtttaaata

SEQ ID NO: 16722 - DNA, 379 bp, Zea mays
  Clone ID: cC-zmpo148048h03a1
gacttcagcataactaacaatgggtattggttaaggtccaattttcatgtccaaacgaataccttctcccattctcccctctttacatatcgaaattaacagaaaagggataaatggcaaagcaaataaaatgaatggatcaatctacatgttcaaacccaaattaaattacttaaatatatatataaacggaatccaacccaatacaggcaatggcagccagcagcctctccctccgatcctcctttaattttactgcaggtagtaagcgaagaatgagatcacggatgcgcccagcacggcgccgactgccgtaaacgcgaccgaagaggctctgtatggtgcactcaccagggcctctgtggctatgaccaccgtg

SEQ ID NO: 16723 - DNA, 437 bp, Zea mays
  Clone ID: cC-zmpo148048h03d1
gggcatgggctcaaccaataataaccacgagaagcattcatctatacaaatagcgaataatcctgcgggcccgtcgttctttcttgtgtcaaccccgaccacgctccgttcggctccggcacaccacataacatcgccatctagatcaagaacgccgcctgcgccgccctgctcggcgcctccttcctcaccgtggtcctctacctaccaggccccaaatcccggccccaccagcgccatacgctgctcgctgccagccgccggctccgtgctgatcgccttcatactatacttaatcgcctactacctgcatctaaacataaggagggacggagggagaggctgctctctgccattgcctgcttttctgtgaattccgattatatataaatggaaaaacgtaaacactattctgaacaacacgatagatccataca

SEQ ID NO: 16724 - DNA, 252 bp, Zea mays
  Clone ID: cC-zmpo148048h04a1
atccttaacccccctttttttttttttttttttttttttggtgggcttttaatatactatccaagaacaacaaccctccgttaaatgagccgccacccaccgtatccctctttcctctcgttgttacacacaaaatttaaaactttcacagcgtaacctccttcatgcaaaaggccctaatcccgaaatcttaagctttcccatctgcccttaacgggcaccttattattctagcctgcctggtcccccccc

SEQ ID NO: 16725 - DNA, 627 bp, Zea mays
  unsure at all n locations
  Clone ID: cC-zmpo148048h04d1
gggccacccacgcgtccggtttccctctttttcttaggccgccctctacactttttgatttatccatcgagagggcggtcgagagaaacgggagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcgtcgatgcgcgtcgcggcggagaaggccagggaggccaagagccgggtggacgagttcgcggcgaggaaccacgagggccggccgatggagtccatcctcggcgcctgcagcaacgggtacggcaacgttgtgcagacgctcgaggaggcgcggaagatcgtcgccacgcgggcggcggcgggcacccaggcccaggccgacgacatgaacacgaagctgtcggccgccgtcacgagcgccagcgactgcgacaacgccttcgccgacttnccggcgattaggtcccccttcttgccatgcagcggaacg

SEQ ID NO: 16726 - DNA, 73 bp, Zea mays
  Clone ID: cC-zmpo148048h05a1
ataacaacatcacctccctccattgatgaccgacacatttataccaacacttgcatacctgttacttttacca

SEQ ID NO: 16727 - DNA, 516 bp, Zea mays
  Clone ID: cC-zmpo148048h05d1
gtccgaaagcgggcacttctagccgcaagcattcttccttctctttctcattccatcggtgaccatggatggaagagattgatcggcttctctggaggtgcgtgtgagcagctcggaggtcagccgccgagaagagctcataggcaatggcaaccgcaaggaaggatcctcagcaggttgataaagtcaacctgaaacccagcgagtctggcaaaggggtagtacggcgtgcaaggtctgtcccgacctctccggatcgcagatcgtccccatccccggccccagtctcagacaacgccagccgaccggcatcatcactcaacactcgcacgacctcgtcccggtccacaacaacatctagctcggcggcctcttcaagccacgggaagacgatgcgctccgcttcgtcgtccgtgggtggtgcacgtgcaagcgcaaggcagacaaacgcggcgagaaggagagcagagaagcccggtgccacatccgtgtggcctgcggcccgcggcgcggtta

SEQ ID NO: 16728 - DNA, 404 bp, Zea mays
  unsure at all n locations
  Clone ID: cC-zmpo148048h06a1
aaatnncgaacggcatcctcgngggcatagcaaatatacaaaagctagatggctgatatcatgcaaaacataaatcgttacataaagttgcataaacacctacaccgtacatcataattaatgaaaaattagtatgggctcaaccaacagccgcatgcataaacaaataattggaggaggtcatcggaggactccgccgccgaggccatcacatcgaaggagttggtcatcgaaggacaccggatccaaccacgcctcatgtggccaccaccgttggagactaccgctccttacgcacccgtcggagctacccgcgtgttccatggccaccaccgtcactgccgaagcctatcgtgcctcgcacaatcaccgttaccaccgagcctagggtgcgaccccgtcac

SEQ ID NO: 16729 - DNA, 542 bp, Zea mays
  unsure at all n locations
  Clone ID: cC-zmpo148048h06d1
gtccgcgcggttccctcgggcgtgcaagcggtggagatatcttgggtgggcggcggtggtgccccgaggtgggtgggccacgccgacgctcccgaggcagcgggcaggcagcggtggttctcccctaagactgagtgatggcgacgctccagaggcgggcgggcaagcggcgacggcagtcccgagtcgaacgagtggcggcgtcgcaccctaggctcggtggtaacggtgattgtgcgaggcacgataggcttcggcagtgacggtggtggccatgggacacgcgggtagctccgacgggtgcgtgaggcgcggtcgtctccagcggtggtggccacatgaggcgtggttggctccggtgtccttcgatgaccaactccttcgatctgatggcctcggcggcggcgtcctccgatgacctcctccaattctttgtttatgcatgcggctgttggttgagcccatactaattnttcattaatatgatgtacggcgtagggtgttaatgcaactttatgtaacganttatgttttgcatgata

SEQ ID NO: 16730 - DNA, 355 bp, Zea mays
  Clone ID: cC-zmpo148048h07a1
gtatcacttaataactcaattgcattggtagtacgtactccattaatacgtagggctcgtttgtacatgctgattgatgatgattaattaatatctgcatgcatgcattgtagaagcaaagaaatgggaggtagcttaggcatgcatgcatgatgcatggggccttaattaattcatccacggccacgggtcgtcggtgatgatagcttgaaccctctgagcgcggacacgccggcggcggcgcctcgctcttgtgctgcttgtggtgctgatgcaagcgcttctgctttcgctaatacagccgacgtacctaaggttgtcatcccgacttctccgtaacatgcgctggcacaag

SEQ ID NO: 16731 - DNA, 446 bp, Zea mays
  unsure at all n locations
  Clone ID: cC-zmpo148048h08a1
ctttcttttttataatatacattncgctcgctttccactcggtggagttcggcttacatgattagaattgcctcctacaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctattagaattggacgttggaagtgtagacggcatcgggtcttcagttcggcgggatgacctcttttgcgatgaccttcttgccggactctctggtgaagcggattgaaaaggggcccttgaacgccttggcagtgtccatcctccaaatggcgccccaagagagctttatgggctttcacttaatcgacaactttgcctggatttcca

SEQ ID NO: 16732 - DNA, 429 bp, Zea mays
  unsure at all n locations
  Clone ID: cC-zmpo148048h09a1
cttttccctttttttattcttttcccccccccccccccattacggacnngggttttttttaaataatttttccggcccccccccctcttataaaaaaccaaaaaatttttaaaaaaattcaaaaaaaccccccttaccaaaaattaaaatctacaattttttttttttaaaaaaacaaaaaacccaaaaaaaaacccccttccccccataaaaaaaaaaactaattagaggccgggtttacttaaaaaaaaaaacccaaaattaaaaaaaaaaacaaaaaatttcaaaattaaaaataattaaataaaaaaaaaaccacccccattttttccttttttaaaaaaaaaaaaaaacccacaaaacccttcctgaaaaaattaaaaaaatatctacaaaaaaaaaacaaaaaaactattcttttttttaacc

SEQ ID NO: 16733 - DNA, 386 bp, Zea mays
  Clone ID: cC-zmpo148048h10a1
gggtcacgtttttttttattttctttcctccccccccccctttaggccaaaattcaaaaaatttaactaaactcaaaaatttgcaaaaaaaccccccatttttgggaaaaaagctttttccaaaacccacctccccaaaaaaaaaaaacaaaaaatatttaaaaccgcttaaatttaacattaacccaacttttttccccaaaaccaaaaaactttaaccctaaaatttttttaagaggccaaatttctaggggcagacaaaaaaatacttcctttaaaaaatccaaaaccatttttttctttctaaacataaaatttttcaatgaaaaaccattttttattcaaaactttctactttttaaaattaaaaataagccccttttttt

SEQ ID NO: 16734 - DNA, 426 bp, Zea mays
  Clone ID: cC-zmpo148048h11a1
atattaaagatgtgctcattagtaagtaaacgttcagaaacataacgtcacaactcatccctctttcttatagacaggcccatacacagcagggtttgtaccacaggccacaatgacacattcttcttcgttacattacgtctccccagaagagaagagcatacaccagaagttccagtatatataatcgaccaccgaccatcagcatcagcataagtacgacaacgcgcacatcccctgtttattcaattatattggtgtaaacatcacacgctccatgttgcgttgcatccttggccaccggtgcctgctttcttcctcgtcgatcttacatgctcggcttcaggttcagcctagaagccagcttctggccaagagcggcgtcgcactgggaccagtaggagatccaaatggtacggtgttcat

SEQ ID NO: 16735 - DNA, 447 bp, Zea mays
  unsure at all n locations
  Clone ID: cC-zmpo148048h12a1
gtaacaaccncctttaattatccggccagtagcacaaactgaagcagacaaccttcacccatgtaccggaaaagaattcacaggtatcgacaatcatgatcagtaggctctcaagtgacaactgcaccttggagaaccaagaagcggtcacccaatggcgggcctagtgttgtacacagtctattatatgacggtgttagcaggaactcgttcattcatatattgctacaaaatgattaagacatgtgtggccgtacagtaaagaaacctcgtgatcgcgaaaatatttaatctctatcacgtgtaggcatgtaatctgaacccctgctgccatctgtccttgctggagagcccttgtgccttgttatgtttcgacagaacgtatccagctcttctttctttctcttgatttcacaggaccaaagtactggttccacattcttgggc

SEQ ID NO: 16736 - DNA, 605 bp, Zea mays
  Clone ID: cC-zmpo148049a01d1
cggccaattaaagagggatcggattggaactcgatcggaaggattgtcctgcttgccggctggccggtcgtcgagggaggaaccaagctgctgctgctgctaccggacgacaccaaccatgatacggaggacgaccgggtgcctaggcctgctgcttctactactggcggcgtcgactgcgacggcacatttctcgatcggcgacgtggacgagtacttgaacaggcgcacgcaggagtcccgccacaggaaccacggcggcgcgcacatcaatgacctcatctccagtgctgcgcgcttccacgccaacgtggatgcacgcgcgtatggtcgccgctccaacctgcagctgcaggaggaggaagcagcagctaccgcggggcgtgtaaccaaagcagaagaacaggaggcttctactcaaggtggagattaaccgcccaattattgcaattgcaattctcatcacccatttatattttctgccatcatttattcttcttttacacgcgtacgtgtgcgtacccccaacccatcctttttggattattaagcatcgtcgatggattacttatattactctctcttttctatgggatatatatatg

SEQ ID NO: 16737 - DNA, 384 bp, Zea mays
  unsure at all n locations
  Clone ID: cC-zmpo148049a02d1
ccatcgatgccaaaatgggagtagccatgcccatgcattttttgatattttagaaagcgaaacagcaggagacggaggggaaggaggagaaaagcacggacaaggaagacagncaatgcttatcgccgagncttccagtcgagggcttctgcttcaacagcgacagatgcgccgatgtgtgcatgaaggatagctttcccggtggctagtgcaagcaggtcgtggccacgcgcaagtgcttctgcaagaagccttgctagttcatcggtcttgctaattgttgatgggtgctttcattaatttgatttgatgggtcttatggctactagaaacaaaactacttttgataaaatgcatggcatgaaaagcgtttctgccttcctt

SEQ ID NO: 16738 - DNA, 590 bp, Zea mays
  Clone ID: cC-zmpo148049a04d1
cgcgtgggcggacgcgtgggcggacgcgtgggcggacttttggggttttacttggtctcaaatatcgggggaagggtgtcacttcagggacaaatcgttcagatttacatggagcggccgtgaatcacgcagagagaaaattccatgtgacagcgaagatgaagaaagcgcggatgagagcagagaaacagccagcgttggttcacatgctcacagggtcatccttggattacaaccatgtggtccactaactctagaagatgttaaaactgctttccgggcatctgcgctgcggtggcaccctgacaggcacccggggtcatcacaggtgtgtatccaaacaaattcaggccatggctgaggagaagtttaagctgtgcgtgaatgcgtacaattcactctgcagtgtcctcaaggctgcttacgttgtgtttgctgtcactggaggatgttagctcgttatggtatatcagttttgaagggctcaagggctgaacaatttggcggggaaaccactggcgaccatggatgcagtgcagtgggttgttttgttcactttttatttcattgaaatgtaaggggaactaaat

SEQ ID NO: 16739 - DNA, 489 bp, Zea mays
  Clone ID: cC-zmpo148049a05d1
gtacgtccctaccttgggcccaacccggcggtgatgggtccgtttctatgtttacggacatcctgtacaacggggacgtgagggctgcatacggggccaaggtgacgggcgtcttggtgggcggggagcggctggacattccggacgaggtgtgggacgccgagaggtttgtgggcggcggtgtcattctagacacgagcacgttggtgacgtcgctggtgccggaggcgtacgcgccggtgacggcggcgctggacaggcacctgtcgcacctgccgcgggtgtacgagctggagggcttcgagtactgctacaagtggacctttaccggcgacggcgtggacccggcgcacaacctgacgatacccagctttacggtggaaatggcaggcggtgccaggctggagccggaagccaagagcgtggtgatgccggaggtggagccaggggtggcgtgcttggccttcaggagctgctacggggagggcc

SEQ ID NO: 16740 - DNA, 254 bp, Zea mays
  unsure at all n locations
  Clone ID: cC-zmpo148049a06d1
gaggcccgaccggagnccacacacacacggaggacaaaggcggccgaaacaaggagccgccgccgcgagaccgcaaacaacaacgacgaccacgccgcaacagcagccgcagccgcggcgcaagcaaccaagaacgacaccaccgacgaggagaaccgggcggagcgcgcccaggagaaacggacgcgacaaccaaacaacacacacaaacccacacgaagaacacacaaggagggggggggggggggggggac

SEQ ID NO: 16741 - DNA, 178 bp, Zea mays
  unsure at all n locations
  Clone ID: cC-zmpo148049a07d1
tcgactgctcatgacgagagctgctggaaggacgacttccaccattttatctgctntcccgaagacgggcgtggtggggctgccatcgatcagcggccacgccggacggtccgctgcaacatgggcattggtctgtggaggcccgtattgtcagtgcctgtttggcggtactgccaat

SEQ ID NO: 16742 - DNA, 137 bp, Zea mays
  Clone ID: cC-zmpo148049a08d1
cattgagggctggggaagcgcagacggacggcaggacagggaccgccgctctgtacagacgtgatagcgacaacctggccgcacccgtggtcctaggactccgtgcattgcctctgtaacagtggactgacacacac

SEQ ID NO: 16743 - DNA, 510 bp, Zea mays
  Clone ID: cC-zmpo148049a09d1
cagcagccattactatgtagagagcgcagagggccgtttcctggtcttttcgccgaagtgtccattcggggcaaacggagagacctcgggagcctgccgcacctccatcgagcggaacggaagaatggtgggagaacagagaaactccaccgtcatggcccggcgccgcgcctcctctggtgcactggtaccgctgccatgtgccgtgcagtgcgttggtgggatcctgtcgtcgtggtgggaatccagcggccctgggtaattcgggtgtgcgcccacatttggccttggtgaccagctacaggattccgccgacatctccagtgcaaatcatgtggtcattccgggtggattgatgccgggggaccctgggattgttcaccggaaaatctacacagcggcaaagcgactctgagcggagaccggagtgattacgccatcccatttggtaagaagcttacctgtcaatctattttttctccgcaacgaatagatcgttttggtgtgggg

SEQ ID NO: 16744 - DNA, 493 bp, Zea mays
  unsure at all n locations
  Clone ID: cC-zmpo148049b01d1
aaagcgcanaagcttccgcatcttctatacctgcattttatctttttttttatcaacagctacttgaagcggttggggcagaaccagcacctcaggctggagtagtgtcagcagacattgggttcaaggatataactagccactgcgaagccctgacgattgggaaacagcagaaaatgtccgccttcatgagcttccagcaaagcgtgcaagcggcagggctgccgagcagccagcccaaccagatggagctggacctttcccaagacccgcagttgcctcagaccggggcacatagcacgaacccattcactgatgacagccttcagggatatccacagtacaccaaggggcccaacggcgacaacgcacagccaggccaggactttcaacaacagtccctgaagttaccggcggcgagcccatatgacaatttcctcaaagctgctggcctgttagaggtccagcttgcaacagcctaaacatcatttac

SEQ ID NO: 16745 - DNA, 214 bp, Zea mays
  Clone ID: cC-zmpo148049b02d1
cgtgctcctgacatcccactggcccagcacgaagcgacagcccatggtgctaagtgaaccctgcagacggccaaaacgcatccaggcaactcctgacgccctggactggggccctgagtctctatatcgctgacgacctgtgcacgcacctaccgtcaaagaactgatcagatcaactacacctgtctaacgcacgacctcacgcagacctgtg

SEQ ID NO: 16746 - DNA, 460 bp, Zea mays
  Clone ID: cC-zmpo148049b03d1
gacaagatggcatgcacaaacaatgcgatgagagcctttttcctctttttcctcttctgcatcgagcagggtgagaaggaagagtcaaagggcatcgatccgaaagcgtccgggcctggtgggtccttccacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccacgtggatggcaatctgctggcgaccacggacctaagccagtacaaggaccatggtaattgcatcgagattctacgcgtggataacctggtcatcaccggcaagggaaaccttgacgggcagggcccacctgtgtggagcaagaactcttgca

SEQ ID NO: 16747 - DNA, 574 bp, Zea mays
  Clone ID: cC-zmpo148049b04d1
gtacgccacgcgtccgaaacatgtaccggagcaaggacatgctttttataggactttaccgggacagcgcccggggggagccccgggacggatggcatccacatggcccactcatccgggatcaccattaccaacaccgtcattgccgttggacacgactgtatctccatgggccccagaacctccaaggtgaacatcaccggcgtgacctgccgccctggccacggcatcagcatcggaagcctaaggcggtacaaggacaagaaggacgtcacggacatcaacgtcaaggattgcactcttaagaagacagtgttcggcgtccgcatcaaggcgtacgaggacgccgcctccgtgctcaccgtctccaagatccactacgagaatatcaagatggaggactcagccaaccccatctttatcgacatgaagtactgccccaacaagttgtgtactgccaacggcgccttcaaggtcaccgttaaggacgttaccttcaagaacataaccggcccttcctccaccccggaggcccgtagcctgttttgaatgccaaggtcccatgccccggcgt

SEQ ID NO: 16748 - DNA, 388 bp, Zea mays
  unsure at all n locations
  Clone ID: cC-zmpo148049b05d1
gcggtcgtcgttgtcgagcctgagaacaaagagtttgaggtttttgtggagaagaccgncatcgggaaggaggagccatcagcagtccatgcagaggaaaatattgccaccaacaaggtggcagccgagcccacgaacagaattgaagaaagacaccgaggaggagatatagatggagaaggagaagccatcgctaagctaattgactgcatgtcaattggctgatgcctgatgatcaatgtgcaagaaagagatcgaccactaattggcatacatgtttaagtcgggagagagactcggtcaccttgtaaacaaaacataccttttgtgggtcccgttttccctccatggggttctgataatacaacattcctgggcttattgaatg

SEQ ID NO: 16749 - DNA, 478 bp, Zea mays
  Clone ID: cC-zmpo148049b07d1
gcacgctctacatccaatcggagatcggcggcctcatcgttctgcatttttggctgccgaggctcggcgagttcgggcgcagcacctgctactacgccgaggtggaaaaccacgggcccggcgccaacatgaccagacgcgtcaagtggaggggtatcaagaacatcacctaccagcacgcgctgcataagtacaccgtcgagagcttcatccagggccagcactggctcccacagctcggcgtgccattcatcccggggctgctgccgcagcagcaatcgggcaggatacactgacatctaaggaagatgatatatcatcggcacgctgcgttggcgataatgaccgtggcactaacatgtacgtaccatggttaactttgttggatggcctatgctatttttgactactaccttcttttatatttgataaaaaaaatgccgtcaaaattaacctaaaaaaaaaaaaaaaggggcgg

SEQ ID NO: 16750 - DNA, 554 bp, Zea mays
  Clone ID: cC-zmpo148049c01d1
cggccagcgattcagccagattcgattcgacatgaatcccgagttctactactttttcaaacttctgcttattggggattctggggttgggaaatcatgcttgcttctcacatttgcggatgattcatatttggacagctacatcagcacaattggggttgattttaaaattcggacagtagagcaagatgggaagaccataaaacttcaaatttgggatactgctgggcaagagcgcttcaggaccatcactagcagctactaccgtggagctcatggaatcattattgtatatgacgtgacagaccaagaaagcttcaataatgtgaagcaatggttaaatgaaattgatcgttatgcaagtgacaatgttaacaagctccttgttgggaacaagagcgacctaactgccaacaaagttgtggcaactgagacagcaaaagcatttgctgatgagatgggcataccgttcatggagactagtgccaaaaacgccaccaacgtggagcaggccttcatggctatggctgcctccatcaaggacaggatggtca

SEQ ID NO: 16751 - DNA, 611 bp, Zea mays
  Clone ID: cC-zmpo148049c02d1
gtacgccctgaactcccagccggtccttgttcctcgcccggcggccgtctgctaattatggccgcgccgggggcactggttgaacgggaccccgggccacctggagttcccgcaagctagccgagctcctcgggaatccggtgccaggcctcgccttctcgcggcggtgctccctccctcttcgtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcacatcgaggtggacagggcgaagcaccggcggaagaagcgcgcggaggcgcacgcgctgttcgcacgcagcagggagcaccggcaccagcagcagctgcagcagcaccaccaccagcagcagcaaccgcagccgcggaatgccggcatggacacccgccacccgggggtcgacgccgggttcgccaggcccagggcgcccgcgctgggcgtttgagca

SEQ ID NO: 16752 - DNA, 468 bp, Zea mays
  Clone ID: cC-zmpo148049c04d1
gcaagagaggagggccggcgtcggcgtgcctagcttttcttgatttatagctagccagcatggcgccgagcagcgggatagcagtactgctgctcctcgccgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcatgagctgctcaagtacgccaaggagaagggcatcctgtcaccgaccaacggcatcgggtggtacaagggcatcgtccgggagttcgtggacgcccacaacgagctccgcgcgcgctacggcgtgccgcccatgaagtgtgacatgaagc

SEQ ID NO: 16753 - DNA, 298 bp, Zea mays
  Clone ID: cC-zmpo148049c07d1
gacctgaaaaattgtttagatttaaatcagtttggaaaggtttggcctacacctgcctagagtacctcagctataaggataattctaacctactctgtcggctacaagtggcttggagggaagttctctatgtcaaacggacctccgccccgacaattcatatataactgaatatctagcacaaagacatgaaagtagcaatctctgccaagtgcatttatccacccagcagacaaaccggaaaacaagcgcgtttctccgaagggttcaagttctcaaccacaataggcagttatat

SEQ ID NO: 16754 - DNA, 353 bp, Zea mays
  unsure at all n locations
  Clone ID: cC-zmpo148049c08d1
ctcgaaccatcaagngcaagaggagcaagaaaccaccattttaacattttatgcaggnacgaagaaggcggcgaacacggcgaggctgaccacggaagcggccgaggccccgagccaacaataaacgacagggcccgcacggggccgacagcaccgaggggatggcgacacaagacaaaaagaacagccgcaaggaactgggcaactgcaataagaacctgggccctgaggccttccgtccagggaaacccgtcaactactacacccgtggctgcaacccgatcaccggttgtcgcggctgaacatatttctcttggtgatgtgctcccaatgacaatgtggcatccgcgtgc

SEQ ID NO: 16755 - DNA, 469 bp, Zea mays
  Clone ID: cC-zmpo148049c09d1
ccccctcctccacctttctccttttcttgccacggcaaaactttttcgtttttgagagcatggcgaaggcggggcgagagcgagaggtcaccctggcgtcggcacatgacctcaagaaagtgtcgctcttctcccggactcgcatctacgccgtggctttcatctccggattcgacctccgcattccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggccaacgcgacatcggcgaggtgtttgtgcccatcgacaacctcctggccggcgccgacaagggtggcgatccgaggcccgtgagctaccaagtgcgcaagccgtactttggtcgcgcccacggcgtactctacttctgcta

SEQ ID NO: 16756 - DNA, 561 bp, Zea mays
  Clone ID: cC-zmpo148049d01d1
gtacgacaattccgattccggccgcctcctatacatagccagccttttttcctctttcctcccccaacacagagcagggagccgcgcgcggaggcgaggcgttcgcacacctcgcccgcgccaccaccaccgctccgttgcgcccgccagccgtcacgcgtgacgtttcccggggggccgggggagagagaggcagaaggaggaggcacggagaggacgagacaggatgctcgggttcaggcagatgccgtggtcgtcggcgcaggagcaggagcaggcgccgtcggagcagctgtgcgagggggtgtcggccgtcgtggcggcgcgccaggggatggagaagccgctgacggctgtggcggatgcgttcgaggagctggcgcgcggcatggaggccgatggcggggagctccgcctcgctcccttcagcgactcctgcgctctcgtttccgtgctctttagcagcctcgggatggcctttacgttcgccgagatcgagtacgtcaccaaggtgaacgatctcatcggtgccggcaagtcgtaccgcacgttgagcgacat

SEQ ID NO: 16757 - DNA, 551 bp, Zea mays
  Clone ID: cC-zmpo148049d03d1
ggactaacacaggtgagcgcgacgatgggatccctcgttaattttatcatgtttgtgggcgccgtccttgcggggctcgtcgggggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcggcatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggcgtacatcactgacatgaactacgagcctatcgctccctaccacttcgacttgagcggcaaggccttcggcttccctggcaaagcccgggctcaacgacaagattcgccactgcggcatcatggacgtcgagtttaaaagggtgcgatgcaagtaccccggccggcagaagatcgtgttccaca

SEQ ID NO: 16758 - DNA, 435 bp, Zea mays
  Clone ID: cC-zmpo148049d04d1
aagaagacagggcaggcactcgtggttggcatttatgacgattttgatgacgcctgggcagtgcagcatggtgggggaaaggctgggcgactacctgcttgaacagggcatgtaactactacgtaccagctggaatgcatgtcgacgacgatggtttcgagtttcgacttccaataatagtaacaacaaagcaaaggccttccttccggcgtatttgctttggctcttctcctccacgccataagatatctagcaattggtgactcgccttaattagttcgctttgcttttgaggttgactcgaccattttgctgtaacgtgaattgcatggacatgcaacgctccaatggcctttggaatgtggaatttttttcccgtttctgtaattttcctataaaatgaagtaatgaactggttcttatataattcctctc

SEQ ID NO: 16759 - DNA, 535 bp, Zea mays
  Clone ID: cC-zmpo148049d05d1
aggctgcaggaagagaaggctgcaaagcaaaagtatgttctgtttaacctgaggacgacggaacgggaggctgagcacgaccacctggcgattcacgacctgcaccatatgcttacggagagggagaaagagttgcttgacttggacgctgagctcgcgcactgcaggaggttcctgcataacgatccgttcaacggcgacggacgtaataatggcgctgacacagtgaacacaacgattgacggcagaaatccggcgatcgaatgcttggatggcgcggaccttgtggggagcgccatgtcgctttttgaagacgagaatgcgttcattttggagtccttgagcatactgtaagaaaaccttggcattttcacaaacaggcttgcttccggtgacgccagagggtgtcaagaagacgtgttgtttgaagagcatgaccatacaacagttgatgggtcaccttccaacggtgacaagttgagccgcgttatcaaatttaaggctgggaattctatgcttaattaaaaactgaggg

SEQ ID NO: 16760 - DNA, 621 bp, Zea mays
  Clone ID: cC-zmpo148049d06d1
tgcaaaactgtatatgtatcacatctgtacagcctttttatacatttacaacagcattggagtgtgcggcagggacggtaagcctcaaaatctcctgcctaatcctcatacccatcagctaaaactgtgtgactttggcagcgcgaaagttctggtaaaaggcgaaccaaacatttcttacatctgttctagatactacagagctccagagctcatatttggtgctactgaatacacaacagccattgatgtttggtctgctggctgtgtgctcgctgagctgcttctaggacagcctctgttccctggagaaagcggtgttgatcagcttgttgaaatcatcaaggttctgggcacacccacacgtgaagaaattaagtgcatgaattccaaattataccgagtttaaattcccgcaaatcaaagctcacccgtggcataagatatttcataaaaggatgcctgctgaagcagtacatctcgtgttcaggcctttgcagtactcatccaaacttctatcgacttgctttggaacattggtccattccgtctttgatgaacttcgggatccaacaccccgttaccgaatgggcgtttttttcccctctttcaatttaagcc

SEQ ID NO: 16761 - DNA, 311 bp, Zea mays
  unsure at all n locations
  Clone ID: cC-zmpo148049d08d1
gagganactangaaaacccngacaattttccagtttttatancgcagcgaacccaagagcgcgcaccggggaganggaccacgcaagggccccgcaaaaacgagaacaagggccagcaaacagaacaacaacaancaaacgacagacaaacgggagaacaggccaaggaaaggacaacaaagggaggaacccgaaaagcgaaacaaagcgagcacagggaaggaaaccgacganacggaaccggacaacccaccnaccaccgaagaaaaacagaccgaaggagcagcagcaacncacaccaacggaagaag

SEQ ID NO: 16762 - DNA, 543 bp, Zea mays
  unsure at all n locations
  Clone ID: cC-zmpo148049e04d1
cggaacgtcnnacgagaacctttctccctcctccatttttctctttttcttgccacggcaaaacaccggcgccggggagagcatggcgatggcgtaccgcgtcctgcaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaatgccgtggtacacttccccatcccggctgccgctgacacccgcggtctcgcactccacttgaggctccgcgcccagcgtctatacctgggccatcgcgacatcggcgaggtgtttgtgcccatcgacgaccttctggccggcgccgacaagggtggcgatccgaggcccgtgagctaccaggtgcgcaggccgtactctggccgcgcccacggcgtcctctacttctgctataagttcaccgaggtccccgcccgtttttgtgtttcggaaccggaaagcaa

SEQ ID NO: 16763 - DNA, 390 bp, Zea mays
  Clone ID: cC-zmpo148049e06d1
tggctgtggcgtaggtgttcttgatgaccggctcatggtgcggtcctcccaaagtcctccccaggcaagaacattacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggttttcctcgtgggtcctgcttcgagaccaagtgccataagccctgggagtgctccagcaagcccgtggtggtgcacattacggacatgaactattagcctatcgcggccgtaccactttgatttagcaagcacggcgttacgcgccat

SEQ ID NO: 16764 - DNA, 602 bp, Zea mays
  unsure at all n locations
  Clone ID: cC-zmpo148049f01d1
gtccggttatcctcctcttacattacaggtcatagctttttaggtttttcaggatgncgnggcagacaggcgtcggggggcaccttatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggcttggcgactacctcgtagagcaaggcctgtgaatggattcatttaacctcgctcgctcgcttgtccatggttcgagcatccagcagcaccgataccaacatcagcattatttaattggtagcctcctctagctacgcacgcactttagttccctacacgcccttggattgtgcgtggttctggta

SEQ ID NO: 16765 - DNA, 111 bp, Zea mays
  Clone ID: cC-zmpo148049f02d1
ccacaaccacggcaagtttacagccgtgccgaggaaacccgaccacgcggccaacgggggcggacggaaccgaaccggcaccacaacccccgcaagcggaaacaaggacac

SEQ ID NO: 16766 - DNA, 372 bp, Zea mays
  unsure at all n locations
  Clone ID: cC-zmpo148049f03d1
ccccgaaggcgccacccgaccccaacangaccaccaancacaacgggaagaaggcacaacgcgagggccaccaggaacggagagcccaacagagccgacgcaccggacaacggcggngcgagcggcaccaagaacgcgaaccagccaccccacagcggcaagacggcgagcggcaacgaaccaaacancaaggacgagaagggctgcggagcaagctacaaggggagacgcaaggaaaaaccggagggcgggggcaaaccacacacagggacatcacagacatgaaccacgagccgaacgctccctaccacaacgacgagagcggaaaggcctacggcacccgggcaaagcccgggcacaacgacaagacgc

SEQ ID NO: 16767 - DNA, 331 bp, Zea mays
  unsure at all n locations
  Clone ID: cC-zmpo148049f07d1
gaacaacggggaggngttcaggatttctcagcacaacaccaagaacgggcacaagagcaggnacaaaagcaaggacacgcgcaacaaccgacacaaagngacggcgcccggggaccagcccaacacggacggcaaccacaagggcgacacgnccggggacaccaacaccaacaccngcagaggcgacagcgacgaccagcaaaaccaacggccccgggaccnacaaggagaacaacaccggcgcgacccgcggacccggccacggcaacagcaacggcagacgaaggcggcacaaggaccaaaacgacgccacggagagcaacggcaagga

SEQ ID NO: 16768 - DNA, 481 bp, Zea mays
  unsure at all n locations
  Clone ID: cC-zmpo148049f08d1
gacgggctngaagaacggacagagcccaagccgaagttttacaaattttcctatcccgggaagcanggggcggagacgagaagtcttctacctgctggcgacatcacccagacaatatctgatgataaagcggatatcgcagtgctagaaaagccagaacatcttacttggcaccaccatggacagaggtggaaaagcacagttccaaaaagttataggtgttgatcatacaaactatttggaatacgtgaaaagagagaaaaatggatacattactgcgtcatatcttaaaacacatcaattcttgggttacagacatctattgtcataaggatataaggatgtctgcagcaactcatgatgttccaaggtctgtgattttgtaacgtacatggagttaaccccaaatatattgaaaaaggcaaattgaaacatcattcgctatgccaaaagagcaagctttcttcaagggtgcatatta

SEQ ID NO: 16769 - DNA, 424 bp, Zea mays
  unsure at all n locations
  Clone ID: cC-zmpo148049f09d1
ggccgggacgagaangacggcacggacaacaacgccaatttacagcattctnaagaagacgacgaacggcgggcgcaccgaggcgaacgaagacgccgcccccgcgcacaccgacaccaagagccaccacgagaacaacaagacggaggacacagacaaccccagcggcaacgacacgaagaacagccccaacaagacgagaacagccaacggcgccgacaagggcaccgccaaggacgacaccgccaagaacaacaccggcaccaccaccaccccggaggccgaaagccggcaccgcacagccaaggccccaagcaccggcgacaccaaggaagacggcaacgcagcgganagcggcacccacaacaagaccaaggccaaaagcacgaacgccaaggggcagaccaaggggcgccacaaggag

SEQ ID NO: 16770 - DNA, 522 bp, Zea mays
  unsure at all n locations
  Clone ID: cC-zmpo148049g01d1
cggaacgcgcatacgcggnacgacggcacggcgctttatcaggttgtcaccacggccgccgagcgcggcgacgaggaccggatggaggccttcacgcacctgcgcatggggcccgacctcttccacccggacaactggcggcgcttcgccgccttcgtgcgccgcatgaacggcgccgggacgtgccgggaggccgcggagcgggaggcgcacggcgtcgcgcaggccaccgggtcgctggtgcacgaggccgccgtcgcgctgcggagctgaccggccgggccgggacgggaccgaacggaagcctaccatcgactgtacatacaggggttgggacttgggagggagctcggctacttgttgggttttcctttgggtggagagcgagggagcgcaatcaagagccagcgagcagtctctcgtgccgtgcaatgcaatgcaatgcaacttcggcgtaaaagaaattgtattgtgaccaaacccggaaggaaagcagggaggggaggacatagatgttttgtc

SEQ ID NO: 16771 - DNA, 597 bp, Zea mays
  unsure at all n locations
  Clone ID: cC-zmpo148049g03d1
gtccgggacatttgcttaggcaccaacaacattgtaaatttaagattttcatgatcgagctggcatagggtagtcaggccttaaattcaatcctgatgggtctactcctattgcatctactgcagcatccatctctgaactgtcttcttacctagacagtgatactgtcacccaatttggtgcagacttcaacattcttaattggtggtagaggcataagcttacttatcctattcttgctcttcttgctaaagatgttttgactgttcctgcttctaccatatcttcagaatctacctttagtcttgctggcagggtgctcgaggagcgatgacgacgactaacaacagatatggttgaggtcttatcctgtattaaggattgggagctagcagacaagcatatgcagaatactatcgaaaacgatacgaaggaacttaaagcaacctatgagaacatgtaccttgatgttgaagatagagacaaggacaaagatggagaatcaagacctggaagaagttgagtttgtagttgtctctatggctgtttcattgngcgtgtttacttcattgtggctgtttacttatctattgatgt

SEQ ID NO: 16772 - DNA, 601 bp, Zea mays
  Clone ID: cC-zmpo148049g04d1
cacgcgtccgcgccgagttccgcacgttcattgaggtggtcttttagaacctttagaagagcatcgacaccatccacatcgagggctacgccttcttcgccgtcggcatggggcccggcaaatggacgccagcgtcgcggagtacgtacaacctcctggacacggtgagccggcacacgatccaggtgtacccaaggtcgtggacggcggtgatgatgacgttcgacaacgcgggcatgtggagcgtccgctccaacatctgggagaggcagtacctcggcgagcagctgtacgtgagcgtcatctcgccggagcggtcgctcagggacgagtacaacatgccggagaccagcctccgctgcggcaaggtcgtcggcctgccgatgccaccgtcctaccgcgccgtctagagcgtcgatcgatcgcgcacggtgctgtacacaactaaaggagagcgagaggggactttttctcgcgtttccttctctagccagccttgtctgtccccccctccgttattctctctctctttcttttcggtcgcttccgaggaataatacccaaacaaaaaaaaaaggggctcaagactcatcatgcatgc

SEQ ID NO: 16773 - DNA, 448 bp, Zea mays
  unsure at all n locations
  Clone ID: cC-zmpo148049g05d1
cacgggaggaacaacccaatctttgnacctttttacacacagncagacatggggaacggcgggcgtcttagccgagcctgaacccgcacctcgccggagtcgtccgcgacggtgcgcctggtgtactggggcgggcggtcgaggcagctggcgctcacggacggcggtgacgacgccattgtcacggccggagacgtcgcggtggagcttccaccgtcggccgcgggctacgccgtgtgccccgccgacgccttcttcatcggcctcccgatcccggccatgtccccgggcgaggagctcctgccgggccgcacctactgtgtgctccccgccgcgcgcctcccttgccttaaggcgctcactcccgccacgctcgacgcgctgtcgcaatgcacggcagaaagaagcagcagcctatcttcgcggtcgcggggtgccccgtcgagca

SEQ ID NO: 16774 - DNA, 566 bp, Zea mays
  Clone ID: cC-zmpo148049g06d1
gtccgaaagaagtcgcctaattctttcgatcgaattattttccttttttttcccacgctccgtctttatgggtaatcggaggcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcattctgtcggtgcggccgaacgccacgaactgccttgtcgacgagagccacgtgtgctggaagaacggcaagattgcgcaggacatgatccttccgcttaggaacgtggagagcggggagattcagttgc

SEQ ID NO: 16775 - DNA, 332 bp, Zea mays
  unsure at all n locations
  Clone ID: cC-zmpo148049g07d1
acaacaccgaccacaaggacagcaacactaaggaggttcagccggcggacagcaccagcgagccggcgggccagaacacgggcgacaacaccccccaccccagagggaacgacccgacaagccagaccgaggaggaccaaagagcagaaggccagcaacccgcggaacaagacccacaaaccggacgcggcgaaagngacaaagccggagcagaccgcagagacagagcgccncaaggcgaagaaacaggacgggccggggaagccgcaagggaccaagcaagggaggaaggggcagaacgccaacgacacccacaacaacgaggagacacc

SEQ ID NO: 16776 - DNA, 257 bp, Zea mays
  unsure at all n locations
  Clone ID: cC-zmpo148049h01d1
gggcggaaggagaacnanaggctgaggcaaancaaccattagcagagtctgaagagcggcagggagccgggcgcggccgcgacggaccgcgacgacaaggacaaganccgcagcgaggggaccgccgcgcccggcccgcccccgagaagaggaggaggcggaggggcgacacgnccagacanccgagccggacgcagaagacggggagggccccgacgcccgccctgcagcccaacacagcgaggacgccgcagccg

SEQ ID NO: 16777 - DNA, 356 bp, Zea mays
  unsure at all n locations
  Clone ID: cC-zmpo148049h02d1
gggcgggcanngaaagccnagagngnggcccagaaacttttgcaagttttccatcaacgaccagctgccggcatggcgggctncctctccatcaactaccacttcaagactgtggggcaagagctcaccaagagcagatgaggacctgcctagcaatggcagcatgacgcggtggcgacgagctgctatatgcagctcttcctctccactaactaccacttcacgacagtggggcagaagttcatcaagatcggatagggatcacaagttggacatgtttttttttgtctatctacatactgtatttggagatgtacttctttattctctacaatcgggtaaccatggattgcttg

SEQ ID NO: 16778 - DNA, 556 bp, Zea mays
  unsure at all n locations
  Clone ID: cC-zmpo148049h03d1
gtacgcggagctgnnggcacaangatatcctcctncattttctcttttttcgcaatagcgatattcagcggaatgaagggtgggacgctagatgtcggggattttctccctattggagctatcttttctgcaacggattctgtgtgcacgctgcaggtcctccatcaggatgagacgccctttctgtacagtctcgtgttcggtgagggagtcgtgaacgatgccacgtctgttgtgctcttcaacgcactccagaacttccatcttaaccacatcgatgtagccgttgtgctgaatttcttgggaaacttctgttacttattcgtgtcaagcaccttacttggagtgtttactggattgctcagtgcctacataattaagaagctatatataggaaggcattccactgaccgtgaggatgcgcttatgatgctcatggcttacctctcctacatgctggccgagctgctagatctgagtggccatcttaccgtattcctctgcggcatcgtgatgtcgcattacaccctgccacaatgtgacagagagctcaaga

SEQ ID NO: 16779 - DNA, 608 bp, Zea mays
  Clone ID: cC-zmpo148049h04d1
gtccgcccacgcgtccgggcaagcgatcgtcggagcatttagagactttctcgcctccatcccatcccggggccgccggctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaatgtggggggagagacttggctgcgctgcgctgctctgctgctcccgcgcattcccgatgcgtgggcgtgctctgattgggcacggcggtggcagtggcacaccttcgtcttccttttgatcgctttttttccttctctttcacttgaatttcatttaacgaattggtatcgctgatgcaccactttaattatggtgccctggtatttggtccttatcctcgagtgagggatcgacacccgtaccattgcttgccatttgtttggaccggttaacaattcgctttaacctt

SEQ ID NO: 16780 - DNA, 441 bp, Zea mays
  unsure at all n locations
  Clone ID: cC-zmpo148049h05d1
gtccgcccacgcgtccgcgagaagnaccaactcaaggtttcctccgtttcgccatgancgncctccggggggtgcatggctgcattcattgctgccctgcccgctcgcccaagaattgaagatggtagctgccttccgcgttttttgtattgcgtatgtctatgcactgcattcgagggcagcgataatgggcctggcctcgtaagcaaacgttccatccgcttcttttgatgggcctaaatctgcatgcatgcagatgtactgctacttctgctcttttatattgcttttttttttaattttattaacttctcgttttctccctcatccctcgtcgaggaggaagggtatccctttcgtttttatgatgcaaaggtattcccttttgtttgtatagtacagtatctcatcaaaaaaaaaaaaaaagggcggccgttttta

SEQ ID NO: 16781 - DNA, 480 bp, Zea mays
  unsure at all n locations
  Clone ID: cC-zmpo148049h06d1
gtccgaacacaggtgagcgcgacgatgggatccctcgtttataactttttgggcgngggcgccgaccttggggcgctgggcgtcgtcgggtcgtgcgggcccccgaaggtgccacccggccccaacatcaccaccaactacaacggctagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacattactgacatgaactacgagcctatcgctccctaccacttcgacttgagcggcaaggcctttggcttcctggcaaagcccgggcttaacgaccagatttgccactgc

SEQ ID NO: 16782 - DNA, 446 bp, Zea mays
  unsure at all n locations
  Clone ID: LIB148-008-Q1-E1-D12-TGA
caggttcgacttgagggcctccacgtcggttgccgggactttgtggatcttgtcattgttgtacacaaagctccccataatagccttgaagnngagatacttggtcacgttggtgcggatcaggacgcggaccagcgcgccgtttgccatcatgaacttgggcaccatgtcgacgttgtactctttgctgacgcccaggtgctcgggagggctgtcgttgcccttgaacctgttccagagcttggttagattcagggacgaagattctcctccgtagtagtcattcctgtccatgtgaaggaccttgaggccatcgacggagaggaggccgctgatgatgcactccttgagccccgtccccaacacgatcacgtcgtactcctcatccatctctctctctctctctctttctctgcctgcttgccttcttctcctcgatctcacgc

SEQ ID NO: 16783 - DNA, 385 bp, Zea mays
  unsure at all n locations
  Clone ID: LIB148-008-Q1-E1-D12-TAA
caaccaaggaacgaggacagaaaaaggtgggaagnanaaagngnacggcaaagagcancatccggagcgacncancacccaccgagccacccagngggcacgacggggagagacggacgccacgaccaccgggagccaaagggacgaccgagcccaagccggagccaggacaggaccacaacgaaaaacagaaaagagcaccgcgcgagccacaacaggcaaccccgcagagacaccaacccganggacgccagccaccagcagcaccaggaagggagaaggaagggaagacgggcaaggcaaacaagaacgaaacgcgacgcaggaaacgcgagacgagccagggcaaagcaggcggggcaagacgagcgacacgcgaacgcca

SEQ ID NO: 16784 - DNA, 261 bp, Zea mays
  Clone ID: LIB148-008-Q1-E1-D12-TCA
aagatgggtctaatgtatcaaaagttgaagatggtcatgtcgatagaagtgttggtgtgaagaagcccagatattctgcagatgaaggcccttcgttgactgaactgagtggatacaatgcaaagagacacgagtttgacccagagtatgataatgatgccgaacaagcgcttgctgagatggaatttaaagaaactgattcagaaactgatcgtgaactgaaactccgtgtgctgcgtatttatctgtccaggcttgatg

SEQ ID NO: 16785 - DNA, 614 bp, Zea mays
  Clone ID: LIB148-012-Q1-E1-E4-F4A
tgtgtcaccgaggctcttctgttcaaagctgatgcaccacaccggcaacgagctcttgcagcggacgcaataacctgccggaaattcgccgagcgggcttacaagtacagaccactcaaagttgttgagtttgatcggccctacccacagtgcatagcatacttggatctcaagcgcgacgagtgctctcgactctttcctgcagggcggatatactcgcaagccttccaccttgcagggcagggtttcttcctctcagctcactgtaacatggagcagcaaagcgcgttctactgcttcgggctcttcctggggatgcaagagaagggctccacgagtgtgacagtggactacgagttcgctgcaaggacgagaccatccggcgagtttgtgagcaagtacaagggtaactacacattcaccggtggaaaggcggttgggtacaggaatctctttgcaatcccatggcagaagttcttggccgatgacagcctcttcttcgtggatgggatgctgcatctgagagccgagcttacgataaagcaaccctagagcaatggtctctgtatagtggtagttgttacgacagatgaaaaatatatcgggatgggata

SEQ ID NO: 16786 - DNA, 460 bp, Zea mays
  Clone ID: LIB148-012-Q1-E1-E4-R4A
atctcggaacttaatcaaatccttgtacttaacagcgagaaaatccttagctgcatctgtcagaggttgaactgcagctgccattgaaactgagcaagggagatctaggtagagaagtgcagattctgtggtcatctgcaagcttgtgagcaactggctgcagtacctcatgcatgaaacaacctcaaatttgtcggcagccatcaagatatccagaagaagagtgggctcagtagttgtcaactttccactatacataaagcttaaaagctccatgagggcaatttcctctgagtcagtaattctaagggttgcatgtctctggtccgattctttcatgccgtttgagaaaagcttgaaaaagaaaggactcttcgcagcaagaatcgccgaactgatataaattgtcttgactcgtaaaaccggcgtaactacagcagcccaagatggatcaatacct

SEQ ID NO: 16787 - DNA, 330 bp, Zea mays
  unsure at all n locations
  Clone ID: LIB148-048-Q1-E1-F3-F3A
tggaaggccagtcctaccacaagagctgtttcacagtgctcgcacgggggctgcatcctgaccaccttctcctacgccgagctcaactgcgatctgtactgcaagatccacttcacgcagctgctcatggagaaggggagctacggccacatgatgaagaagagcccgtcccaggatacactgccggacatggcagccgacgagcaaccgccggaaccggcgccaccgcacgactgggaaggagaggacaactaggaggaagggaccgccaccaatatatattacacacacacacacacactcacacattntnacactcaagtctgggtt

SEQ ID NO: 16788 - DNA, 185 bp, Zea mays
  unsure at all n locations
  Clone ID: LIB148-048-Q1-E1-F3-F4A
acaaccaagacccccgagaacacgggccgacaggcagcnggcaaggagagacaccagangtctccgngacggcagaggaggcacatgacaacggcgaanacggcacggagcagggccagccccgcggaaaaacgggaaccgcgaaagcagaaccgcnacanaaggagccgaacaacgaagnnccg

SEQ ID NO: 16789 - DNA, 635 bp, Zea mays
  Clone ID: LIB148-048-Q1-E1-F3-R3A
gccgttccgcggttgctcgtcggctgccatgtccggcagcgtatcctgtgacgggctcttcttcatcatgtggctgttgctccccttctgcatgaacagatgagcgaagtggatcttgcagtacagaacgccgttgagcgcggcgtacgaggaggtggtgaggatgcatcccccgtgcgagcacttgaagcagctcttgtggtaggactcgccttgcagagttaacttttccagcgggtacactgttttctggcaagctgcacacttatcctgagtaccagaaaacgcagatgatagcttgctgggggcccttgtcagttcacccttgtctgaagacttgccacctggcgtgaagttcttggagaagctcccggtcttcttgaagagctgcttgaagtgggtcttgcagtacagcacaccgttcatggaagagtggctgcacatcgagaggatccctttgcactggctgcacttgaagcatgtcttatggtaggggacgcccgcggccgtgaggaggtcgatgaagtggaccggcttgtcgcactccgcgcacttgtcttgcatgccgttgaaagaagacatggtgccgacgcctgcctgtggtttgacgcacgcactctcgcccggacgcgtgg

SEQ ID NO: 16790 - DNA, 237 bp, Zea mays
  Clone ID: LIB148-048-Q1-E1-F3-R4A
caccacacgcgtccatgcgaagagtaggctgcacagccgagaggcatccctgtgcagctggctagcagcttgaagcatgatcatatggtattttgactgccgtcggccgtgaggcaggtggacgaagtggaccgtgttgtccaactccgcgcacttgtcctgcgagccggagaaagaagacatggagccgacgcctgactgcgggtgaacgcacgcactctaggacggacgcgtggg

SEQ ID NO: 16791 - DNA, 644 bp, Zea mays
  unsure at all n locations
  Clone ID: LIB148-060-Q1-E1-H6-F2B
gagcacggagagccaccagagctcgtggaagtttgagagctggctgaagatgacctgcaccacgccgaagccgacgatgtaggagcccgtgttctgggtgcagtcggcgtcgtgcccgtgccagtggaagcagttggacttgaggatagccgcagcgctggcagaagccgtgatggtgtagccgatgccggtgccgaacatgttggcgtactggcagaagccgcagaaccagacatacctgccgcctaggtaggactcgacggcctcagtgtaggtgtagttgcgcttcccggtgacagggtcgccgaagcggtagcagtcggtgaggaggcaggaggtgtagtaggtgatggccgcgaagagcagcaggatcacaggcccgggcacccagcccagctgggccattgnccacgccagcgacagcacgccggacccgatcaccgccgtgatgatgtgcgccgacgccgtccacaccgtccctgtcctcttctccttgccgtcgtcgtcaagttcgccgccatggctagcaccgccaccgcgggcttgcatgtcgacgtccatggcgccttctccgtcacgcatcaacctctccgctatactcctcctttgcccctctacctagctgcggaaacaatgtgggcttg

SEQ ID NO: 16792 - DNA, 612 bp, Zea mays
  unsure at all n locations
  Clone ID: LIB148-008-Q1-E1-D12-F5A
ctgggcgactacttcctcggccccagcctcgacgccttggtacagcagctcgccgagaacgatgcggcgcggcacggaacgccgcctgtcaagaaggaggccgtggaggcaatgccgaccgtggaaatcgccggcggcaacgatggcgacgacgcggcagctgcccggctgctggaggactacgcggccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcggnggtgatggtagggcaagctctccgggcaacgccgagctagctgaagctgaagagagtggcaggcgggtgcccgcatccctggcaggggctcaacagcctgttctcgccgtcggcgcaatcctccggtagcggcggcagcagtttcgcatcattgggagaactaaggcaatattgccatgggttgcctgccgcttgaaagccttgggccccgttgggttgggtccccaa

SEQ ID NO: 16793 - DNA, 389 bp, Zea mays
  Clone ID: LIB148-008-Q1-E1-D12-F6A
gaatgaattgttgaatggattcaaacaaatggcaagcgatgaaatgatacaagtgttaatccctctctcaggggaagaacatcagcggcatgcatcaattcgttaaattaaggagaaagagggaacaaagaaaaagaggacaaaaggtgtgtcgaatcaaaaaacatgcccacgcatcggaatgcgcgcagccatgtcactctctctccccttcgtcttttcctcggcctccgggcgccccggccggcttactgaatgtagtaggcgaagaaggaggcgacggcggccccgagggcggcgccgacggcgggcgcgacggcggaggagccgctggtgggggccggagccggagccttcgcggcgagcgccacggtggccgccgaggcggc

SEQ ID NO: 16794 - DNA, 437 bp, Zea mays
  unsure at all n locations
  Clone ID: LIB148-008-Q1-E1-D12-R5A
cacctgtaccaccgcgccgtcgccggcgccgtcaccgncgncggtcgcggccccgcgggcggnctccatctcctcgaggttttcgctgtggcagaacgggcacttgatctccacctcgccctccgcggggctaacggccgcggcgcacatgtggcaccagacctccgcgcccgcctgctccgccattgctgctgagcttctagcgctttaatttccccgccaatgcagctactctagtaattgtttgttggggggtgggggaactcagcttgggcagggcggggcggggcggaggcagggcatgtgggtggggacggggaggaagggggagcagcgaggccagaggggccggctgtctccgcctgctttatactagtgattaggccagagcagcggcagcatcctcctccctgcatcgatcatggcctcggcccggc

SEQ ID NO: 16795 - DNA, 428 bp, Zea mays
  unsure at all n locations
  Clone ID: LIB148-008-Q1-E1-D12-R6A
cacttgagacaccgcgccggcgccgtcgccgtcaccgtcgtcggtcgcggccccgcgggcggtctccatctcctcgatgaagccgctgnggcagaacgggcacggcatcttcacctcgccctccgcggggctaacggccgcggcgcacatgtggcaccagacctccggcgcccgcctgctccgccattgctgctgagcttctagcgctttaatttccccgccaatgcagctactctagtaattgtttgttggggggtgggggaactcagcttgggcagggcggggcggggcggaggcagggcatgtgggtggggacggggaggaagggggagcagcgaggccagaggggccggctgtctccgcctgctttatactagtgattaggccagagcagcggcagcatcctccttcctgcatcgaacatgggc

SEQ ID NO: 16796 - DNA, 591 bp, Zea mays
  unsure at all n locations
  Clone ID: LIB148-043-Q1-E1-F4-R3C
agcgtgagcctctcgggacggcttcaacgtggcggtcgtggtgacaggctgccgccggagggcgggcggcggngtcccacgctgggatgcgccgnggacctgggtgccgactgccccgcgcgcccgagcgccatgaggaggatgcggcgctgttcaaggccgaggcccanngacacgaggaccaacgccacaggacgtcgaggtgacgccgcaggaccgcgtcaagcccgttgagatcaaggttgtcttgtgccccaagcccgccaccatcgtcgcgggccacctctagcgcgccgcgccatgcatgcgtcgtcctggtgggcgcggcggtggtgtgccggtaccgcaaggaggaggcctggaacgagtcgacgtgcccggtgtgcctggccgacttcgacgacggcgaggtcgtgcgggtgctccccgagtgcatgcactacttccacgccgactgcatcgacacgtggctgcgcgggagcaccagctgcccgatgtgccgcgccgagaccacgcccacggccacgcctaggccgggctccgtgcgccaccacctcgagctctcccgctccgtcgaggagatcctcgtcg

SEQ ID NO: 16797 - DNA, 331 bp, Zea mays
  Clone ID: LIB148-043-Q1-E1-F4-R4A
gccacctctagcgcgccgcgccatgcatgcgtcgtcctggtgggcgcggcggtggtgtgccggtaccgcaaggaggaggcctggaactagtcgacgtgcccggtgtgcctggccgacttcgacgacggcgaggtcgtgcgggtgctccccgagtgcatgcactacttccacccactgcatcgacacgtggctgcgcgggagcaccagctgcccgatgtgccgcgccgagaccacgcccacgcccacgcctagcccggcctccgtgcgccaccacctcgagctctccgtctccctcgaggagatcctcgtcgcgacgtgagcagcgccccga

SEQ ID NO: 16798 - DNA, 578 bp, Zea mays
  Clone ID: LIB148-048-Q1-E1-F3-F3C
acccgctgcagaaggtaactctggaaggcgagtcctaccacatgagctgcttcaagtgctcgcacggggtttgatcctcaccacctcctcctacgccgcgctcaactgcgttctgtactgcagagatccacttcgcgcagctgttcatggagaagggagtacagccacatgatgaagaagagcccgtcccaggatacgctgccggacatggcagccgacgagcaaccgccggaaccggcgccaccgcaagacggggaaggagaggacaactaggaggaagggaccgccaccaatatatatcacacacacacacacacactcacacattctcacactcaagtctgcgtttgccatttttcttttctttttctctacgacttcgttattccctcctttcatctatctctccgtgaactcggtttgtcgtccagctggctgtaagtgtaccagatgccttcgttacgtctgatgaggctcatgacaatggcgattttggcatggagttgtgttagcctcgcggaaaaactgtaactgtgtaagcagaactgctatatattgttcctaacaatgttgtcctt

SEQ ID NO: 16799 - DNA, 195 bp, Zea mays
  unsure at all n locations
  Clone ID: LIB148-048-Q1-E1-F3-F4B
gttatnncctnctttcatatatctctccgngaactcggtttgtcgtccagctggctgtaagtgtaccagatgccttcgttacgtctgataggctcatgacaatggcgattttggcatggagttgtgttagcctcgcggaaaaactgtaactgtgtaagcagaactgctatatattgtcctaacaatgttgtcctt

SEQ ID NO: 16800 - DNA, 173 bp, Zea mays
  unsure at all n locations
  Clone ID: LIB148-048-Q1-E1-F3-F4C
tctctccggaactcggtttgtcgtccagctggctgtaattgtaccagatgccttcgntacgtctgagtaggttcatgacaatggcgattttggcgtggagttgtgttagcctcgcggagggactgtaactgtgtaagcagaactgctatatattgcctaacaatgntgncctt

SEQ ID NO: 16801 - DNA, 555 bp, Zea mays
  unsure at all n locations
  Clone ID: LIB148-048-Q1-E1-F3-R3B
tgccacgtccggcagcgtatcctgggacgggctcttcttcatcatgtggctgtagctccccttctcctcgaacagctgcgcgaagnggatcttgcagnacagaacgccgttgagcgcggcgtaggaggaggtggtgaggatgcagcccccggcagccttgaagcagctcttgtggtaggactcgccttccagagttaacttctccagcgggtacactgttttctggcaagctgcacacttatcctgagtaccagaaaacgcagatgatagcttgctgggggcccttgtcagttcacccttgtctgaagacttgccacctggcgtgaagttcttggagaagctcccggtctccttgaagagctgctcgaagtgggtcttgcagtacagcacaccgtccatggaagagtagctgcacatcgagaggatccctttgcagtggctgcacttgaagcatgtcttatggtaggtgacgccgtcggccgtgaggaggtcgatgaagtggacggtcttgtcgcactccgcgcacttgtcctgcgtgccggtgaaagaagacat

SEQ ID NO: 16802 - DNA, 475 bp, Zea mays
  Clone ID: LIB148-048-Q1-E1-F3-R3C
gctgccatcggcggcagcgtatcctgggacgggctcttctttatcatgtggctgtagctccccttctccttgaacagctgcgcgaagtggatcttgcagtacagatcgccgttgagcgcggggtacgaggaggtggtgaggatgcagcccccgtctgaggcttgaagacgctctcgctgtcggactcgccttccagaggtcacttgtccagaccgtacactgccttctcgcaagctgcacacttatcctgtgtacctgtaaacacagatgatagatcgctgggggcccttggcagttcacccttgcttgaagacttgccacctcgcgcgcagttctaggagaagttcccggcctacttgtagagctgctagactggggtgtcgcatgacagaacaccctcccttgaagagtagctgcacatctggccgatccctatgcagggaatctacttgaacaatgtcttatgggaggcgac

SEQ ID NO: 16803 - DNA, 226 bp, Zea mays
  unsure at all n locations
  Clone ID: LIB148-048-Q1-E1-F3-R4B
gtcctggaagagtagctgcacatcgcgaggatccctttgcagtggctgcacttgaagcatgtcttatggtaggtgacgccgncggccgtgaggaggtcgatgaagtggacggtcgtgtcgcacttcgcgcacttgtcctgcgtgccggtgaaagaagacatggtgccgacgcctgcctgtggctgcacgcacnngcactctcgcccggacgccgtgggcggacgcc

SEQ ID NO: 16804 - DNA, 540 bp, Zea mays
  Clone ID: LIB189-026-C9-F2A
agcaacaaaagtggcttaatagatgttcagaattgagcgacactacagtcaaagatgcacaacacttgacactagcttgtacacagtaaaattcttctctggtacaccgtacacatcaggagacgaaacaaaactcctgcgctctcttatttaaccaagatcagggactatgaggtaatcctcgtcgtcggtgacctcgatccgggccttcttgctctggcgaaccccagcgccgccgccggcggcggctttggccggcctgtagtacgccgcgtcgttcgccgcctggtatccgaaaagctccggcacctccgccaacgtcctgctggctttgggcgcctgctcgtggaagaggtcgatgtcggcgaaccactccagctccttgaacccgagcgtcggctccttgtgcagcttgtcgctggactcgtagtcggagaactgcaagagctcgtcgacggcccagccctgcggcaggaactgcggcggcgagggcacctgctgcaccgcggcggaaacggcggcgtgcggtggctcgatggt

SEQ ID NO: 16805 - DNA, 510 bp, Zea mays
  Clone ID: LIB189-026-C9-F1A
agcaacaaaagtggcttaatagatgttcagaattgagcgacactacagtcaaagatgcacaacacttgacactagcttgtacacagtaaaattcttctctggtacaccgtacacatcaggagacgaaacaaaactcctgcgctctcttatttaaccaagatcagggactatgaggtaatcctcgtcgtcggtgacctcgatccgggccttcttgctctggcgaaccccagcgccgccgccggcgggcatattggccggcctgtagtacgccgcgtcgttcgccgcctggtatccgaaaagctccggcacctccgccaacgtcctgctggctttgggcgcctgctcgtggaagaggtcgatgtcggcgaaccactccagctccttgaacccgagcgtcggctccttgtgcagcttgtcgctggactcgtagtcggagaactgcaggagctcgtcgacggcccagccctgcggcaggaactgcggcggcgagggcacctgctgcaccgcggc

SEQ ID NO: 16806 - DNA, 431 bp, Zea mays
  Clone ID: LIB189-026-C9-R1A
cttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgcgagcaagcaccagcgcctcccgctcgaagagctctccgccaagctcccgcgctgcgacgtctgccaggagaaagcggcgttcatcttctgcgtggaggaccgggcgctcttctgccaggactgcgacgagcccatacacgtcccgggcacgctctccgggaaccaccagcgctacatggccaccggcatacgcgtcggcctcgcc

SEQ ID NO: 16807 - DNA, 509 bp, Zea mays
  Clone ID: LIB189-026-C9-R2A
cttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgcgagcaagcaccagcgcctcccgctcgaggcgctctccgccaagctcccgcgctgcgacgtctgccaggagaaagcggcgttcatcttctgcgtggaggaccgggcgctcttctgccaggactgcgacgagcccatccacgtcccgggcacgctctccgggaaccaccagcgctacctggccaccggcatccgcgtcggcctcgcctcggcttccgcctgcagcgacgcctgcgacgcccacgacttcgaccaccacgccccgtccaaggccaccatcgagcca

SEQ ID NO: 16808 - DNA, 363 bp, Zea mays
  Clone ID: LIB189-013-Q1-E1-G8
cgcagttcacgcttggctgacgaccgacccccattcgttctagccctccctccgacactccgatccattactcgctatggacgcggcgggcggcgaccagctaagcctggccgcggtgcgcgacgcgctggtgcggctggaggactccgtggtgttcgcgctcatcgagcgcgcccggcatccgcggaacgcgccagcctacgcgcccgccgccaccgctggagaacattcgctcgtggagttcttcgtccgggaagcagaggccctcaacgcaaaggctggacattatcaaaagccagaagatgttccattcttccctcaagatctaccctcacctctctttcctacaaagccttccccaaa

SEQ ID NO: 16809 - DNA, 404 bp, Zea mays
  Clone ID: LIB189-019-Q1-E1-C5
acggacgcgtgggcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtcaactggtgttttcactgaccaggagaaggctgca

SEQ ID NO: 16810 - DNA, 391 bp, Zea mays
  Clone ID: LIB189-018-Q1-E1-E9
caaatccacggtttaataacgaaccgtgttaacttaccataacaacaactcaattcctatcgaattccttcctatcgaattcctatagtaaaattcctataggatagaacgtacacagggtgtacacattatatatgaatgaaacatattcattaacttaagcatactcctttttttatttaatgagttgatattaattaaatatcttttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactaaaccccg

SEQ ID NO: 16811 - DNA, 421 bp, Zea mays
  Clone ID: LIB189-012-Q1-E1-H11
aaccagattttgatgcctttattgatccgcacaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggac

SEQ ID NO: 16812 - DNA, 396 bp, Zea mays
  Clone ID: LIB189-006-Q1-E1-A5
cccacgcgtccgcccacgcgtccgcggacgcgtgggcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgt

SEQ ID NO: 16813 - DNA, 397 bp, Zea mays
  Clone ID: LIB189-018-Q1-E1-G1
gatgctctgcgtccagtgactgatcttccgttggatgtacatctgatgattgtggaacctgagcagcgagtccctgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattacgttcttgatgttgttgacctggtgctgattatgtctgtgaatcctgggtttggtggccagagctttatcgagagtcaagtaaagaaaattgcagaactgagaaggttatgtgcagagaagggagtgaacccctggattgaggttgatggtggtgttggtccgaaaaatg

SEQ ID NO: 16814 - DNA, 416 bp, Zea mays
  Clone ID: LIB189-031-Q1-E1-D1
agaaccaaatcgcttaccgcccccgaagcgtctcggttcgcatagcaaagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgctcaggaaggcattccatgtgagggcatcagctcgggttgacaagttctcaaagagtgacatcatcgtgtccccttcgattctgtctgcaaactttgcgaagcttggtgatcaggtaaaagctgtggaggtggcaggatgcgactggattcatgtcgatgtcatggacgggcgctttgtgccaaacatcacaattggaccc

SEQ ID NO: 16815 - DNA, 406 bp, Zea mays
  unsure at all n locations
  Clone ID: LIB189-032-Q1-E1-B6
agtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgangaggacgaggaagcaacg

SEQ ID NO: 16816 - DNA, 425 bp, Zea mays
  Clone ID: LIB189-010-Q1-E1-C10
acctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggctcttgatctggtcccaaccaagatccacgacaggtccccgatattcctcggaagctacgacgacgtggaggagatcaaagcgttgtacgccgagcaggcgaagtcgagctcggcttcatcctaag

SEQ ID NO: 16817 - DNA, 367 bp, Zea mays
  Clone ID: LIB189-011-Q1-E1-H7
gtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgc

SEQ ID NO: 16818 - DNA, 412 bp, Zea mays
  Clone ID: LIB189-029-Q1-E1-D12
agtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcga

SEQ ID NO: 16819 - DNA, 353 bp, Zea mays
  Clone ID: LIB189-017-Q1-E1-C6
cggacgcgtgggcggacgcgtggggatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctg

SEQ ID NO: 16820 - DNA, 374 bp, Zea mays
  unsure at all n locations
  Clone ID: LIB189-015-Q1-E1-C5
gctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcgccgatcgacgtcgtcgtcgtgaacgacagcggaagcgtcaggaacgcgtcncacctcctcaagtacgactcgatgctcggcaccttcaaggccgacgtcaagatcgtggacgacacgaccatcagcgtcgacggcaagcccatcacggtcgtctccagcagggacccgctcaagctcccatggggtgag

SEQ ID NO: 16821 - DNA, 407 bp, Zea mays
  Clone ID: LIB189-019-Q1-E1-D11
agcatttcagtctgtctccaaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtc

SEQ ID NO: 16822 - DNA, 379 bp, Zea mays
  unsure at all n locations
  Clone ID: LIB189-018-Q1-E1-C10
cccacgcgtccgcccacgcgtccggtaactcctaccccagaaggtgactggttttctacaggggtttatacgactggaaatccttatggcatagcagaggatatcgtgttcagcatgccatgcagatcgaagggtgatggtgattacgaactggctagtgatgtgttgatggacgattttctctgggaacggattaaaaagagcgaagctgaattgcttgctgagaagaaatgcgttgcccatcttacaggagaggggaatgcattttgtgatcttccggaagataccatgctaccaggagaagtgtagtttagttacagaagcaacagcagtggaatgcattttgccaatacattagctgagacttganacatctgct

SEQ ID NO: 16823 - DNA, 371 bp, Zea mays
  Clone ID: LIB189-002-Q1-E1-B7
agcccacgcgtccgcggacgcgtgggcggacgcgtgggcggacgcgtgggggagcacctgtgcttcgagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggaggcgcgcttcgtcgagtacttcagatcggctacaccggagaccgagtacgggaggatgaacatcggcagccggccagccaagatgaggcccggcggcggcatcacgaccctgcgcgccatcccctggatcttctcgtggacccagaccaggttccactccccgtg

SEQ ID NO: 16824 - DNA, 435 bp, Zea mays
  unsure at all n locations
  Clone ID: LIB189-009-Q1-E1-G7
acggacgcgtgggctggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtagttcgccgacgagaacaagcccgccggactggtcaagctgaacccggcgagcgagtacccgcccggcctggaagacacgctcatcctcaccatgaagggcatcgccgccggcatgcagaacactggctacgcggcttctcttcactcacctgcagagtgcaccgcaataatcagcttccggatggtggcgtattgtcagttttggatggaaatgccgaactggcagcgtctgtnttccctatgcatatg

SEQ ID NO: 16825 - DNA, 412 bp, Zea mays
  Clone ID: LIB189-031-Q1-E1-H11
cggacgcgtgggcggacgcgtggggggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaaaccggcgaaacaatttaccccccgggcctggaagacacgctcatcctcaccatgaagggcatcgccg

SEQ ID NO: 16826 - DNA, 370 bp, Zea mays
  Clone ID: LIB189-028-Q1-E1-B6
acagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctacgcggcttctcttcactcacctgcagagtgcaccgc

SEQ ID NO: 16827 - DNA, 394 bp, Zea mays
  Clone ID: LIB189-011-Q1-E1-F6
accggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaaaggcatccccgccggcatgcagaaca

SEQ ID NO: 16828 - DNA, 392 bp, Zea mays
  Clone ID: LIB189-024-Q1-E1-A11
gcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgtggtcaag

SEQ ID NO: 16829 - DNA, 337 bp, Zea mays
  Clone ID: LIB189-031-Q1-E1-H12
cccacgcgtccgcgtctgaccgaccggacatgctgggattgccaggttgaagcagtatgtgcctgcaggggtagaattcacgcgctttgggagccaactcagggaccaataagtcgagacacagcagcttctcggcaatatcgcagggcagaacgatatactatgaacgcgatgcattcctgaagcaggggctggtgcagcgcaaaccctatatcaccagcctgaacgtgttccaggcctacacgctgaagcggataagggaccccaacttcaaggtgacgccccatccgccgctgtccaaggaattcgccgacgagaacaagcccgccggactggt

SEQ ID NO: 16830 - DNA, 390 bp, Zea mays
  Clone ID: LIB189-020-Q1-E1-B11
agcggacgcgtgggcggacgcgtggggggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatg

SEQ ID NO: 16831 - DNA, 288 bp, Zea mays
  Clone ID: LIB189-033-Q1-E1-F2
aaccaaacgtccgcattcgtgttcgtcatggccaccaacgtcaccgtggaaaacctcaaccccaaggtcttaaaatgtgagtatgcagtccgtggggagattgtcatccatgggcagcgcctgcagcaacaactacaaacacaggcagggtctcttccttttgatgagatcctctattgcaacattgggaatccccaatctcttggtcagcaacctgtgacattcttcaaggaagttcttgctctttgttatcatccgtgcctcttggaaaaagaggaaaccacatca

SEQ ID NO: 16832 - DNA, 408 bp, Zea mays
  Clone ID: LIB189-002-Q1-E1-F5
agcccacgcgtccgcccacgcgtccgcacccgaccaagtacgccgccatgctcgccgagaagatgcagaagtacggcgccaccgggtggctcgtcaacaccggctggtctggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaagtgttcgccagctacaagatcggggacgacagcagcctgactgacgagatcc

SEQ ID NO: 16833 - DNA, 364 bp, Zea mays
  unsure at all n locations
  Clone ID: LIB189-029-Q1-E1-A4
accacacgtccgcggacgcgtgggatctggagttggaagaacattcacanaagaaatcattgaggccatgtcttccttcaacgagaggcctatcatcttttcactgtcaaacccaacctcgcattctgaatgcactgctgaacaagcatatacctggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggacaac

SEQ ID NO: 16834 - DNA, 393 bp, Zea mays
  Clone ID: LIB189-018-Q1-E1-D11
ggacaaggggaaggtcctagaagttctaaggaactggccacataggaacattcaagttatctgtgttactgatggtgagcgaatcttgggacttggagatttgggttgtcagggaatgggaattcctgtaggcaaacttgctctatacactgctctaggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcacaatgcctttgatttgcttgaaaaata

SEQ ID NO: 16835 - DNA, 418 bp, Zea mays
  Clone ID: LIB189-014-Q1-E1-D11
accacgcgtccgcccacgcgtccggcagagcagacgtatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatata

SEQ ID NO: 16836 - DNA, 414 bp, Zea mays
  unsure at all n locations
  Clone ID: LIB189-027-Q1-E1-C5
agcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatatacatggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggaaatgcntcttcgcggcttcaaaaccgctacctgatcaggccacacaggacaac

SEQ ID NO: 16837 - DNA, 347 bp, Zea mays
  Clone ID: LIB189-018-Q1-E1-G7
agggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaa

SEQ ID NO: 16838 - DNA, 398 bp, Zea mays
  Clone ID: LIB189-020-Q1-E1-G9
aggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatg

SEQ ID NO: 16839 - DNA, 335 bp, Zea mays
  Clone ID: LIB189-002-Q1-E1-C11
agctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcaaggttccga

SEQ ID NO: 16840 - DNA, 345 bp, Zea mays
  Clone ID: LIB189-013-Q1-E1-F6
atgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 16841 - DNA, 312 bp, Zea mays
  Clone ID: LIB189-015-Q1-E1-G8
gccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaact

SEQ ID NO: 16842 - DNA, 427 bp, Zea mays
  unsure at all n locations
  Clone ID: LIB189-009-Q1-E1-G9
acagagatgcaagcccgggccatttttgaagctgctatagcaatgaccaaccaaggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcncgtctatcttgctcagggcattctccaacatgaccccttcgaggtcctggaccagaggggagtgggcgagctggtgaagcttgctacagagaagggcc

SEQ ID NO: 16843 - DNA, 394 bp, Zea mays
  Clone ID: LIB189-020-Q1-E1-G4
agtccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatgctatgtgaacattactagtagcagtgcccataaaagctacaatcccatctcccttttttttcagtcatgtaaaacttccaaac

SEQ ID NO: 16844 - DNA, 423 bp, Zea mays
  unsure at all n locations
  Clone ID: LIB189-006-Q1-E1-G6
agcggacgcgtggggggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatcnccaaggcagctctggtggctgatgagatagcggagcaggctgaattcttctcct

SEQ ID NO: 16845 - DNA, 342 bp, Zea mays
  Clone ID: LIB189-016-Q1-E1-H7
aagaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctagtcactcctactgagctctatattttgtaattttcatgtgcattccgattccgctgtgagggtcatgttaaccccgctagaaaataattgtaatcttctttgctgcgtctgtacttctgtttttggtcgccaggacgtatatttttactgaaatgatactccgaagagc

SEQ ID NO: 16846 - DNA, 364 bp, Zea mays
  unsure at all n locations
  Clone ID: LIB189-028-Q1-E1-E5
accacgcgtccgcccacgcgtccgcgacgtccatcctgcacagccttgaagggatgcctgacctggactggccgaggcttctgaacctccagtcctgcgacggctccttcttgttctctccttcggctaccgcttacgcgctgatgcaaaccggtgacaagaagtgcttcgaatacatcgacaggattgtcaaaaaattcaacggnggagtccccaatgtntatccggtcgatcttttcgagcacatctgggttgtggatcggttggagcgactcgggatctcccgctacttccaacgagagattgagcagtgcatggactatgtgaacaggcactggactgaagatgggatttgctgggctag

SEQ ID NO: 16847 - DNA, 395 bp, Zea mays
  Clone ID: LIB189-002-Q1-E1-C1
agcctgaccaaggctaggaagtacaccttcttcaagcccaagttcatcttctacgccacctacctgtccgagaagatcgggtactggaggtacatcaccatcttcaggcacctcaaggcgaacccggagtaccaggtgtaccccatcttcaagtatttcgagaactggtgccaggacgagaacaggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacaccaaagaattcgacatgcatgtgatcattgagaccaacgcacaacggcg

SEQ ID NO: 16848 - DNA, 439 bp, Zea mays
  unsure at all n locations
  Clone ID: LIB189-019-Q1-E1-G7
accttcaacaagagttgctcttcggaatgacagttatatgctccatctgatcctaccaagcaaagttgatccattggtcaatctcatgaaagttgagaaggttccggattctacctatgatatgattggaggccttgaccagcaaattaaagagatcaaagaggtcattgagcttccaatcaaacatccggaactgtttgagagccttggaattgcacaaccaaagggtgtccttctttatggacctccgggcacaggaaagacattgttggcacgtgcggttgctcatcacactgactgcaccttcatcagggtgtctggttctgagttggttcagaagtatattggtgagggctcccggatggttagggaactctttgttatggccanggaacatgcaccatccattatatttatggatgaaattgactctatcgga

SEQ ID NO: 16849 - DNA, 410 bp, Zea mays
  unsure at all n locations
  Clone ID: LIB189-032-Q1-E1-A3
aggcgtagcctcatgagggagagactcgtcaattcgccaaactccttcttcatggatgttaattgcaaggggtgcttcaccataaccacgtgttttcagccacccccaaacggttgttgtgtgccctggctgcaaaactgtcctctgccaacccacaggaggaaaggcaaggctcactgagggctgctctttccgcangaagggagactanagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgataattggtg

SEQ ID NO: 16850 - DNA, 353 bp, Zea mays
  Clone ID: LIB189-022-Q1-E1-G3
agaaccggacaggcaagagctgccggctgcgctgggtcaactacctccaccctggcctcaagcgtgggcgcatgtctccccatgaagagcgactcatcctagagctgcacgctcggtggggaaacaggtggtccaggatagcacgccgcttgccagggcgcactgacaatgagatcaagaactactggaggacacacatgagaaagaaggcacaggagaggaagaggaacatgtctccatcgtcgtcctcgtcttcgctgacttaccagtcaggctacccagatactccatcaaccattggagttgagggacaggagcttcatggtggcagtggctgcatcacaagcatcctg

SEQ ID NO: 16851 - DNA, 407 bp, Zea mays
  Clone ID: LIB189-002-Q1-E1-E8
agggcagagggcaggaaaagattgggatctaacacagcagtccaagggaacgtggatcctggtgttctttttggatccaaagagtttataagcaggcggatttacgacactgtgcagaaggctggcaatgttggacatgtactgaaccttggccatggcatcaaggttggaactccggaggaaaatgttgctcacttcttcgaggtcgcaaaagggatcagatactaaagaaccttgcatggttctttcctttctccaaatcggcagaagttgtagagtcggcggtcgaggatagatgcagaaagccatgtgcagtatagagtccctgaaaacatttttgtgactgattctgtctgtcgcaattcaagttccggtttcaatgtgatattgtaagcagatttgagacg

SEQ ID NO: 16852 - DNA, 398 bp, Zea mays
  Clone ID: LIB189-014-Q1-E1-E6
acggacgcgtgggtttagcataacacggggtgcatgcacatgtatccgattccctgcatcactcacacctcactttttctgctaaattgtggcagtggtgataattgatatgcatagactgtacttatttaatgactatgaaataccatttaacatagctattgtgcctgacagggtaaatctaccaaggacacacatagttaagccttgctcagctgacgactgctaaggaatttctgttaagtgcagtttggggggtcttctcaaccattgcttgacttaaggcaacacattagaggatattcatcagcatcagaggcaattcttcccaatctgatttgagaaaaaaatttgttggcaacgaaaaattagtgttttcttgctgaatcttggggggc

SEQ ID NO: 16853 - DNA, 229 bp, Zea mays
  Clone ID: LIB189-029-Q1-E1-E4
actcgccagctcgcacatcaaaacacttcagtcaagcctccaagcaacagcgtcggacatggtatacagagggatacgccgagagtaggtcgtgcccgcgctcgcgcacgggcggtcacacactgcaagaaattcagagtcacacgtctcagcccgggcaacacacacacatgcacacgcgcacgctctgtgccgaacaggtcagagacacacactgacggcagtcaca

SEQ ID NO: 16854 - DNA, 367 bp, Zea mays
  Clone ID: LIB189-029-Q1-E1-E5
cccacgcgtccgggggaactgtcaggtaaacgacatcctagacattggctgctctgttggagtaagcaccagatacctcgctgagaagttcccatcagctcaagctgttgggctcgacctatcaccgtactttcttgctgtggcggcacaaaaggaagaaaaactgtcacggccaaagcctattcgctgggttcatgccaatggtgaagcgaccgggctgtcttcagattcatttgaccttgtctcccttgcttatgtgtgccatgagtgcccagcacgagcaatcacgggattagtgaaggaagcattcagggtccttcgcccgggaggaacaatcgccttaactgacaattcccctaaatccaaa

SEQ ID NO: 16855 - DNA, 365 bp, Zea mays
  Clone ID: LIB189-029-Q1-E1-E7
acccacgcgtccgctcaaatatgaaaatgatgctggcaagaaggaaattcagctgcagcttgagaagatgaagaaatatgcttctgttatccgtgtcattgctcatacccagattaggaagatgaagggtttgaagcagaagaaggctcacctgatggagattcaggtcaatggtggtaccattgctgacaaggtggactatggctacaaattctttgagaaagaggtccctgttgatgctgtcttccagaaggatgagatgattgacatcattggtgtgaccaaggggaaaggttatgagggtgtggtcactcgttggggtgtcacccggcttccccgcaagacccacaagggtctccgcaaag

SEQ ID NO: 16856 - DNA, 335 bp, Zea mays
  Clone ID: LIB189-029-Q1-E1-F1
gcgtccgaccacacgtccgcccacgcgtccgcccacgcgtccgcccacgcgtccgcggacgcgtgggcggacacgtggggggttgctttccaggtcacattggtgttcacgaagtcttccaagtcatcaaggtcctgggtactccaacagtggaagattttcaatgcatgaacccgaattacacacagtttaagttcccacaaatcaaagctcacccatgggacaatgtattcaacaataggattccgccataacctgttgatctggtctctcagctactccagtactctccaaatctgaaatgcattgctgtggatgcgcatgttcacccattc

SEQ ID NO: 16857 - DNA, 391 bp, Zea mays
  Clone ID: LIB189-029-Q1-E1-F10
aacacaagcacttcgacgtcgcacgggcgctgcacacagacacaccaagcgtcggcaccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgatcgcagggagagcttcctcgccagggctaactgagccgcccggcggccggcatccacgcccgttcgtgcctgcctgcgtg

SEQ ID NO: 16858 - DNA, 390 bp, Zea mays
  Clone ID: LIB189-029-Q1-E1-F11
acgcaaccctgatgtatgggacgaccctcttcgcttcgaccccgaacgccacatccctttgagccccgagatggaggtctcactcgttgagcgtgatctacggtttatctccttcagcactggtcgtcgcggctgcatcgctgcagctcttggcactgatatgaccatcatgctcttcgctaggctcctgcaggggttctcttggagcaagatgaccggggtggcggccatcgacctttagcgagtccaggcacaacactttcatggcacggccactcgtgctacaggctaagccacggcttccagcgcacctctaccccgggatcttgctttgtaagtagtcccaaataacggctgagcatgtagaaaatttcaccacttatacatgct

SEQ ID NO: 16859 - DNA, 355 bp, Zea mays
  Clone ID: LIB189-029-Q1-E1-F12
acccacgcgtccgcccacgcgtccgaaaaaaaaaaaaaaaaaaaaaaaaaaaaaaaaaaaaaaaaaaaaaaaaaaaaaaaaaaaaaaaaaaagggaggaagaacaaaaggttaaaaagtttaattaaacataaatgcaaggttgtaagcttttctatagtgtaactaaatttaatttcatggggggtggttttaaaatttggtgattgggaaaacctgggggttttgcattttaacccctttgcagcattatcccttttcgcaatctggggtatttttttaaaggctcgcacggttggcccttccgaaattttgaccattttgaatggtgaatgggaccctcctttttccggggt

SEQ ID NO: 16860 - DNA, 434 bp, Zea mays
  unsure at all n locations
  Clone ID: LIB189-029-Q1-E1-F3
gcacgcgtccgaccggaaggggcaagggcagtaggggagcaatcccattcttatcaaacatggacaattgcgggttccctgacctcaaaaatgttcctggaaaaccccaacctggcttcaatccttacctgcgatgaggaccttgagcttctcaaaggctgtgcttgctgcctgtccaagaagaggaccaagtgctcacgccgggtggccaagccacatgctggggtgaagctgtgaagctcatgttgttctttctactgcagacgcacaatggatactacagatggagaaataactaaagcacagactcctcagctgtacattagtataggtttatattagatacccatccattcatttcctcggtgtctgctcattgggttttttttgctgagctaccactgatgggaactaccctgngtgatacgggtggt

SEQ ID NO: 16861 - DNA, 399 bp, Zea mays
  unsure at all n locations
  Clone ID: LIB189-029-Q1-E1-F4
gcgtccaaccacacgtccgagctcctcctcgcgattccaatccacgcacgcctcctccgcttccgcctcgctcaggcttatattcattgatggaacacaaggaggcgggctgcaaccacccggagggcccaatcctatgcatcaataactgcggcttcttcggcattgctgcaacaatgaacatgtgctccaagtgccacaaggagatgataacgaagcaggagcaaggccagctggctgcctcctccatcgatagcattgtcaatggcggtgacggcnggaaaggacctgtaattgctgcatctgtaaatgtggcagttcctcaagttgagcagaagactattgttgtgcagcccatgcttgtagctgaaaccagcgaagctgctgctgtaatcccca

SEQ ID NO: 16862 - DNA, 402 bp, Zea mays
  Clone ID: LIB189-029-Q1-E1-F5
acacagcagtatctggagacttgagtcatacagatagtaatgatgatgaatctgaggggaccaacatcattatcaaaactgaagctcctagtgtaataactgaagcttctgattgaaagagaactattgaactgggtaaggtacatgaaccatgttcaatggactccatggagccatgcaacacatttccatctggagtttcctgcgaagtgatgccaaatgtagacactaacgaggagaagaatgagcttgaagagtcatgtattaccacagtgaacgaagcgcacgaacaagggaaaactgagggacagattgaaattcaagtagcatcatcgatggatatgataagtgatgaagctttaacagctgacaatcaataccatggaattggagaatcaaatg

SEQ ID NO: 16863 - DNA, 344 bp, Zea mays
  unsure at all n locations
  Clone ID: LIB189-029-Q1-E1-F6
agctttcttcaaatcattggttcctctttggtgccgacagatcccatacaccatgatgaagttcgcatgcttcgaaaaaacagttgaacttctgtataagcatgtggtgcccaaaccacgttctgaatgcaccaaaggagaacagttggtggtaacgttcgccgccggatacattgccggtgtcttctgcgccatcgtctctcaccctgcggacaccgttgtatccaaactcaaccaagaaaaaggctcttctgccctagacgtcgccaaaaaggttggctttgccggtctctggaagggattgggtcctcgtatcatcatgatcggtacattaancgccgccc

SEQ ID NO: 16864 - DNA, 428 bp, Zea mays
  Clone ID: LIB189-029-Q1-E1-F7
actcttctatactgagatccaaatcccgagtccatgatcgttgaagctgaaccgtgaagtagttatactgcttatgcttttctttcttatagtaatatactccgtctcaaaataagtcaatttctagaatcacttaaagtcaaattatcttaagtttgaccaattttataggaaaggtaccgtcgtctatgtttctatgacaccaaatgagtacattatgaaaattattttatggtgcattagtgacactaattcagtgccgtgctctttttatgaatttggtcaaacttaaaaatagtttgatttaagataactctgagaaattgatttattttgggacagagaatgtttctgggttgtcttgtaaatacagttcttattattagagtatatgatgactaggaccggtttaatccgaattatataaa

SEQ ID NO: 16865 - DNA, 383 bp, Zea mays
  Clone ID: LIB189-029-Q1-E1-E11
acggacgcgtgggttatgacgctattgaattagagacaagaatttccaagctaaaagaatccatgtgcaatttacacagcctacaaatgaagttgaaggtacctgaggatgaaccactgcaaactaacatcagggcatctctactgtggtccgagaaagaaagttttgaagagtataatgagtcttttatccctggacgcccagaacgtctctcatttgctgcgtaccaaacagtttcaggcatgtcagatgaacttctcactgtgcaaaactacaagatacaaccaatggattcgacagacacccttgaaaggctgaacactggtaccaattttgtaaaccataccaccggaatgatacccgcaaggcttgccattcaaata

SEQ ID NO: 16866 - DNA, 395 bp, Zea mays
  Clone ID: LIB189-029-Q1-E1-C5
acgtgtgtctgacgatgttacagaacttgaggcaatattggtgcttcaaggatgaatagtgattgcgtgtcattccgggattagtgcggacagggaaatgttgaaagttgtatgagatcgttccagaaagtgaagagggagcacggtgccctgaggcagaaactagaggcctatttccagctgctatgacaagctggtcctgctggagctgccaacaagcctggatgtaagaactaggagttgcaggaaaacggattatgacccaagaagatacctcactacaactgactggcccggtggccctgctgcgcagcaattaggggtcagcatacgaagcgaaacaagagatgatatgcatggatatgcacaaaactgtaataagagattgttttttc

SEQ ID NO: 16867 - DNA, 294 bp, Zea mays
  Clone ID: LIB189-029-Q1-E1-C6
aaaaagttatggcgatggaatcccaagcggaggcactcggccaattagcaactgacgatctagaaggaaagtttgcactgctcgagaattcatctgtccatgatgatttttcacagctgaaaaaagaactctcgggaagctctttgaaaggggagctcccatcaagcaaaagagcggccagcaactcaagcgccgggcgccctttccccgacctagagattgagagcgagctaaacgagctgcggaggaagggcaaagaatactagagagtatagactctccaccaaacatctt

SEQ ID NO: 16868 - DNA, 436 bp, Zea mays
  Clone ID: LIB189-029-Q1-E1-D1
gggtcgaggccgcgtccaggggaaggcgggcgggctggtggttcgggcggagatgtttggccagctcaccaccggcctcgagtccgcctggaacaagctgaggggagtcgatgtattgacaaaggaaaacatagctgaaccaatgcgggatatcagaagagcacttttggaggccgatgtaagtttgccagtagtaagaagatttattgagtctgtaagtgaaaaggctgtaggcactgatgtgatccgaggtgtccgacctgaccagcagttggtgaaggttgtgagtgatgaactggtacaactgatgggcggggaggtatcagatttggtgtttgcaaaatctggaccaactattatattattggcaggtctgcaaggtgttggaaaaactactgtttgtgcgaagcttgccttctatctcaaaaaactgggc

SEQ ID NO: 16869 - DNA, 382 bp, Zea mays
  Clone ID: LIB189-029-Q1-E1-D10
acccacgcgtcggtctttgcgcatttagaaacacaacacacgtttcgcactaccaacatgctaacagcagtggctaccacgatattaaccgtcgttgcgcttcgtgcgccttttgcgagcgaaacacatgcttccattagtccagattgctcacttgctccaatctctattagtctacacttcatcccatcatttacgtcagtggccatcgaagagccacctgtgcatccctatacggtacaagaggcgattgcggccagcgtcatagtccaggcagttgccgagttgcaagtgtaagccttgcgacatctcatagtaaacgccatcgcaatgcactaggtccatgagtatcgaccagcactgaaccacctaaccatggtga

SEQ ID NO: 16870 - DNA, 197 bp, Zea mays
  Clone ID: LIB189-029-Q1-E1-D11
acggacgcgtgggaagcgggcgccccccgtcgtcgcgttcccccgcgcacgtacaggtggcgaagtcgcctcgtgctatgcataacaggcagtccttgatctccatgagaattatgctaacgttagatgcactggcattagtctaggatactcacttgcacgtatttctatcggcctacacttcttcacaccattta

SEQ ID NO: 16871 - DNA, 364 bp, Zea mays
  Clone ID: LIB189-029-Q1-E1-D3
gcgtccaaccacacgtccgggcagaagcaattcatcttctccacaaccaacaggaggaccggcggcggaaggaggcacggaggggcaaggaccttcaagttcccttgctccttcaaaaacccgttggtaattggcctgccggaaaactcaggttgcggaaagagcaccttcatgcgcccggtcaacaaacttctttccgtgggccccccgagcccgcccaaagggccggaaccccggactcaaacacgctcaacagtgacaccaagacagtgatatgcctcgacgactaccatttcctggaacaggaacggcatgaacgataaaggtgtgaccgccctccaccctaaggccaacaactttgatc

SEQ ID NO: 16872 - DNA, 390 bp, Zea mays
  Clone ID: LIB189-029-Q1-E1-D4
gcgtccaaggacacttgggtgaccccttcaaggtcctggacaaaagggaattgggcaacctggtgaattttgctacaaaaaggggccgcaaagctaggcctaacttgaaggtgggcatttgtggaaaaaacggtggaaagccttcgtctgtggccttcttcgcaaaggctgggctggattacgtttcttgctcccctttcagggttccaattgctaggctacctgcacctcaagtgcttgtctgaggctgcctcctccgttggaaaccggattgcctgctgctggtggatgtggtgatcaacagtattattacacagccatgctaagtgaacattactagtagcagtgctcataaaagctacaatcccatctcccttttttttccaatca

SEQ ID NO: 16873 - DNA, 429 bp, Zea mays
  Clone ID: LIB189-029-Q1-E1-D6
acccacgcgtccgcggacgcgtgggtatcgaggaggtttttagggtggtggtggtgttgtgaggagctgctgccgctgctctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgcggcgcgccctgcgtgccatccgctcccggttcacggggtggaggagcaggcagggcatcagttacgccgacgctgacggcgacggctacatcgacgacagcgaggtcgatggcctcatcgagttcgcgcagaagaactcggcctcaagatcgtcgcctactgatctcacatggggcgcggcgcgcggccgtcggggggtgg

SEQ ID NO: 16874 - DNA, 372 bp, Zea mays
  Clone ID: LIB189-029-Q1-E1-E1
gggtcgagcacgcgtccggcacccatcctgtcgccgcccaagtcgcccccgtcggagtccccgccattgtcgcccgacttccgccgtgggtgctggccgggcgccgggtcccccgtcaacgacgtcctcgcctcgctccgccagctccgcctcagcagggccaactcgtccccgtcgggcgggtggtgcggctaccctgcatccgcggtcgcgtacggatcgcctacggggggcgcgctctacggcctgtcctccaccccgaggtccaccgccggctccggctacatggccaacctggaccctctcgacgtcaccttcggcggcgacgaggagcccgtggagagggtggagtccggccgcgcactccgcgcg

SEQ ID NO: 16875 - DNA, 401 bp, Zea mays
  Clone ID: LIB189-029-Q1-E1-C3
cgtccgacaacacgtcggccaacccttccggaattatttaacctaacataacaaccaaaatggcaacggaatttataacaaaaccaaccaaaaatgcccctggggcaacaacaaccctccaattgcttcgggtccaaacatttggtaatggatttggcatttaacaatattgcacatgtcaagagtgaatactttcaaaccaatggacactattgctctacatttgatgttgccattgccaaggtttggcaagctaggacaagggcaatcaagtacgaaccaaatttcaaggtgcatgtttgcttctttgccaacactcgccacctcctcacacatgtgctacccaaggttggtggcttctatggaaattgcttctatccagtgactgtcacagcaactgc

SEQ ID NO: 16876 - DNA, 392 bp, Zea mays
  Clone ID: LIB189-029-Q1-E1-A9
acgttattacctctctcaaaaaagaattcaaaagagaaaaaaaaattaaataattttcaataaaatatgtcgaaacacgggcaaaaaaagtataaaatgtacgaagcttaagaatgatcatgaaggtcaagctattgctgactgggaaagatgcccttctggatgaagattataaaatgggggagggcccaaatggtggggtggttgcaaattgtgcccaattaaccttgatagtgccttgctgattcaccataagtcgtatgctggggtattgccttttgtacttccggatgggtggacagtagcagttttcaatatgtacgacctgcttaggggaattctgttgtgcctcgagttcaacaacttccatgtgcttttgttttaccacctgg

SEQ ID NO: 16877 - DNA, 209 bp, Zea mays
  Clone ID: LIB189-029-Q1-E1-B1
cccacccgtccggccaagatggctcctgagggctaagaaaagctgtacaccaaggtcaagagcattcacgacagcctgatcgaggctggtgtccgcgtcgagtccgactaccgtgagggctactcccccggatggaagttcaacgactgggagctcaagggtaatcctcttcctaaccaattccgtcccaaggattcccaaaaaggttt

SEQ ID NO: 16878 - DNA, 424 bp, Zea mays
  Clone ID: LIB189-029-Q1-E1-B12
agctcttcttgaggtcaagggcagaaggcattcttaaagaatattatcctacaagaactgaacgggtggacaagccacttctggaccagattgtaagagcttcatatgatcctggtgctgcaaaagtccttgagagtgtattcaacttcaatctttcaattcctcttaacttcttatttgattcttttggagggaagatattagttatccagggtatgaaagacccccttacaaaatctgaggcatttgtcaccatgctccgagaacattgcagcaaggttcaaatcagagagttaaatgcaggtcatgctccacatgatgaagttccagatgaagtaaataccatactatgtaaatgggtggagcagattgaagttaagccagccctggagaaagacaaggcaatataggtaacatttagaat

SEQ ID NO: 16879 - DNA, 427 bp, Zea mays
  unsure at all n locations
  Clone ID: LIB189-029-Q1-E1-B6
acccacgcgtccgagctctctgagcctgggcccgggctccgccgggctcgggccgcgccggctcgtcgcggcggcgcccccacgggcgttcttctcctcgtccccctaccagccgccccagccggaggggttctcgcagcaccgcgagtacggtctggtccccatggtcatcgagaccacctcccgcggggagcgcgcctacgacatcttctcgcgcctgctcaaggagcgcatcgtctgcatccacgggcccatcgccgacgacacggcctcgctcgtcgtcgcgcagctgctcttcctcgagtccgagaacccgctcaagcccgtccacctctacatcaactcccccgggggcgtcgtcancgcggggctcgccatctacgacaccatgcagtacatcggctgcccgtcacaccctctgcatcgg

SEQ ID NO: 16880 - DNA, 443 bp, Zea mays
  unsure at all n locations
  Clone ID: LIB189-029-Q1-E1-C1
cgggtcgagcacgcgtccgagccgaggcggccatcctgctgaccaagctagcgctggcgcggcaaagcgccgacaacgtcagcgtcgtcgtcgtcaacctaaggcggcgcccgcgatcgtgatcggtggtggctccgatggactagccgttcttggttggtttggtttcctggccgtccgtaagttcgaatgggagagcccagttcaccttcgcttcggccgagcaatcatttgacaagatgtcaaagcgaagatcgaacaaaatagtgagatccttagcagaattgcatgctacttccttttacagtagtacagcaggactattgtttcgttagcgttcttttttttatgggtgggtggagggtgcgtttgtgatctggtcggacagatcatcccgcctttcttcccccggtaaattctccanatagaaaagcgcatgcgtt

SEQ ID NO: 16881 - DNA, 423 bp, Zea mays
  Clone ID: LIB189-029-Q1-E1-C10
acggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgt

SEQ ID NO: 16882 - DNA, 211 bp, Zea mays
  Clone ID: LIB189-029-Q1-E1-C2
gaaccttggggacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttgggacaatgat

SEQ ID NO: 16883 - DNA, 401 bp, Zea mays
  Clone ID: LIB189-029-Q1-E1-A8
aaaggagtagaaataaaataaatcaaggctttcttttggccaaaacattgtgtcattttcagtagatatgtctagactcgggcacaatactgttaactgtgcgagcttcagactgctcctgaaggtcacgctattgctgaggccgaagatgcccttctggctgctgatcatgacttggggcaggcgccagtggtggggtggtggaaattgagcccaggaagcttgagagtgacttgctgaagcagcagaagtcgtaggctgttgattgcctacgtatttcgggatatatggagagtagcacgaagcagtatgcaggacctgcttcggctaattctgccgtgcctcgacttcagcaatttccttttgcttttgtatcatgacctggcacgtccttgttgtgt

SEQ ID NO: 16884 - DNA, 262 bp, Zea mays
  Clone ID: LIB189-028-Q1-E1-H12
gcccacgcgtccggcgccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacac

SEQ ID NO: 16885 - DNA, 304 bp, Zea mays
  unsure at all n locations
  Clone ID: LIB189-028-Q1-E1-H2
gcccgcgtccaaccacgcgtccgcccacgcgtccgcccacgcgtccgcggacgcgtggggcgcggcggtagcgctcgcgtccttcccgtccgcggcctccacctccgccccttcccgcgtctcggccagcagccaccgcggtcagcggcactccagggccgcaaccgtcagatgtcccagcacgtcgcccaacgtgtcccagggcgcgccggcgccggcgccgcccaagccgcanatcgagctcgagttcgtcgggccgaagcccggtgccgacggctccttcccggtggaccgggcggaggcg

SEQ ID NO: 16886 - DNA, 275 bp, Zea mays
  Clone ID: LIB189-028-Q1-E1-H4
cacacgtccgcgactgatatggccgctgaagacctagaccttgctttgtcggacaaccctgccaagcagccgcgtggtctgtttgcagatcaattcgaggcaatatgattccatttgggcccgaaattttagcatgctaagagtcctcgatgtctacagaatctcgccaacttcgatgcccattacaacgggactggcccggagatactgcgccagacgaatggcgagatcgacgctttcgtagcaggggctgggacatgcggtacgctacctgg

SEQ ID NO: 16887 - DNA, 234 bp, Zea mays
  Clone ID: LIB189-028-Q1-E1-H5
acaaccgccaacccccaccccaaggaaggaaccctagtaccctacccgtgagaaccgccgccgcacaaccccggacgtggtggcaggcgaccgatccggatccatcatcccaagcttcctttctgtctcctcttcatccatctccacaacgataatcaaggaacgaatgccatggttttgttctaacttgacccggacatcatccgatggggtcttcaacatctcctccccgct

SEQ ID NO: 16888 - DNA, 252 bp, Zea mays
  Clone ID: LIB189-028-Q1-E1-H6
cgggccgacccacaagtccgacgggagtgtacgtgccaccatcagcggtatcattagtggccgccgctgcgaccatctcatcatcctcgcacttgctcctcctctcccgccatcaggcggcctccctacaatgcggcctctcctgcctcggccatcccaaagggcccggtacggttacggctcatgctcctgccgctaaggacgtgccgttcatggcggtcgtggacactactgcagcgtccactgcggctg

SEQ ID NO: 16889 - DNA, 442 bp, Zea mays
  Clone ID: LIB189-028-Q1-E1-H7
accacgcgtccgcccacgcgtccgcccacgcgtccgcactcatcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggacgagggcacc

SEQ ID NO: 16890 - DNA, 379 bp, Zea mays
  Clone ID: LIB189-029-Q1-E1-A10
atactggaccaatctgccaccacactttgatcacacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgtgtagctgccgtcgtcgcgaccgaggccgcgcagatcgactacagctcaagcgtctcggtgttcccgatggaggcctgcgacctgcttggtggcgacgcgtgcaacgggcccatgttcccggaggccaagcccgcctcggcggcggcggcggcgagcaggattgtggtcggggtggacagggactacctgtcctacgacgagccaaag

SEQ ID NO: 16891 - DNA, 331 bp, Zea mays
  Clone ID: LIB189-029-Q1-E1-A12
cccacgcgtccgcccacgcgtccgtataggcgtagccgactggtcgccgcgtcccctctcggctccacccggcgagcgaacaatggaggcggggggcgtcggcctggcgctgcaggcgcgggcggcgggcttcggctccagccggcaccggggcggcctacaggcgcccaccgggagcctgagagtcgctgacccggcgggacctgcggtcgctgtgcgggctcgcgggtccaagcccgtcgcaccgctccgactccgtgcgaagaaatcgtccggaggtcatgaaaactcgcacaactccgttgacgaagctctcctgttgaagagaaaa

SEQ ID NO: 16892 - DNA, 315 bp, Zea mays
  unsure at all n locations
  Clone ID: LIB189-029-Q1-E1-A3
ccgggtcgacctacgagtctgaggttcgcaggatcaccatgttcaaccggctaaacaagtttgggccaaaaatatttgaaacaccccccaacttaaaaaatgcggtcagggaggcaattgaggggatgagggtcgcactangtgcggctgtgattttaaattattgcctgcaaggtctcttccatccagcaaggaaagtacgagaagtgtattggaagatatacaactctttgtacatcggcgcgcaagatgcacttgttgcttcttatcctgccctggaagacgatggggataacatctttagtcctccaaaat

SEQ ID NO: 16893 - DNA, 429 bp, Zea mays
  Clone ID: LIB189-029-Q1-E1-A5
gacgcgtgggtcaagatggttggtgggaccctggcagagcagacgtatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatataca

SEQ ID NO: 16894 - DNA, 225 bp, Zea mays
  Clone ID: LIB189-029-Q1-E1-A7
accacgcgtccgccaagggttgtctcctcgtcggcccgcctgggaccgggaagaccctccttgcgcgtgccgtcgctggggaggccggggtgcccttcttctcctgcgctgcctctgagttcgtcgagctcttcgtcggtgtcggtgcctccagggtgcgcgacctcttcgagaaggccaaggccaaagcgccctgcattgtcttcattgatgagattgatgccg

SEQ ID NO: 16895 - DNA, 286 bp, Zea mays
  Clone ID: LIB189-028-Q1-E1-H10
tgtcctggcctggttcagccgacgtcacacggaaggccctcctccgtggtggagaccaactcaggaccgcgaggaccgtggtggaaggcatgaggatgatccgaaaccagcggtgctcagtgctcacacatgagacctacgtatgcctccgttccttgtgatgaggaaatatgcttgcgttcgttctccgtgggcgttgttcctacaaattcacttgctttctgtctctctctctatatacacactgtataaaacaagaacagctgtttatcatctcttcttatat

SEQ ID NO: 16896 - DNA, 395 bp, Zea mays
  unsure at all n locations
  Clone ID: LIB189-028-Q1-E1-F5
ctgccctcctttttctttgttttaggtcaacggtttttctgtgatttatgtgggaggtcttacaagtacaagcagaatatgaccgctcataaaaaatacgagtgcggacgcgagcctaaatttcaatgtgtcgtctgctttaaaaaatttaaagtcaaaagcaatttaaaagcccatttagccgttcatggattagcttcttattctttttgattcctaattttttaaaaaattatgttcctgacattttgcttccgtttactccgaaataagcaaaaaaatttttcgtcccaagggtctaatttacganaaaaacaaattttatcgtccaatgtatataaaaaactgtaaattanaaacattttttaatgaatttgttttaaaaatacattttt

SEQ ID NO: 16897 - DNA, 453 bp, Zea mays
  unsure at all n locations
  Clone ID: LIB189-028-Q1-E1-F6
acgactcccagctagcccctcacgcgctcgtcggcgccctgtcgagtcgagcccgcatctcgcccgatcgagagcgagcgcatccgcgcgccggggagagctttgctttcggtggtctgtaacgactcaacgacgacggcaggcggtagataaaggcgcgcgatgtgcgacgcggcgccgaggtacaggggcgtgcggaagcggccgtggggccggttcgcggcggagatccgggacccggcgaagcgcgcgcgcgtctggctcggcaccttcgactcggccgaggccgcggcgcgcgcctacgacgtggccgcgcgggccctgcgcggcccgctcgccaggaccaacttccccgcgctcgccaccacctcccgccgccccgcgcccacgtgcagctccggctccaccgtcgagtcctccagcgggccccgcgccggggacccanggccaggg

SEQ ID NO: 16898 - DNA, 354 bp, Zea mays
  Clone ID: LIB189-028-Q1-E1-G3
tccgaaataaatgggaaaatggtataattcaataaacaatttaaaaatgttaccccaacaaaagccaattgtggaagggccaaattgagaaaccggtaacctggaaaaaactaatttaaaataagttaagttaataagttaaaaaaagtttattggagaataaaattgttaatccgaatgtttatgccactttgatttgattttaagcgtaagggaatcttctgattttgcggggagtaaaccactaaaggttcattgtttgatttttcattatatgtggcacagaaatatcttccctttgataaaacaactaagggagttctatttttttgacatcaagataaaatacttttt

SEQ ID NO: 16899 - DNA, 406 bp, Zea mays
  Clone ID: LIB189-028-Q1-E1-G4
gcaaatcccccttcgcggccgcaaaaatggtaaacgttcctaaagacaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattgggggagacaagaagggcaagggcacatctcttttctaagcttctcgtccacctgtcgggtttttgattttaacctgtgggtctactactactgttataaa

SEQ ID NO: 16900 - DNA, 430 bp, Zea mays
  Clone ID: LIB189-028-Q1-E1-G9
ggacgagtcagacgtccacatctgccacatcggtgaagtggtgtcgtggtgaccatggcgcctggcctcctcgctgccgccgccgtgctggccgcggtggcggcgtcccgcgcggcccacgtcgcgctcaactgccccgtgcacccggtgccgtcgcatcgcccgccgcacactccggcgcccaagaacctagtacagaggccggatacactcggggaaggggcgctggactccccggaggacctgtacgtggacgccgtggcgggcggggcgctgtacacggccacgagggacggctggctgcagcggatgatgcaccccaacaacggctcctgggagcggtggcgcttcgtcggcggcacgggcctgctcggggtcgcgccgtccgccgacggcaccatgctcgtctgcgacgccgacaaggggcttt

SEQ ID NO: 16901 - DNA, 453 bp, Zea mays
  Clone ID: LIB189-028-Q1-E1-H1
cgggtcgggcacgcgtccgaccaaacgtccgcccacgcgtccgcccacgcgtccgccaagaaccaaaggtagctagctagccgcgactcgttggctagacgattcaagcagcagcgcaggatggtggcgccggtggtgattgcgtcggccgggctgggcatgctggccggcgtggcgatggccaaccggtccctcgggaacgggctcccggcggcctccaggtgggacgcgcgcccgcgctgcgccacgtgcggcggctccggccgcgtggagtgcatctgcaaccgctggtccgacggcgactccggctgccggacctgcgctgggttcgggaggatgccctgccgcagctgcggcggctccggcacgggccgaccgctccctgcacgggtcaccgtccagcaccagaagccgccgccgccgccgccgcccggctacaactgatcgatggtg

SEQ ID NO: 16902 - DNA, 430 bp, Zea mays
  Clone ID: LIB189-028-Q1-E1-F4
cttcggccccttaaggaacgggaaccggggcaaattcccccaacaaggagggaacaaaactggtggaaaaccttcccgggaacgggttcccaattggcaaaagtcccacttggccctggtactccgttgttaccaacaaaaaaaatcagctggcgcacgaggatgctggtggtatcagactggacacgccgattcatcttcggaagagactcgagttgcatatgatcaagagggaaaagattttgctgtgacatatattcagatgaacgaggccagtacagcctcttcccacttttttttagtctgatttcacataaatgttccccttttgttgttaaggaagaatctgacttcccctgcactttgtatagtgcaccacgaagaaattcctttgtacctaccttttctttttgagagagttgcactgcac

SEQ ID NO: 16903 - DNA, 436 bp, Zea mays
  Clone ID: LIB189-028-Q1-E1-D7
aggattgtgatcagctacttcaatgcaaaattttttaggaacagtcttaatgtgtggtaccagttcattccccagctgatcttcttgaacagcttatttggttacctgtccttgcttattattattaagtggtgcacggggtcaaaagcagatctataccatgttatgatctacatgttccttagcccaacagatgagattggtgaaaaccagttgtttagtggccagaagacagtgcagcttgttctacttctgcttgctctggtgtctgtgccttggatgttgattccaaaacctcttctattgaagaagcaacatcagcaaaggcatcaaggtcaccagtacgcaatgcttcagggcgttgatgaatcagtgggagcagagctgggggaacatcatgaggaagcacatgaccatgaggagtttgagttcagcg

SEQ ID NO: 16904 - DNA, 332 bp, Zea mays
  Clone ID: LIB189-028-Q1-E1-D8
ccggtcgacccacgcatccagcagacgaagccaaagcttatggacttgtcgatattgtaggggatgaaatgattgacgagcactgcgatactgatccagtgtggtttccagaaatgtttaaggattggtagtgggtggatttcttgtaaatttatctcaaacctaaattcgggttttatgctatagaaaatagaaatacttcatgatgatgaatcatcaggttaagatcgatctaaaccaatccattttatatatacatacgacatgccaacggttaaacaacttattagaaatgcaagacagccaatacgaaatgctagaaaatcggccgc

SEQ ID NO: 16905 - DNA, 197 bp, Zea mays
  Clone ID: LIB189-028-Q1-E1-E4
ccagaagaaaaggttgacccggttaattgaaaaaggaaacggccggcaaaacaacaatcaatccgttcaacccaatgggttacttggccaaaattgcaacaacttccggaacggcggttacttcggcgaagggccccaaaaaaacggcggcaatcgccccggggctcttcttaataaccttacccccggcttcttca

SEQ ID NO: 16906 - DNA, 440 bp, Zea mays
  Clone ID: LIB189-028-Q1-E1-E7
accacgcgtccgagctcggcggcggagcacggcggcaaggggagggcgatggaattctgcccggtgtgtgggattctgctgcagatcgatccgggcaccggaagccaccgcctgcgcctcttctgccccgtctgcccctacgtctgccccatcctgaacaagatcgtgaagaaggcgaggttggtcaaaaaggaggtggagcccatctccagcacggcggatgagatgaaatcggcccctaagaccgcagttacatgccaaagatgcaaccatggagaagcatacttcaagcagatgcagattcgatcagctgatgaaccgatgacaacaatatacaggtgttgcaaagaagaatgccagcatgaatggagagaggactgaccatagcattcgcactttgcttacacttcgctccctgtgcttcttcagttttgagtgtt

SEQ ID NO: 16907 - DNA, 388 bp, Zea mays
  unsure at all n locations
  Clone ID: LIB189-028-Q1-E1-E8
agcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttcnccgagctgctctcccgc

SEQ ID NO: 16908 - DNA, 431 bp, Zea mays
  Clone ID: LIB189-028-Q1-E1-F2
gggtcgggcacgcgtccggagcaaacgggtgcttaagggctccaacatcgtgctgggcccatacgcgcgcggcgacgcacaggtggtcaacgcagattttgtaaagagcagcgtgcgtcccgatgactgccctcgggacggccttccggagtttgcactcgttggccggtccaacgtcggcaaatcgtcgctgctcaactcgcttgtccgccgcaagcgccttgcccttacctccaagaagcctgggaagacccaatgtatcaatcatttcaaagtaaatgacagctggtatcttgttgacttgcctggttatggatatgcttctgcaccacaggaagctcgtaccaattgggatgaatttactagaaattactttctcagtcgggagaatttggtatcggtttttcctcttatagatgcacgtatacctg

SEQ ID NO: 16909 - DNA, 408 bp, Zea mays
  Clone ID: LIB189-028-Q1-E1-F3
gggccggcccacgcgtccgaacgaacgcgctcttctggatccggcactccatcgtgcgcgccatgaccctgtcaagcttcacccgcttcccgttcgccatggattcggaccggcaggaaatcggcagggcccgggaggagctggcgttcgacctcggccggccgcccacggacgaggaggtgcgggcgagggtgggcctctccccgcagaggtaccgcgacgtgctgcggatggccaggcccacatactcgctgcacgcccggaaccgcgtcacgcaggaggagctcatcggcgaggtcaccgacgccgaagccgtcggggtcgacgccggcggcaagcacgacgcgctgctccgcctcgccatcgatgacctcctggactctctgaaacccaaggagagcctggtga

SEQ ID NO: 16910 - DNA, 337 bp, Zea mays
  Clone ID: LIB189-028-Q1-E1-C2
cccttcgggttcgggttcgggtccttaaggttctccggggtccggttccttgggtaaccggatcaaaatggcggcgtcggatgttaagtaccgctgcttcgtcggcggcctcgcctgggccacggacgaccactccctccacaacgccttcagcacctacggcgaggtcctcgagtccaagatcatcctcgatcgggagacccagaggtcccgcggcttcggcttcgtcaccttctccacggaggaggcgatgcggaacgccatcgagggcatgaacggcaaagagctgggacgccgcaacaaaaccgtcaaccaagcccaatctcgcggcggccgt

SEQ ID NO: 16911 - DNA, 433 bp, Zea mays
  Clone ID: LIB189-028-Q1-E1-C4
acgcgtccgaggaaacgtgggcggacgcgtgggcacgcacactctgtgaggataacgaccccctgaatgtcctcatactgatgcaggaacaagttgtccctgggtgtttcctgcaagctcgtgctattgggctcatgcctatgatcgatcagggcgagaaagatgataagattatagcagtctgtgctgatgaccctgaattccgtcactacacggacatcacggacctcccaccgcatcgccttcaagagatccgccgcttttttgaagattataaaaagaacgaaaataaggaggtcgcagtgaatgagttcctgccagcgaaagatgccatcaacgcaatcaagtactcgatggacctgtatggctcatacgtcatcgaaagcctgaggaagtgatctccagctgcttgattgtggttgtggatgctaca

SEQ ID NO: 16912 - DNA, 409 bp, Zea mays
  Clone ID: LIB189-028-Q1-E1-C5
acgaggccgcactgcacgcgagtcctccactccgaccgcacgatggctgcgctgcgcctcgcctccttcaccctccgccccgccgctgcctcggcctccgcctcctccggcgcgaccccaaccgcgtccggctccgtctccgtctccttcgcccgcgcggcgcgggggctgccctccctccgcctggccccgccccgccgccgcggggacctcgccaggccccgcgccgcggccgatgccgcagcggagagctacacgtccgcgctgtcagaggtggccgtcgagaacggcaccctcgaacagacggtctccgacctggagaagctggggaaggtcttcgcggacgaggccgtcgccgagttcttcgacaaccccaccgtccctcgcgaggagaaggccgagctcatcg

SEQ ID NO: 16913 - DNA, 351 bp, Zea mays
  Clone ID: LIB189-028-Q1-E1-C7
gagctttattatatggttttgtttgagagttaaaaaaaacacgattaaagattgtataaatggcagccacgccatcagcctcacacctataggaagcacgaccaccaccaccaccacaaaaccacgtacgaggacaaggatggcgactggatgctcgtcggcgacgtcccctgcaagatgttcgtggcaacctgccagcgccttcgtctgatgaagggttcaccggccgtgaacttggcaccaagagccgcccgatgaggcacacgccgttgggcgttggcacgcacccacgcactggcgtcttgcaggaaagggggaactctgctggtcttgcggacgctcttcccgtca

SEQ ID NO: 16914 - DNA, 443 bp, Zea mays
  Clone ID: LIB189-028-Q1-E1-C8
cccacgcgtccgccaagggtggtcgtccattgacagctcgctcttctccatcgagaccgtgtccgggggcatcacgaatctatgtgagttgttgtggcatggctcgtagcgccattcagaattcctcgccttttgcgcctgagcagcatgatgattgtagtaaatgaaatgaatagtgcataatagttacattgaaatgttgcacatcgttgacatgaggacataacttttttttatctcctgctgtaacgacaacttgtccgcttccgcttcctgctcctcattgttcccgtttactgataaaacagcagaacctaatgctttttgcaaactgtgtgcgattagattagatactctccggggtgctgcataatatttcctttggcctgtatcatttctgatgtcatttgtcacatctgcggatctgccccaccatgcttgca

SEQ ID NO: 16915 - DNA, 411 bp, Zea mays
  Clone ID: LIB189-028-Q1-E1-D11
gcgtccgaccacgagtccgggaaccctcatgtggttaaaaggcgaataaggaaaggaattcctgattgtctcagaggacttgtttggcagttgatttcaggcagtcgggacctcttactaatgaacccaggggtttacgagacactggtgatatatgagacatcggcctctgaattggaaattattcgtgacatatcacgcacatttccatctcatatattcttccaacaaaggcatggtccaggccaaagatcattgtataacattttgaaagcatattctgtctatgacagggatgttggatatgtgcagggaatgggatttttagctgggttgctgcttctttatatgagtgaggaggatgcattctggttattagtcccattgctaaagggagctgtccatgcacca

SEQ ID NO: 16916 - DNA, 388 bp, Zea mays
  Clone ID: LIB189-028-Q1-E1-D4
gagaatggtctcgaaattgatggcaggaatgtgttctttcagtacagtaaaccaaccggggggatgggtgggccttctcttggacaagaaaattttacgaggcctacttatgggcacaggactgctgctgcaccgtgtgactggatttgtactatatgcggatgtatgaattttgcccgcaggacctcctgctttcagtgcaatgaacctcgtactgaggatgctcttccagctgatgcgacaggttccgcttcacactttgggagaaggggatctgaactaggtccaactcatgttttagttgttcgtggcttggatgaaaatgctgatgaggaaatgcttcggtacgaatttgctaagcacgcaccattaaaggacatcccccttg

SEQ ID NO: 16917 - DNA, 417 bp, Zea mays
  Clone ID: LIB189-028-Q1-E1-D5
acccacgcgtccgaagttgtgaaggtttctaaggatgatattaccatgcaaaatcctgccaccggggatatttcagtcccttatgggatggctgtctggtcgactggctaatcgccgtgtcttggctactgatgaatggctaagggtccgtgaatgtgatggtgtctatgcaataggtgactgtgctacaataaaccagaggaaagtaatggaggacatttcagaaatattcagagtcgcagataaagataagtctggaaccttgactgtgaaagaaattcaagatatccttgatgatatctacgtgaggtacccgcaagtacagctctaccttaagagcaagcagatgaacggcatcgctgatctagtgaggagcgccaaaggagacgctgagaaggaatccgtggaactgaacat

SEQ ID NO: 16918 - DNA, 440 bp, Zea mays
  Clone ID: LIB189-028-Q1-E1-A2
gcgtccgactaaaacaggacatacccctgcgaatatgctgtgtgacagtttctcacgtgattaccagcttaggtcacggggggatgcatcgggatcagtctagcaagcacctaagtacagaggactatgcagatatggtgacaagatcaaaagagtctcttccatatccttgggtggctgtgatgataggtttgaagaatgcaatattgccaataaagataggccagaccaaataaaacatgctatggggacaaaaaggaagaccaagaggcgtctagattcccatattgacgaggaagtccgggtgtctgaagatgcatacgtttcagaggatgaggatgataatcagagtgaacataactacgaacatagcttcagtgaggattaggcaactccaactgaatttacacaagctgaacaaggtgatcgacacaatgggg

SEQ ID NO: 16919 - DNA, 179 bp, Zea mays
  Clone ID: LIB189-028-Q1-E1-A3
agaaactgtacgacgaccttaccactgggttccgcaccctacaacatgaggcacggtgaactgctgtacattttgtgtaacacaataatggctgccaaatggtttacaaggtacggcagttgctcattgacaccatgtccgagaattttccccaccgctactcatttctttgccaccac

SEQ ID NO: 16920 - DNA, 446 bp, Zea mays
  Clone ID: LIB189-028-Q1-E1-A4
accacgcgtccgcccacgcgtccggggaagctcgtgccgtccgacatcatcgtcaggctcctgctcacggccatgctccagagcggaaacgacaggttcctcgtcgacggattccctcgaaacgaggagaaccgccgagcgtacgagagcattgttggcattgagcctgagttggtgctgttcatcgactgcccaagggaggagctggagcgacgcatcctgcaccgcgatcagggaagagacgacgacaacgtcgacactataaggaagcggtttcaggttttccacgactccactctacctgttgttctgtactacgacagaatggggaaggtccgacgggtcgatggcgccaaatccgctgatgcagtctttgacgatgtgaaaggcatatttactcaactacggaccactcagggaagccaaggtggcaatgcgagcagcag

SEQ ID NO: 16921 - DNA, 274 bp, Zea mays
  Clone ID: LIB189-028-Q1-E1-A5
cccacgcgtccgaaagtgtggacgtcgatgcgccggtcgagcacctagcgccgccttcgaaggcgacgacgggagctcgcggcggcctgctcgccgccgtggagacgacgacgagcagctgcacgggagtgttaccgtgtcacgccttatcaggcgccggagcggtggaatcgggaccgtggtggtggacgtcgccgctggacaccttgtaccgcgcggcggtggtgctgggcgacctgcacccggtgacggcgcgggcggtggtggccgtgcc

SEQ ID NO: 16922 - DNA, 223 bp, Zea mays
  Clone ID: LIB189-028-Q1-E1-A8
aaaaaaaaaaaaaaaaaaaaaaaaaaaaaaaaataaaaaaaaaaaaaaaaaaagaaaatcatataaaaagaataaaaataataaatccataaaaaaaaaaaactcagagcggtggccgatgatcagggggttccggttcaggtgccggcgttttccctcatcctcctcgaccgctgtgtcgccctctccgttttcggtcgtcattttcttctccgcgcctttc

SEQ ID NO: 16923 - DNA, 420 bp, Zea mays
  Clone ID: LIB189-028-Q1-E1-B1
accacgcgtccgcccacgcgtccggaaaataatctcaacggccatattccttcaaacataggcttcctaacgaagctagaaggtatagtcctttccaataataatctcaccggtgtcatcccaccaaccttgggaaacatctccacactaggggtagttgatttttcagtgaatcaactaagcggaagcattcctaataaagtttggcaaatcccaaacataacagtgttaagtctagcacaaaataacctatcaggtggaatcccagatactctctctaacttatcttctcttacatcattaggcttgaacaacaataagctaggcagcgcattgccatcaaacattggcgatgtgttccctcatctaaatatactatacttagattacaacatttttgtgggtacaattccatcttcc

SEQ ID NO: 16924 - DNA, 300 bp, Zea mays
  Clone ID: LIB189-028-Q1-E1-B3
gcgtccgatcacacgtccgccgacgcgtcagcggacgcgtgggcgggtttgccgtgttcctcgtccatctgaccaccgatcgctatcaccgggaccggtatcaaccccgcgcggagccttggcgccgccgtaatttacaaccagcaccatgcctgggctgacaagtggatcttctgggtcggccccttcatcagcgcagcgctggctgccatctagcaccacctgatcttcatggcgatcgcgttcaggagtaggtcttaaaggatcagatgctgctgcttcgacatgctgccggtcttg

SEQ ID NO: 16925 - DNA, 297 bp, Zea mays
  Clone ID: LIB189-028-Q1-E1-B5
accgacaaggagaccaccacccagggccacgatgacctcggcaagcgctgcgctaagtactacgaggccggtgcccgctttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctctc

SEQ ID NO: 16926 - DNA, 425 bp, Zea mays
  Clone ID: LIB189-028-Q1-E1-B8
agccgtcgggcgcctgcaagggcaccagcggaggccacgccgtgctcatcagcggatacagcgagggcaaaggcaacttcgccatggtcagggacatgatacatacatacatactgctgatcgagctctgctgccttgcatctatctatatacctaacatgcatatgctgctgcttggacgacgcacggcgtgcagatgcccgacgcccacgcgtcggtcgtcggggccatgacgcacagcttcgtccggacgctggagtgccagccgcgcggggtcacctacggccacctgctcagctccatgagggccatcatgaagaatcgcggcgggggctgcgatctgcacggggccatccgcgcacccatccgcaccgtcgccaacttcagcggcgtgcacgtctccatgtccaatccctccgtctctg

SEQ ID NO: 16927 - DNA, 336 bp, Zea mays
  unsure at all n locations
  Clone ID: LIB189-028-Q1-E1-B9
gaaggatctcccaggaggtcagtggtgatgctctgggtgaggagtttaagggttatgtcttcaagatcatgggtggatgtgacaaacaaggcttcccaatgaagcaaggagttctgacttctggtcgtgtccgccttctgctccacagaggcactccctgcttccgcggttatggcaggcgtaatggtgagcgcaggaggaagtctgtccgtggttgtattgtgagccaagacctatctgttatcaacttggtaattgttaagaagggtgagaacgatctgcctggtttaactgacactganaagccaaggatgaggggtcccaaaagggcctcca

SEQ ID NO: 16928 - DNA, 448 bp, Zea mays
  unsure at all n locations
  Clone ID: LIB189-028-Q1-E1-A11
gggtcgaggcgacgcgtccggctagctactaccttattacctctctccggtctccgcagctgtatgcggcggcggccatggacttcgtgctccaggtcctgctgcgagtggtgatgagaagaagcatccgcaggctgcaagaggtcgttgacatcgccgtggacatcggcacggctgtcttcgtggccgtgcgggtctccggcctcgtcttccgccgccggctgcccacgccgactacgacatcgtcgtcgtcgacgacgtactactactccccggggacgtcctcctcgatcggcatgcatgtccaggaggattaattattggcaggcactanatgagctagctagctagctagggccaaaagatgtatacttctcgcgggggggcatgtaagtaacaaagtcatatatctgtgcgttcttttttgtggaatcaaactaatttcgct

SEQ ID NO: 16929 - DNA, 135 bp, Zea mays
  Clone ID: LIB189-027-Q1-E1-G3
agggaacctgaagcgttgcaaccggtcaatgattcatgcaatggcagcctgctgcctgtaacaacaaacaagtattgatcttattgagaccggaaactgtattgcacatggtaaatcaatgtacaattcctccct

SEQ ID NO: 16930 - DNA, 412 bp, Zea mays
  Clone ID: LIB189-027-Q1-E1-G4
cacgcgtcaggacaagcaccgccgcgcaggccaccgtcgtcctcggcgtggccccggaaaaaaaggccgcgcccgatttcgtcaaggccgcggctgattccggcaaggccgcccacggctgcagctgcggtggcaactgcaattgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggttgatccgattgcatctgctgtaaccatata

SEQ ID NO: 16931 - DNA, 368 bp, Zea mays
  Clone ID: LIB189-027-Q1-E1-G5
aggaagaagaaggaccacaaggaggccgaggaggccggcggcgagaagaagcaccacttcttcggctgattgatcctcccgtatcgtcgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgtttcgccaaaagtattagtacccattatgttatattttactaaaaaaagcgaacatgg

SEQ ID NO: 16932 - DNA, 309 bp, Zea mays
  Clone ID: LIB189-027-Q1-E1-G6
agcggacgcgtgggttttttttttttttttttttttttttttttttttttttttattttttttttttttttttttttttttttttcaacgaaccccgaacgggaggtcataaggtattaacaaagcgtactttacagaaactggaagatgtaaaaaaaactagataacagacagaaaacatccaaacctcggcgggccccttaaaaaaccccccaaaaaacccaacaagatgcccaaaaccaaaaaggggagggaaaaaaaaaaggagaaaaccccgggaaaaaaaacccaatccaccaaaaggggttt

SEQ ID NO: 16933 - DNA, 207 bp, Zea mays
  Clone ID: LIB189-027-Q1-E1-G8
ggtgtagttcgtgtccctcgataccagcgtttactccagctacaccataagcggctacttctgctgcatcgtcgacatgtgggatgtgcagtacttcaaattcaaggaatgcatgtacacggacaaggtcactaccggcttggattgtgtctgtcacttgttcgtcagcatgtgaatgtttctcggcttcaacgacgtaattttcac

SEQ ID NO: 16934 - DNA, 139 bp, Zea mays
  Clone ID: LIB189-027-Q1-E1-H1
agactagttctattcttcactgtttttttgctacatttactaaaatatgacctttgttcatatgatctactggtaattcttcgacctttcaatttcacaaaacttgcaactatttttatgctctgcatcctaccaaaag

SEQ ID NO: 16935 - DNA, 335 bp, Zea mays
  Clone ID: LIB189-027-Q1-E1-H3
ggtgttcggggggcaaggtttcgtcccctttgtgcctggttccccggtggaaaggattgtccctgaatctcacctgggcactgtgacggaggctgagcgcagttgaaatgaggcaagagggatgccgacaattttctgtagatcttcagacagataccactcatactcctattttaatttcagaatccactggtgcgaattgttctttgtagtaccttgtgcatatagttttatatagagctgctacacaagctgctgtaaatttctgggaggcactcccaactgtagattactgcaattcatctgtaaatttcaatcttgttcaagaaaaatga

SEQ ID NO: 16936 - DNA, 349 bp, Zea mays
  Clone ID: LIB189-027-Q1-E1-H5
agcccacgcgtccgcccacgcgtccgcccacgcgtccgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccg

SEQ ID NO: 16937 - DNA, 372 bp, Zea mays
  unsure at all n locations
  Clone ID: LIB189-027-Q1-E1-H6
cgctgtccccatgtcaggaggccctgctcttcttcggtcggttttaaggcctgtttggagaggagcctacggcgccgcagcccgccacacctgcggcggccgatttgggcgccacacccgcggcagccggagtgtggcgcggtgtggcgcccgagccagcccaccaaacaggcccttagatagccaaaacgcagtacacacagcgctgcttaccttgacgacgaccacttgtgttggagcagcagtcatctacagccaaaactcttcacttccttcgccattgccgtgttaccagcccagccagcgacgtgggcgtgccgcgacagggttttttccccctgggaaacgttgtgttctggcanatgccacaaa

SEQ ID NO: 16938 - DNA, 284 bp, Zea mays
  Clone ID: LIB189-028-Q1-E1-A1
aggcattcgtaagcccagtcgactcgtcggtgcactcacaggttatcgtcatacctggatacggttccaacctcaccgactcagttcatcccgttacacgcatactctcaccgatgtaatacgaccgcgcttgggacacacctccagaggtgggagtatagaattatcacttcggaccatcagcaggccgattcgtaactaagtatggcacgtccccagcatcgcaatctgcaatcgaactggacacagccgtggacgtgaaaacccacagtggctgtccaagt

SEQ ID NO: 16939 - DNA, 353 bp, Zea mays
  Clone ID: LIB189-027-Q1-E1-E7
agagccaccatcgatctgcaagtctcgctacgtagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagc

SEQ ID NO: 16940 - DNA, 354 bp, Zea mays
  Clone ID: LIB189-027-Q1-E1-E8
ccagcctaaacatcaccgagcataatgacatccaagacaagatagcaatcaaccaaatcaatgctttccagctcattggaatgtcctcctgccttgatctatccggattttttgagaaagaggatgtttctgaaaggaaaatcagatttgcatcaaattattccccagcttatttatttgagaagattgagagcattgtcagaaaaatggggttccaggtacataagagcaacggcaagctaaaagtgatccaagactgcaagggactagcaaattcaagagggcaagagtcattattaatttctgctgaggtgtttgagatcaatgaatctctttatgttgtcgaactaaaga

SEQ ID NO: 16941 - DNA, 338 bp, Zea mays
  Clone ID: LIB189-027-Q1-E1-F1
cacgcgtcagcgtcagcatcggcaaatcctttggctataggatcaacattggtgatgtattatgatgaatcacatcaagcgatgttcatctgcgtgtcaaatgggtgggtaggtttgaaggtcatttgtggaactctcatcacattgtccttcttccgaaaactcttttagagttcgctcagttcgctagctttaagcgctgtgatgcattaagatattcatttgcgctatcttttgcccttgcaatagtttttgtcgatatcgctgatgcaagttccagctgcatccacttctttggaaatgtttagagttccaaactttttcgacaattagatggt

SEQ ID NO: 16942 - DNA, 416 bp, Zea mays
  unsure at all n locations
  Clone ID: LIB189-027-Q1-E1-F2
agcggacgcgtgggcggacgcgtgggcggacgcgtgggcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatcaacagcgactgatattcgctggcaagcagctggaggatggacgcacgctggctgactacaacatccaaaaggagtcaactcttcatttggtcctcaggcttaggggtggaaccatgatcaaggtcaaaactctcactgggaaagagatcgagatcgacattgaacccactgactcgattgacaggataaaggancgtgttgaagagaaagaa

SEQ ID NO: 16943 - DNA, 295 bp, Zea mays
  Clone ID: LIB189-027-Q1-E1-F3
ccaaaaaatgcacttgggggaaccaacggggttctgaaccaaaaaaaaggtcatgtctttgaggaaatgcaaaggccgggtaccccgctctacaacatcaaggctttcctccctgtcatcaattcctttggtttctccagccaactgagggccgcaacctctggtcaggcgttcccccattgtgtctttgaccattgggacatgatgggctcagatcctttggaggccggctcccaggctgctcagctggtgctggatatccgcaagaggaagggtctcaaggaacagatgaccc

SEQ ID NO: 16944 - DNA, 351 bp, Zea mays
  Clone ID: LIB189-027-Q1-E1-F4
cttcagccaaacctccgcccaagcctccggtcctggctaaagccgaaacccccgaagaagcaattactgccccaaacaatggggcacaaaggaattgattaagcccgacaaaacacaagttccttgccttcaaacaaaaggataaaggcgttaagcaaattaataatggccccaagccttaacctaaggcacaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctg

SEQ ID NO: 16945 - DNA, 353 bp, Zea mays
  Clone ID: LIB189-027-Q1-E1-F5
aggatcggcgagctaattgtttacatgattatcattggtgatgtattatctggaacaacatcaggcgatgttcatcatcgtggtatattggagggctggtttggagctcatttgtggaattctcgtgccattgtccttcttgccacagctcttttggtgttcgctccgttggtgagctttaagcgcttggattcattaagatacacatctgcgctatcagttgccctggcagtagtttttgtcgtaattactgctgggattgccatcatcaaactcttcaatggaactgtagcgatgcccaaactttttccagaattagatggtcttaattctatctggaatctttttacagc

SEQ ID NO: 16946 - DNA, 389 bp, Zea mays
  Clone ID: LIB189-027-Q1-E1-F6
agcccacgcgtccgcccacgcgtccggccaaggctgattcgcgctcacccaaaggtatcaaagtttcgcaacaggccattccctcttttttatagtttagaagggctatatgaaggtagtgtggctaccagagagttaaatttcacatcaacctttgttgatcttcctccaccttcagctccattccaggagtgtgtctggacaaagtctcaatcccttgagtactaattcacttgatttggatggataagaaaccacaagtgtcttcaatctatcttctgatgttcaatctgtcccagtcaatactaatgaacccactgaagctcaatttgtcccatctaatcaagaatcaagccagagagaaggtggcagtgggagaaagcgtaagc

SEQ ID NO: 16947 - DNA, 406 bp, Zea mays
  Clone ID: LIB189-027-Q1-E1-F7
agtgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctccatatggaggttgtcgaagtatctgctgttcgtgtcagtgttggtttaataatggaccggttgtgttgtgtgtgcgtactacccagaactatgacaaatcaagaataagtttgttgtttg

SEQ ID NO: 16948 - DNA, 334 bp, Zea mays
  unsure at all n locations
  Clone ID: LIB189-027-Q1-E1-G1
catctcgcnggggaaagaaaaaaaaagaggagaggtgcaagctggtgaaatggatcggttggaggagcggaacattaagaagggggatagggagatggaggaggcgcgcaaggaagaggagcggaaggaggaggcgggggacaggaatacccaggagccgcagcaaggtcaaggcctcagcctctcactcgccaacggcagcgacagcggcaggtctgcaatgttgccgatgtcgaacccttcagctaatcccacacagcttacaattttctatggtggatcagtatgtgtgtatgactcggtgccaccagaaaaggctcaagcaatcatgctt

SEQ ID NO: 16949 - DNA, 272 bp, Zea mays
  Clone ID: LIB189-027-Q1-E1-G10
gcgtcagattgagaccaactagcatcatagaaggcagattattgttgcattaatggcagccaaaatattttgcctccttaggcaccttggtctttcagcaactgctgcaacggcgaccattttcccgcaatgctcgcagactcccatatcttcacgtcatctcccgtatctcatacctgcggtatcgcctgtaagtgacaactcaactcttcacacctacacgatcgaaaacgcaatcatcaagtggcaacttatatttaacacccctgatc

SEQ ID NO: 16950 - DNA, 201 bp, Zea mays
  Clone ID: LIB189-027-Q1-E1-E6
agcccaagcatccgtctacaagtctggatcattaacagtggaatacagtaacacaactacagtagcaatgacggccatggtattttccaccattgtgctcgttggtcttgctgtatgtgttgcgtcggcgaccatttttcgtcaagactcagtgactcttatcactgccgttcttaccgcaaaccttgcagcagtgtccgg

SEQ ID NO: 16951 - DNA, 363 bp, Zea mays
  Clone ID: LIB189-027-Q1-E1-D2
aggagaagtacaggaggccgttgtggatcaccaaggcgttggaaaaccctgtagtgacagtccaggaaatgtcaatgcagtcgacgagcaacctgaccatcagatgggcgttgagagggaagcctaagaacccgttgttcgcgagcgtcggaggagacgtcatcgtccgcgtcgagtcacggttcgtcctgaaccagataagcgggcaggtgctggagcaggccgagtcctgggacctctccgcctcgtccctccctgcccaggcctacttctggctgtcccgaagggtctactccgccgtggagtccgggaaggacgcgatcgaagccgccaagagcgcggcgtcgtctgggctgacgacca

SEQ ID NO: 16952 - DNA, 344 bp, Zea mays
  Clone ID: LIB189-027-Q1-E1-D3
acgcgtcaagccaagcttcggccaacgccttcgccaagccttcagatttccggttggccccgtcctcaccttctccgtcacggctcaaatcacggcttgcatcaatggcgtcgttctcggaggctccccccgggaacccgaaagccggcgagaaaatctttaagaccaactgcgcgcaatgccagacggtcgacaagggcgccggccacaatcaaggtccaaacttgaacggtctttttgggagacagtccggtatcactgcaggcgatgccgacactgcgggaaacataaagaaagctgtaatctgggaagaacacacgttgtataagtaacggccaaaacct

SEQ ID NO: 16953 - DNA, 345 bp, Zea mays
  Clone ID: LIB189-027-Q1-E1-D4
cccggttccgggtaacaaggaccattaccaaaagggattctggatggccaattcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaag

SEQ ID NO: 16954 - DNA, 352 bp, Zea mays
  Clone ID: LIB189-027-Q1-E1-D5
acaggtagggtttcggccaccagccatggccgactccgcgccgtccatcccgggcgtcatcgcctccctccaggcctactccacggccctctccgcctttaccgccgcatggcgtgccgtcgagacccacgcctccaccctcgactccgccctcgccgcccgcctagccggcttctcggagctcgagctgatctgctcggcgatggacggagccggcctccgcgcgtacctcaccgagcacagggacgagctcaaggatcccacgcgcgccctcgacgcagccctccaagttgcgcccgacccggggcttctggtcctctccgcggcagcgagtttctgccgcacgctgccg

SEQ ID NO: 16955 - DNA, 421 bp, Zea mays
  Clone ID: LIB189-027-Q1-E1-D6
agcccacgcgtccgcccacgcgtccgacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggcctaactgaccgccccggcggccggaatccaggcccgtccgtgcttgcctgc

SEQ ID NO: 16956 - DNA, 379 bp, Zea mays
  Clone ID: LIB189-027-Q1-E1-D7
aggtcgtcacgctggagcgggtgctcggggacgaatcaatagctgagttgttgacaaacaacaagttatctgagttggcatgtttggcattatatctcatgtatgagaaaaagcaaggaaaggattcattttggtacccctacattaaggaacttgaccgacatcgaggaagggggcagctagctgttgaatcaccacttctatggactgaaagtgaactggactaccttagtggaagccccttgaaggatgaagttgttgctagagatgaggcaataaggagagagtataatgagcttgacacattgtggtttatggcaggttcactatttcagcaatatccttttgacatacctactgaggcttttccgtttgaaat

SEQ ID NO: 16957 - DNA, 334 bp, Zea mays
  Clone ID: LIB189-027-Q1-E1-D8
tgctctgttgctggtgactaggagcagtagcgagagggattctggatggccaagtcgattaaccacacggcgcataaccagtcgttcacggcgcacaagaacggcatcaagaagcccaagcgccagcgccagacctccaccaaggggatggacccgaagtttctgaggaacttgaggtactcaaggaagggcaacaagaacagtggcgaggctgagtccgaggagtaagatgatggtgattgagtttgtggcgacaaatgcatctcttgtatcgctaagagtcttatctgtgaacttagttctcacttctgtgtgactgtgatcaaatgacttg

SEQ ID NO: 16958 - DNA, 365 bp, Zea mays
  Clone ID: LIB189-027-Q1-E1-E1
acgcgtccagtccatctcctctggcgccatcaacgccccttccttcaagggcgcgcccgctcgcgcaatggtcagcaagaggtccttcaccgtgcgtgcctctctccgcaaggccactgccaccgccgccgtggccgttgccgccagcgtcctgcttgccggcggcggcgccatggccaaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacg

SEQ ID NO: 16959 - DNA, 318 bp, Zea mays
  Clone ID: LIB189-027-Q1-E1-E12
agcccaagcgtccgctcaattcgattggctccgtgtcgacctccaggttgagaaggaaagcatcgcgagttcgccatacggatgggttccaaagcgcctttctgtctcacgctcctcttgctgctcgccgcggcctgtggacctgctgcacatgccaacgatgctgtcgagctcccgcatcatggctcagccttgaaggaacatatttcttcaaccaagattcctgcccgtctcaagaggggcagcggactatgctcggcctgtgaaaacttcacgagcgaagccgtcacttatctcggcaaggaacagacacaggac

SEQ ID NO: 16960 - DNA, 279 bp, Zea mays
  Clone ID: LIB189-027-Q1-E1-E4
caaacgtccgggtttaactcaatactccaaaaactgacaagctatctgaaaatggagaaaatgatagacttaagtttgggccttcaaccatgcaaggatggccagcaaccatggcagatgctcaatcagcaatgccagattttgaaaaccagacaacaatccttggtgtttttgaagggcaaggaagaaaaatccttgccaaattctgttgcaaaaaaccgcatggtcaagtcctcaaaagccaagcccattcaactggtgacctaggcactgctgtcc

SEQ ID NO: 16961 - DNA, 344 bp, Zea mays
  Clone ID: LIB189-027-Q1-E1-E5
cgacccacgcgctcagcccacgcgttccgcccacgcgatccgcccagcgtcatcagctagatgcgtgaggcggacgcgtggggtagatatttcaacgttaacagtggaataccatgtgaaaacagcactggcaaatcacagtattggaacgatgtacagtggcattaaaaaaaggttacgtccacatacacgcaggaaacatagtaaagttaaacaaaaatgtttagagcattgctatagagctcacaatcttgacatttagtcgcatgaacacggctggatatccgataagctcggtgctgtgctgtacgcaaaaatatcatatgcaacaaggttcacggtca

SEQ ID NO: 16962 - DNA, 386 bp, Zea mays
  Clone ID: LIB189-027-Q1-E1-C8
ccacgcgtcagatcgtactggaccaatctgccaccacactttgatcacacacaggaagttgagatcagaaaaatgcaggctgccgcaactgccgccgggttctcggccttgctgcccgccaagggcaggccggcggcaaggaccaggttggtggcccttgtccccgccacagggaggaccttctgtgtacctgctgtcttcgagaccgaggccgcacatatcgactacagctcaagcgtctcggtgttcccgatggaggcctgcaacctgcttggtggcaacgcgtgcaacgggcccatgttcccggaggccaagcccgcctcggcggcggcggcggcgagcatgagtgtggccggggtggacagggactacctgtcctacgacga

SEQ ID NO: 16963 - DNA, 369 bp, Zea mays
  Clone ID: LIB189-027-Q1-E1-B11
gggccgacccacgcgtcagcccacgcgtccggacaagagcagcgtccatgatgttgtccttgttggtggctccactaggatccccagggtgcagcagctgctccaggacttcttcaacggcaaggagctgtgcaagaacatcaatcctgatgaggccgttgcctatggtgctgccgtccaggccgctatcctcagtggtgagggcaacgagaaggtgcaggacctgcttctgctggacgtcactcctctctctctgggtctggagactgccggaggagtgatgaccgtccttatcccgaggaacaccaccatccccaccaagaaggagcaggtgttctccacctactcggacaaccagcctggtgtgtt

SEQ ID NO: 16964 - DNA, 386 bp, Zea mays
  Clone ID: LIB189-027-Q1-E1-B2
acgcgtcagggatatggagaggattgaagggattaaatctcctcctattcaattttgactaggaggggatttaatccccttcaatccccctcaaaccactagtaaccgaacgtggcctgagggggcgggcgagtctttatattgaatgaaactacataaaatagcatgccgtctctgtcactggcaatggacggtggtgcctagcgcaactcagcgcacaactgtgtgtcttgatttttcttctgtttatcacggcattagtgccatgccgttttatgttacagtgttgtgtgctcgcaagcatccgaaaatatgcgtctgagtttagggttgggtcaaacttgtcgaatttggggttctgttataatatgttgagcatggataaa

SEQ ID NO: 16965 - DNA, 370 bp, Zea mays
  Clone ID: LIB189-027-Q1-E1-B3
acgcgtcagattgacataagtactctggctgtggaaagtgaagtggcggctgagaatgatggcccaattaacagtcaggtgcatgaaactgtagctctagaaaatgtggaaatgaaagatgatgtttcttctgctgaaaatgagcataacagatcgagcagccctgttattcatttagaggacccactagtgtctttgaaggatgttgagcagcatggtccaactcctactaaggactttgttgtacctaacacagaagaccaacaagaagccagagatatcagcttgcaggtacaagctgtggattccatgaaagattgtggcgaagtaccagatggaacaatagaggcttcgacgaatgatgatgaat

SEQ ID NO: 16966 - DNA, 355 bp, Zea mays
  Clone ID: LIB189-027-Q1-E1-B4
agccttcacgggcgccttggcgggtttaacgcctttggggggttttccgtgttcctggccttcctccttggcaaaggcggcggcgcccggggctgcgcaagcggctgcgggacgaggtgcggcgcgccatggtgggcaaaggcaaagacggcgagttcgggttcgccaccgtccgcgagggcatgccgctggtgcggtcgacggtgtacgagatgctgcggatgcagccgcccgtgccgctgcagttcgggcgcgcgcgcagggacttcgtgctgcgctcccacggcggcgccgcgtaccaggtgtccgcgggcgaggtgctgtgcgggtaccagccgctggcgatgcgggaccc

SEQ ID NO: 16967 - DNA, 377 bp, Zea mays
  Clone ID: LIB189-027-Q1-E1-B5
agcgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaatagtattgttaatgaaatttttccgt

SEQ ID NO: 16968 - DNA, 315 bp, Zea mays
  Clone ID: LIB189-027-Q1-E1-B6
agcccacgcgtccgagctgatccgtcgtctcccgtcttcccgacccgggtcccgcctcgcccgtcgccgccagatccgacgcgctggatcgccagcggcctgctgctgtcgatccgacgtgcggcagtctgctcttcctgccgtttcactgcgcttgaggtccataatagcacgcatctgggcgggtcaagagcaaaatggattcggacggaagaaggcgccggtgccggctccccctcaacgatggccaagggtccggaaaagaccgacgacttcaaagaaggcgtccgaatcgccggaatcccccaagggtac

SEQ ID NO: 16969 - DNA, 346 bp, Zea mays
  Clone ID: LIB189-027-Q1-E1-B7
agcgggaaacctctcccccgttcccctcgaagcctacgggctcggggggcttcgatcgaatcgaatcggatcggatcggaagcatggagatctcgctcgaggcgtcgtgggtgggcgtgcagcggcacgggcaggacctggcggaccgcctcgcgcagggcttctcggggctcctcctccacgcgcagccgccgcagctgcccccatggtcgccggcggcgctgttgccgcccaagctcgtcatccccttcgacctcgacctccccgttgtccccttcgtcgccgggatgcgccgcggggtcgggaccgtggacctccccgccgtggccgtctcgtcgctcgtcga

SEQ ID NO: 16970 - DNA, 365 bp, Zea mays
  unsure at all n locations
  Clone ID: LIB189-027-Q1-E1-B8
agcggacgcgtgggcggacgcgtgggcggacgcgtgggcggacgcgtgggcggtgccgtgcgccggtgctgtccagtctagggtttcggccctcgcccgccgatccgtcccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaaganaagtggaaagaaatgagcattgcccacccacccatctccaaaacacctaagagaacgataagacagctgc

SEQ ID NO: 16971 - DNA, 306 bp, Zea mays
  Clone ID: LIB189-027-Q1-E1-C1
agaatgttgttgagctatgccaaaacagagtggttgtcttcgataacgtgactgaagaccgaaggctccaagcgcagcaacttgacaaattgctcgatgtagtggattcagtttgtgcaaaaaatggaggaaaaccattttcagatcaaatgttcactagcatcaaggaggtgcatgatagagaaaaagaggtgcatacctcgggatattcagatgagcagatatctgaattgaaaaaggagattcatagaactaaggaagtaaaagcttgggcaaataaccaacatggtcaaggaaaagttaaac

SEQ ID NO: 16972 - DNA, 182 bp, Zea mays
  Clone ID: LIB189-027-Q1-E1-C10
acgcgtcaacccaagcgtccggccacgggttcgtcatcggcctccgtctccttcccgccgccgcggcattcctcgtcctcctcttaaggttggagtgctcaaattcaattgcgattaccgggaggagttgtctgatgccacatgccggggctgcgtccgggcccatggaggtccgtggcaga

SEQ ID NO: 16973 - DNA, 277 bp, Zea mays
  Clone ID: LIB189-027-Q1-E1-C4
ccaacccccgaaaggaactttacttcgcctcccaaaatgattgttattcgttcctttgatgttaacaagcctggttcagaggttgacgaaattagaggtggtgtagctggtggcagtatcctcaggggagttcttagggtgaaccagaagattgaagttcgccctggcattgttatgaaagatgagaatggaaacattaagtgcacgccaatctactcaaggattgtctcactctatgctgagcataatgagctccaatttgctgtcccaggaaggc

SEQ ID NO: 16974 - DNA, 317 bp, Zea mays
  Clone ID: LIB189-027-Q1-E1-C6
gaccacgcggtcaggcccaactcaaattttacatcaaggccattcgccggaaatgggttcggacctgacttacggcggcggaaccttgccgcaaggttcggcttcaaacggtggggaatactcccggaattcttcaaagccgctctcgtgtctcgcccgcgccgcgcgatacgccgccgccgaacagcgccctgtcttcgctctcgcgggtatgctcttcggtggcgctatcttcattttctcttcgccctccactttatcgccgtcagaccccgccgcgtcggtcggcttcaaccatcttgccatcagggggcact

SEQ ID NO: 16975 - DNA, 391 bp, Zea mays
  Clone ID: LIB189-027-Q1-E1-C7
agcccacgcgtccgaactgtagtatcttgttgattacacatttatccaattgctaaatcttggccatattatatttacggttgatataccattgtacttacaagaaattgttagaaaatgatagggaagttcccctaccatatatgtaatataaatatccaatataagaacgaaatagcatcacaagatatgtaccaactcctaaatagcagatgttcaacaagaaattgtggaaccatgtttgtatcactaacttatatgattttgccatatggaaaaccaaggaaaactctgccaaaactgtatttttccaagcatctacttgtttgagatttggctttacattttatctttttgtttgcttcccctaattcccctttgggcctaattt

SEQ ID NO: 16976 - DNA, 315 bp, Zea mays
  Clone ID: LIB189-026-Q1-E1-H3
ccggccaagcgtccgggtgctcaaggatgtggggtacccagttaaactaggtagccgcgtggcaaccgccggcggcgtacctgtcaaactccacgccgctcatcccatctaggatctgagaacaacgtaaggggaggatatcgcaaacaaggccaccgacaacgagtgggcagacgaacgaacaaagcgttgctacatactaccctctcacaatgtaaagttaaatttcacacccatcctgttgctacatactactatagtttctagaattacaggtttgattaaccttcagattaatctacatgtatagccctg

SEQ ID NO: 16977 - DNA, 409 bp, Zea mays
  Clone ID: LIB189-026-Q1-E1-H5
aaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaataaaaaaaaaaaaaaaaaaaaacaaaaaaaaagggaggcctcccaaaaggttcaaactttatttaaccgtgcatgcaacttcaaaccctttcaaaattgtccccaaatttcatttcaggggccttcttttaaaaaattcttgactggaaaaaccttggggtttcccaatttaaccccctttgcagcaaatcccccttttccaaattgggctaattccaaaaaagccccaaacttttccccttcccaaaattttcccacccttaatggcaaaagggaacccccctttaaagggccattaaaccccgggggtt

SEQ ID NO: 16978 - DNA, 423 bp, Zea mays
  Clone ID: LIB189-026-Q1-E1-H6
aataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagag

SEQ ID NO: 16979 - DNA, 301 bp, Zea mays
  Clone ID: LIB189-026-Q1-E1-H7
accgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccgggg

SEQ ID NO: 16980 - DNA, 93 bp, Zea mays
  Clone ID: LIB189-026-Q1-E1-H8
tccgggccgatccacacgtccaccgactcgtcggtccgtcgacattgcgtggaatacgcgggcgtattcacatatggattgcccatcacattt

SEQ ID NO: 16981 - DNA, 394 bp, Zea mays
  Clone ID: LIB189-026-Q1-E1-H9
agcccacgcgtccgctttaaaagcatcctctccgccgcggcgcaacggccacaccttccgtcccccggcctccgctcgcctctctctttctctctcctcgctgagtcgccgccagccatgaacaacctcctcacggattcctttgagctcccccggcgggactcctcaagagatgcagacattgaaatgggaatgcatcaagctgatgcttcagactacttaaaagatttcttgaagaaggtcgatgcaattgagagtttaattgcaaagctgacaaatctattgaataagctacagactgcaaatgaggaatccaaagcagttacaaaagcaagttccatgaaagcaattaagcagcggatggagaaagatattgatgaagtggggaaaattg

SEQ ID NO: 16982 - DNA, 312 bp, Zea mays
  Clone ID: LIB189-027-Q1-E1-A1
agcccacgcgtccgcctacgcgtcggaggacgcgtgggaaactgaataagaatgtacagttgacacatcaattagaacgttcagtgtcaaagttttttttattattccagcaggattcctgccatcggaaacagtacatttgacgtctgactaaaatctgcaatttcaccatggttttttaagagctattggattgagaatgttttaatgccgtatacgacacctgtcaagccgggtctcatacttctctggatttggcaatcacggatctgcaggtccatcacatggatgtgcatccgctaaaaattctac

SEQ ID NO: 16983 - DNA, 327 bp, Zea mays
  Clone ID: LIB189-027-Q1-E1-A11
gccgagccacgcgtcagctgggccatccgccgggctattgctctgacagcttgcccgaggacgtgcataagtacgtagatagatacatcgatcgctagctagctggctaccatggtgtcgctcacgtcggcggtcatcaacgccccatccatcacagccgcactcgctcacgcagtggtcagcacgatggccatcaccatgtctgccacgcttcgaaaagggaatgacaccgccactgtaacggttgccgttaccgtggtggttagcgtccggcgagccatgggccacgacatggtgcatggacgcaaggcagggccgactcgactg

SEQ ID NO: 16984 - DNA, 84 bp, Zea mays
  Clone ID: LIB189-027-Q1-E1-A3
gcacgcgtcaacatctcccccgcaccgtaaccctagcagcagatcggccatggaagagctgggcgacctgcgtggggacaagcg

SEQ ID NO: 16985 - DNA, 359 bp, Zea mays
  Clone ID: LIB189-027-Q1-E1-A4
gccttcagaatacaaaccaaaccaaacccatgggcctgggcctaacaatcccaacggcccaacggctgggctccaagccggggccaatcctcaagaagaacttcccggccggcgttctgggcaagggccccggccaaaaaaagaaccctgcgccggcgaacggcttccaaaacaagggaagtccccccggttaggtcaacgggatcaagacgagcacggtgggtctgggatgtgagggcgtcaccgggcaagtcacggaggtcaacaaggacaccttctggcccatcgtcgatgccgccggcgacaaggtcgtcgtcctcgacatgtacaccgaatggtgcgggccttgcaaagtgatg

SEQ ID NO: 16986 - DNA, 223 bp, Zea mays
  Clone ID: LIB189-027-Q1-E1-A5
cggctcgacccaagcgtcagcccacacgtccgcattcatctcctcgctcccatttcccgggaatcatggcgtccgtcaacgcccgcgccccggtagcggcccttcgcccgttgacggcatcgctgaagttcttggcggacttccttggtcactctaaccgccactggcgcaacacgtctaccatgaagggcattgtcaaggcagatgccaaaggcgaatggct

SEQ ID NO: 16987 - DNA, 346 bp, Zea mays
  Clone ID: LIB189-027-Q1-E1-A8
aggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcgg

SEQ ID NO: 16988 - DNA, 378 bp, Zea mays
  unsure at all n locations
  Clone ID: LIB189-026-Q1-E1-H2
cttcgaccaacacttcggccaagccttcgggttgcccaaggatttggggtacccattgaaccaaggtaccggcttggaacccccggcggcttacctgtcaaattcaaggcggctcatccaaccaaggttctgaaaccattttaagggaaggatatcccaaacaaggccagcgacaacaattgggcaaacgaccgaacaaagcgttgctacatagtactctctaagaatgtaaagttaaatttcacacccacctgttgctacatagtagtatagttttatgaattacaggtttgattaaacttcaaattaatctacatgtatagccctgcccagatttaactatattgggaccgtattacttaccgatcaaaanaaaaa

SEQ ID NO: 16989 - DNA, 314 bp, Zea mays
  Clone ID: LIB189-027-Q1-E1-B1
atcatcctatcctgtcaattgttccctgccatttacgttcatctcaccggataccttcagacatattattgtcatctgcagttttggacgcatccctctggaagataagcctttgcagcttaacttggcggcagatgatcggacgttgtgacccacaatagttgacgcatgttcatgtagtttaagtgttctcagttcccacgaccaaattgacagttaccacatggggttgtcatgctgattgcaaatttctacgtgggatacgtgcattggtacccacggattcaactttattccgacctaaaacaaccttt

SEQ ID NO: 16990 - DNA, 397 bp, Zea mays
  Clone ID: LIB189-026-Q1-E1-F4
aaactccgccggccctccccccaacggtccccttcccccccaaatccggcgggaaggaaaatggccggcttttccaacctcaaggcgggcaatttccccttcggcttcacaacttggggcgcaacaatcacttcctttgtcctgccggacccaaaaggtggccatagggggttaattcaggttgtatggccggttaaaaatttcgtcggtggcggtgactcgccctacatcacgttgtactaccacagcttcgatggaaaacaaggtttcccaggcgacctggacgtgtacgtgacgtaccagctggcggccccctacgtgctgcgggtgcacatgaacgcgacggccgtgaacaaggcgaccccggtgaacctggcgcagcacacgtactggaacc

SEQ ID NO: 16991 - DNA, 212 bp, Zea mays
  Clone ID: LIB189-026-Q1-E1-F8
acggacgcgtgggaaaaatcacacaaccacaaaatcaaaattaaaaatcttccacaacagaggaaacaagtcaattgaaccatggaaagaaatcaaagggcagctcctctataagattcagccttagctactccatcatgaaacgtcacatgtcttccaaacagttcgtaatttaagttatcaggccgtccttttaaacgttcctaacgggg

SEQ ID NO: 16992 - DNA, 261 bp, Zea mays
  Clone ID: LIB189-026-Q1-E1-F9
aggcaacgcatcggtctcgtctccaccatgttcacgtcgggtctggtgggcgaccagttccagctcctgtacatgcagcacgaacacggcggcaggccgggcatcctcggcgacgtcttgatgttcgtcggcgtgcacctggagatgatcatcaccgtcctcgtcactatgcttgtgcagcccatcgtggtctatgatgtcgtcgacgcctagctccatcagatcaagtggagcagctcgattatgtgggcgcagatcgtc

SEQ ID NO: 16993 - DNA, 367 bp, Zea mays
  unsure at all n locations
  Clone ID: LIB189-026-Q1-E1-G1
cgggccaagccacccttcgagaggaaccatttaacccaggttaatccaacaggaaaaatttttcgaaggaaccctttccggccttggccaaattaaaaaaccccctgggaaaattcaccaatggcccttcctcccttggccatttaattcgggtgaactttccttagttaccttccaccaaaaggttccaaatacccaatccaattataaagaactatgacgtcacanaggggcagaccaacttcagaaattcatcgangaagtgaacaagatcgatgcgtacacacagactaaactggacccgcagtttttgcttgagcanacaaagaagcggcttgggattgcttaaagcctgtgaccaaggacg

SEQ ID NO: 16994 - DNA, 400 bp, Zea mays
  Clone ID: LIB189-026-Q1-E1-G11
agcccacgcgtccgcccacgcgtccgcggacgcgtgggttcgccatcatgctggctgagcgatcgacccctcgcgctcggcggcgtcgcctgcaggccaggtccggtttcatcgcatgtcgccgcccgctggtgcttccgtgtcatgggagggagcttcgtttatctttctgaccgacatgtaatgtgcagtgctaggactgctgctgcaacgcttcgcgatgcaaggacgtcgttccagcaggacgattctgtttggactccggaactgcggtttggagttctgaaggcgaataaattgtgatgaaacctgagattctttgtatgaaatacggaatgtatcgcttggacactgtatcgcgaattggtggatgagcatgttgtattccgttgcccttttg

SEQ ID NO: 16995 - DNA, 286 bp, Zea mays
  Clone ID: LIB189-026-Q1-E1-G2
gaccaacgcttccgcggaaaccattaatccatttcccgtcaaccaatttttgaattgttagaactggtttgtaaaacttgtttccccaaccttgcccccaaatcgggcaattttttgggccccgggcaattcactttaaaaatccaaatttgaattgtttaataaaggaaattggttccggaacggaataagtcccaaatgatttaccaaagttcaataataattccgccttaaaattaaatttttccaaaagtttgttacttggaaattaatgccgggaatttta

SEQ ID NO: 16996 - DNA, 420 bp, Zea mays
  unsure at all n locations
  Clone ID: LIB189-026-Q1-E1-G3
ggccaagccagccttcgacgggacgtcagccaaccatttactccaccaatccaaaattgggaaattcaacaccatgaaggtgcggttcgttgcccttgccccccgggggctcgctgcaaccgccgcctcaattaaaaccggcggctgtggttgcaaaacacaacggtttcatcaacggcctcggttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgngccagtgcgtcgagttcctgagggcacagtgcagcccggcggcgacgccctacggctcgccacagtgccaagcgctgcagcagcagtgctgccacca

SEQ ID NO: 16997 - DNA, 257 bp, Zea mays
  Clone ID: LIB189-026-Q1-E1-G4
gaaggggaacacccccagaaaggccgccgggaaccataaggaaggaaccttgaaaaaattcagggccagattaaccggcaaccacgggaacaattccggcaacaacaaggaaaggaaggccaggaaaaggaagaaggagaagaagaagcacggcgagggccacgaccacgacggcggccacagtagcagcagcagcgacagcgactgagatctggtgtcgcagcacaggtgcaacacatgtatgcttgctggatgga

SEQ ID NO: 16998 - DNA, 349 bp, Zea mays
  Clone ID: LIB189-026-Q1-E1-G5
agaaaaggttgatgtattctcttttgggattgttctctgggaactgctaacaggagaagagccatatgcagatttacattatggtgttataataggtggcattgtgagcaacactctacggccgccagtgcccgactcctgcgaccccgagtggaggtcactgatggagcaatgctggtcaacagaaccatctgagcggccaaacttcacggaggttgcgaataggctgcgctccatggcagcatcccagaaggtacaacaacactaagggaacaccaccggcacgcagaatttgtcccagggcagcattcagtcaaacttgcaggttacatccatgggccgcaaattc

SEQ ID NO: 16999 - DNA, 88 bp, Zea mays
  Clone ID: LIB189-026-Q1-E1-G8
aacacgcgtccgcggacgcgtgggcggacgcgtgggtagaactagtcccaagatattaggaatatatcaggttaaggagattagacat

SEQ ID NO: 17000 - DNA, 403 bp, Zea mays
  Clone ID: LIB189-026-Q1-E1-G9
agcggacgcgtgggggacggacggtgctggcatcgccaattcaactccgcatctgcatcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcactttgagcagggcgactgcatcatcgatgggggg

SEQ ID NO: 17001 - DNA, 419 bp, Zea mays
  unsure at all n locations
  Clone ID: LIB189-026-Q1-E1-F3
ttcgaccaaaccttcggccaagccttcgggaaaattgttccttcccttcccaaagacaaacaagcgaacacaaaacaaaaaagcttcaaaccaaaaaaaccaatccaattattgggaagggttccttcctccaaaaaaatggggttaaaaaaggggcaatgaacccccaaggaggacaaggtcttgttccccaaaatcaaaaccttcggccaaagcaactggcgcgcgctgcccaagcaagccggcttgctgcggtgcggcaagagctgccggctccggtggatcaactacctgcgcccggacatcaagcgcggcaacttcagcaaggaggaggangacgccatcatcagcctccacgagcagctcggcaacaagtggtccgccatcgccgccaggctgcccgggcggacggacaacga

SEQ ID NO: 17002 - DNA, 377 bp, Zea mays
  Clone ID: LIB189-026-Q1-E1-H11
agcaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtcagcaagtttgggatcagcaacgtgtatctgggatttgcatcagtatgtgcccttgcagttctgtacatagctgggaatgtggt

SEQ ID NO: 17003 - DNA, 411 bp, Zea mays
  Clone ID: LIB189-026-Q1-E1-H12
cccacgcgtccgcccacgcgtccgcccacgcgtccgcccacgcgtccgcccacgcgtccgcctccctcctgccgggtccttaataaagagcaccagcgcaaggtgagccgccagcttgccccaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacgagaagatcgtgcgcgacaactggcgcgagatcgggttcacctccgacgacgtggggct

SEQ ID NO: 17004 - DNA, 118 bp, Zea mays
  Clone ID: LIB189-026-Q1-E1-D4
ccttcgaatccactggccgccaaggtggtcccgcgaagccggaatgggggcttctccttgtccttgggcaacggattgccgccaaaaacaatggtgcccccaacgaaggccaaccact

SEQ ID NO: 17005 - DNA, 273 bp, Zea mays
  Clone ID: LIB189-026-Q1-E1-D8
cccacgcgtccgggaccgcacctgcgccgccggcgtggggctggtggtcccgtcctgggcgccgcagacccaggtgctggcgcacgccgccacgggcgccttcctcacccactgcggctggaactccgtgctcgagagcctcgtctacggcgtgcccatggtggcgtggccgctctacgccgagcagaggcagaacgccgtgctgctctccgacggcgtcggcgctgcgctccgggtgcccgagtcgtccaagcggagggagattatcgcgga

SEQ ID NO: 17006 - DNA, 409 bp, Zea mays
  Clone ID: LIB189-026-Q1-E1-E11
agcccacgcgtccggacggcccagggcatcggttgctggccggcgctgtggggacgcgggcgccggccagccaaggcttgcagctgaagctgaaagacggccgccgccgcgcgccaccaaccggagtccgaactccggagaagcgagcttgctttctttcatgagctttcgttcttgaatctacagtctacaaccgacctcagaccccctgctacctgcacctctgtaaaataacgccgtcgccgtcgtcgccctctccctttctggtgtgcgtgtgacgcagcgatctctgtcgcagctcttgacgtctgaaccgtagctcctcccgctttgagccggcgcggggcgcgggcctcacgttccagctgccgcattgcacgtggtcagagaaagcggacagaacagaaca

SEQ ID NO: 17007 - DNA, 413 bp, Zea mays
  Clone ID: LIB189-026-Q1-E1-E12
aggccaaactaagaaacgccaagttgccagccaaacgaaccagctaaaacaagggggggcagcaccgcggcgcggcgcggcgtggggacagagccctcgtgatcgatccgtccgtgggatctcgcgcacgccaggattggagagccgcggcctccccccgccccaaccagccatgggttcccgcgcggatcgcggctcttagacgcggaggaggagagagacagggggaggggaaggccgaggcctaggaggcgtggtgcagcgcgcgagcgcgttcgttcggcatggaacagaacgacggctcgttcctcgccgtgcgacgcctctccggcggcgccatccaccaccatcgccaccactcttcgccgggctgaggtcctggccgtgtccacggggtggatcgggaaggggct

SEQ ID NO: 17008 - DNA, 61 bp, Zea mays
  Clone ID: LIB189-026-Q1-E1-E2
atttccgcgttcgcgtttccctcccttttctccggtccttgggttttggctgttcccgtcc

SEQ ID NO: 17009 - DNA, 382 bp, Zea mays
  unsure at all n locations
  Clone ID: LIB189-026-Q1-E1-E3
ggtggtcccccggacccggcaatggcctaacggcggcttccccaaccttcttccaacctgggctctcctcctgtgaaccaccaaccccgcagcagcacgcaaaacgcctccttgccatagcgcctcacgaaagcatcgcagcagctagggaggangagagccacttgcgtcaagagctcgctgcagcgggcaataataacgaggccggcggcggcaggacgaggacgtgcgcgctgccgacgtgggcgctcatcggcggcatcacggtgggcgtgaccgtggcgctggccctgtccgcggggccaggccccgccctggcgctggggccagagggccccctgntggaggagttctgggacaacatgcggcggtacgcgctgta

SEQ ID NO: 17010 - DNA, 302 bp, Zea mays
  Clone ID: LIB189-026-Q1-E1-E4
aaaccttccccggccccttggaaaaaaaaaacacaaaaaaaaaaacaaaaaaaaataatctaaataaaaacaacaatcaataaaacaccaatcaaaactaattaacacattactcaaacatcaaaaaataaaaaaaagggccgcccctccaaaagtttcaaacttttcttccccttccttcaaatttaaaccctcttcaaaatttcccccaaatttcatttcccggcccttttttttaaaacttcttaatggaaaaaccctcttctttcccaactttaccccctttaaaaaaaatccccttt

SEQ ID NO: 17011 - DNA, 153 bp, Zea mays
  Clone ID: LIB189-026-Q1-E1-E6
gacccacgagtccacccacgcgtccgcgttgacatctgtttccgtgccgttactgttcactgcgcacatgagaacctccaggcaggtcccatatcggctgtcgaggactctgttgggctggcacgcttcatcattgaggaaaatgtcagcatc

SEQ ID NO: 17012 - DNA, 378 bp, Zea mays
  Clone ID: LIB189-026-Q1-E1-F10
ctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccg

SEQ ID NO: 17013 - DNA, 373 bp, Zea mays
  Clone ID: LIB189-026-Q1-E1-F11
agcggacgcgtggggttctctgcaccttatgtttgcagctctgctctgttcagtgggaacgggtcagggggtagatacatcagtaacgggaagctgttgtccagacggcctcgtggaatcgattccaagaagaggctctggactaacgtccttcttgctcttaatgtcctggcttatgtcgctcaggtagcatcacaaggaaagcttcttatgtggggagccaagatcaacagtctgattgatagagggcaattttggcgtttggcaacatcatctctacttcatgcaaatctcacccaccttgcattcaattgtttctctttgaactctattgggcccatggttgaaatgttaagtggtcctagaagatatc

SEQ ID NO: 17014 - DNA, 431 bp, Zea mays
  Clone ID: LIB189-026-Q1-E1-F12
ccggcctcgacccaagcgtcaggagaaggaagagaaagaaaaaaagaaaaagaagatcacttagaataccttgaggagcgtcgcctcaaggatttggtcaacaagcactctgagttcatcagctaccccatctccctgtggactgaaaagacaacggagaaggagatttctgatgatgaacatgaggaagagaagaaagacgctgaggagggaaaggttgaggatgttgacgaggtgaaggaacagaatcaaaactagaaaaagaagatcaaggaggtttctcacgagtggtcattgatcaacaagcagaagcccatctggatgaggaagccagaagagatcacagaggaacaatacgctgccttctacaaaagcttgacaaatgactgggaggaaccatcgggctgtgatccacttctctgtggagggtc

SEQ ID NO: 17015 - DNA, 318 bp, Zea mays
  unsure at all n locations
  Clone ID: LIB189-026-Q1-E1-F2
ggccaagccagccttcgaggaacctccagccttaataaaatggaccggttaaaaaagaaggcccaaaaagaatcccaattggaaaacctggaaaggttaaaccgaatttggtcaaacccggaaaaagcaccgggccaaaggcggaaaaaaaaaaacctccggcgggaaaaatttgaaattgcaaaccgggataatgtttaacaagaagcggatgcatctgagcgtgatgacagcataaatgatggggaaatgaaaccagatgcatcctctgacagttcagaaatggcgtanaggtggtangagggttgggaggcactg

SEQ ID NO: 17016 - DNA, 70 bp, Zea mays
  Clone ID: LIB189-026-Q1-E1-B8
tgttattgctatcctgccctgggaggaatggtgggagtttgaagtgacaaaggatgactcaaatcctcag

SEQ ID NO: 17017 - DNA, 375 bp, Zea mays
  Clone ID: LIB189-026-Q1-E1-B9
acgcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtc

SEQ ID NO: 17018 - DNA, 255 bp, Zea mays
  Clone ID: LIB189-026-Q1-E1-C1
gcgtccacggacacgtgggcggacgcgtgggttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtaatgctgccgggatcaattttgccgtaataaaaaatctatcaa

SEQ ID NO: 17019 - DNA, 401 bp, Zea mays
  unsure at all n locations
  Clone ID: LIB189-026-Q1-E1-C10
cggacgcgtgggcgacgcgcaagccagtgccgcacccagaccagatctccgcgacatatcagtcgttcgtccagctaactgcactgcactgcactgcacgcaatggccaccacggcgaccgaggcggccaaggctgcaccggcgcaggagcagcaggccaacggcaacggcaacggcgagcagaagacgcgccactccgaggtcggccacaagagcctgctcaagagcgacgacctgtaccaggtaaacaagctgagcgcaatgagtggctgaatctgaccgggatctgagtctctgaccgcgggggaagaatgatccgcagtacatcctggacacgagcgtgtacccgcgggagccggagagcatgaaggagctgcgcgagatcnnacgcaagcacccat

SEQ ID NO: 17020 - DNA, 184 bp, Zea mays
  Clone ID: LIB189-026-Q1-E1-C11
agattgcaacaacaatccttggcacatctaaccctacaaaccattgcaacgcaacaacaacaacaacagtttctgccatcactgagccacctagccgtggtgaaccctgtcacctacttgcaacagcagctgcttgcatccaacccacttgctctggcgaacgtagctgcataccagcaacaac

SEQ ID NO: 17021 - DNA, 407 bp, Zea mays
  unsure at all n locations
  Clone ID: LIB189-026-Q1-E1-C12
cccacgcgtccgcccacgcgtccgcccacgcgtccgctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcngcgcgctcggctgcgtc

SEQ ID NO: 17022 - DNA, 418 bp, Zea mays
  unsure at all n locations
  Clone ID: LIB189-026-Q1-E1-C2
agagagggagggtcggcgcaggacatcgcaacaacggagccgccgaggcgtctgcaaaacctgaccgtccgccccggcgttgccgtggactccatcgagttcacctacaccgacacaggtggccagacgcgcaccgctgggcgatggggtggacttggcggcaacgtccggaagctcgatcttggcgacgctgaatacgtcaaggaagtttctggaacgtacggcgcattcgaaggtgcgactaccctgacctcgttgaggattgtcaccagcaccgccagagcttgggggccatggggcatcnagagcgggacacgtttctgcatcancggcaccatcggcagcagcatcgtgggattctatggacgcgcgacgaacaggctcgtcgctgcgatcggtgtctacctgcgccaacttt

SEQ ID NO: 17023 - DNA, 449 bp, Zea mays
  Clone ID: LIB189-026-Q1-E1-C4
gggccaacccacccttcgagtacaagaaccactaccaacctgccctaaaggataatgtttggaaattagaaaagattggcaaggatggcccatccaacaaaaatttaaatgcaattggaatcaaaacagttgaaaatttcccccggcttcttgtaagggatcaccagagattacgtagcattctgggcagtggaatgtcaaataagatgtgggacagccttgttgagcatgcaaagacatgtgtcttaaatggaaagcattatgtatactatgctagagactcaagaaacgtgggtgcaatattcaataacatctacgagttcactggtttgattaccgatgaatagttcatttcagctgaaaatctcacagacaaccagaaggtctatgctgatgcattggtaaagaaagcatatgaggactggatgcacgttgtagaatatgatggc

SEQ ID NO: 17024 - DNA, 304 bp, Zea mays
  Clone ID: LIB189-026-Q1-E1-C6
acccacgcgtccgcggacgcgtggggtcgtcctcggagagaatgactacaccacttcacttcacctaataatactcgatctttgccaccagacttcttctgtggtacaagcatctatcatcaatccctttcgcatacaacatacgcagccatggccggaccaggcgcatcccgaggctacatcattaccctattgacgggctcaatcctcgccggatggatatccgtctccttcttcggcggaatgccaccatggacccctcgctctcaggatcctgctctttctcaggccctacctgaaaccc

SEQ ID NO: 17025 - DNA, 326 bp, Zea mays
  Clone ID: LIB189-026-Q1-E1-C8
gatccacagcatttgcatcaattcccacacatctcttaacgaagaggttcttcttggccatctcggtgtgcagcgccaccttggtctcagcatcgaacaccatatcctggagcgcagtctttgcggcgatggcctggtgcgcggtggagaagagcgcgaagcccatgggctggtcgcccttgaagttgatctgggacgcctcgaatctcgggagccagcgcagcaggttgtgcagctccctttccttgacgtctgcagggagccccgtgatgaagatggtgcggacctcgtccgggccaacggtgccaggcgcgccggggacggga

SEQ ID NO: 17026 - DNA, 362 bp, Zea mays
  unsure at all n locations
  Clone ID: LIB189-026-Q1-E1-D11
aggtggtgcgcggcgtcttgaggggcatcaaggagaagggactcaccaacttcatccgcgacgtccgcgacgaaggatacttcaaatgccttctggacgggaaccttttgcaaacgaaaatccacaatattggcgcaacacttgtaggagttgacaagtttggtaacaaatattatgagaaactacatgacactcagtatggaaggcatangtgggtagaatatgcagagaaaggtcgttacaatgcatcccaagtgcctgctgaatggcatggatggctgcaccacatcacagatagcaccggggataagctgctgaaccagaagactgctaggtaccttgtagagcacaagcagaactac

SEQ ID NO: 17027 - DNA, 395 bp, Zea mays
  Clone ID: LIB189-026-Q1-E1-D12
cccacgcgtccgcggacgcgtgggcgcccaacgcggcaactgcccaccgtccggctcgccggagccgtacgtggcgaccggtggagctggagtgcgcggagaagggatctcagggtatttgccacttccacggaagcggatcgtgaaagggaggaggaggatgtcgccgacgattactattccgttctgggtgtgatgccagatgcaaccactgaggaaattaagaaggcatactacagttgcatgaaggagtgccaccctgaccttagtggggaccaccctgacgtgacaaacttctgcatgttcatcaacgaagtttactcggtgctgagcgatccagcacaacgtgcagtgtatgatgagatccatgggtacacagcaacagcaatcaaccc

SEQ ID NO: 17028 - DNA, 316 bp, Zea mays
  Clone ID: LIB189-026-Q1-E1-A1
acccacgcgtccgcccacgcgtccggcacaaaacacatcaccgcatctttttccttccgagctgtacgtatctgcagagagagagagagagagagagagagagagaaagattaggtcagagaccatgaagcacccgaggccgacggagcaggatgtgtcgctggcgctgtcgctgagcacggactcgtccacgacgacgtccgactcggcggggacgccaccggcgaagcgggcgcgggcgcaggcgcggtggcggggcgccgtggtggccacgtcgggggagggcgagtccgtctgcaggacctgcagccgcgcc

SEQ ID NO: 17029 - DNA, 413 bp, Zea mays
  Clone ID: LIB189-026-Q1-E1-A10
agcccacgcgtccgcccacgcgtccgcacaggcagcagctagcatccctcactctcggtacctgacctgaccacgagagcaacatgggcggaggacacgacatgcacgggcagcactacgggcacaacggcggcgtgaagggcttcgtgtccaacctcgtccacggcggcggcggccatggccatggaagcggctacggccatggccatggaaacggctacggccatgggaatggcggctacggcggcggccacgggtaccctcctcccgccgccggcggcgcgtaccctcacccgcacggcgcctacccgcccgccacctaccccgcgcactcggcgcactacgggcacacggggtcgtaccacaccagccacaacagctacggcggcggcggcggccaccacggcatctac

SEQ ID NO: 17030 - DNA, 417 bp, Zea mays
  Clone ID: LIB189-026-Q1-E1-A11
agggcaaccgcgtccggccgtccgcttccgtctccttggataaccacgacgcccgccggcaagcgaaagcgaagcgagccaacccagccatggagaaggcgatcgatcggcagcgggtcctcctggcgcacctcctcccctccccctccgccgcctcctcgcagcctcagcttgcggcgtcggcgtgcgcggccggggacagcgccgcctaccagaggtcctcctccttcggggacgatgtcgtcgtcgtcgctgcctacaggacgccgatatgcaaggccaagcgaggaggcttcaaggacacctacccagaggacctcctcactgttgttctcaaggctgttctggacaacactagaatcaatccagctgacatcggtgacatcgtcgttggggaccgtgctcggccctggttcc

SEQ ID NO: 17031 - DNA, 439 bp, Zea mays
  Clone ID: LIB189-026-Q1-E1-A12
ggttacggtcaggggcccccggctcgacccaagcgtcagcggacgcgtgggcggacgcgtgggcgcaagggtttgtttcatcatatgacactgctcatcaatacagtgacagtgaagaagatgcacataagtgggtcagtcaccgaaaccatcgagggaacatctgcggagttgatttcatatggcttttaaatcctgacaagtgcaggaagcccctgaagaccagctggaatgaagctgtttttggtatcattaagtacttcctccaagttgttgcattcctttccgaggagaatgcatttgcactcctgaaggcagacagcctttatgatcacatcacatattcaagtttctaccaggcattgtgtcagttaggaatggtccatcctgatagactaagatcagaagaaattgaggagttgtggattgaacctgaccg

SEQ ID NO: 17032 - DNA, 212 bp, Zea mays
  Clone ID: LIB189-026-Q1-E1-A3
gcgtccggggttatcgcgccgccgccgccgccgccgccgcagccgcaacaatgccgtcgcacaagaccttccggatcaagaagaagctggcgaaaaaagatgccccagaaccgccccatcccctactgggatccgcatgcccactgacaataccatcaggtacaacgccaagcgcaggcactggcgccgcaccaagctcggcttctgagcgt

SEQ ID NO: 17033 - DNA, 417 bp, Zea mays
  Clone ID: LIB189-026-Q1-E1-A4
cgggccaagccagccttcgacggaaccttggccaacttgttccattgatccttgaaaaattcaacctccttttgcacaacaaggccaaggatttcttgcaactgcggttcaacctgcggctgcggctcaagctgcaagtgcggcaagaagtaccctgacctggaggagacgagcaccgccgcgcaagccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgattacaccgatcgacgaccatggatatgattattatctatctagcttgtggtggtggttgaacaataataagcgaagccgagctggctgccatacat

SEQ ID NO: 17034 - DNA, 110 bp, Zea mays
  Clone ID: LIB189-026-Q1-E1-A6
acggacgcgtgggcgtagacttcgtagtcaccgcgttcgcatcccgagcacgcaaccatggctcgactgtcagccaccgccgcgctcctcctcctcgtcctggtcctcct

SEQ ID NO: 17035 - DNA, 426 bp, Zea mays
  Clone ID: LIB189-026-Q1-E1-A8
cccacgcgtccgcccacgcgtccgacttcttcagtgccgtgtttttcgggatccatatgcttagaacagaacaaatatcaaggagtacggacaagaagaaatttttagctcttcttggcttcgaggtccttgtggttgctttctcctccgttctctggtttatgttcaaagatggctacgttgataccagcggatccagctttgaatcttggacgttcgggatgctctgggataccacagtttcgtttccttggataccagcattgtacactggagttctttctacggtgttatgcatgtgggcagagatggtggcgatgggcgatgtttcagcaaccgaaactgcagttgtttacgggttggagccagtttggggagctgcttttgcttggttcctccttggtgaaagatgggatgacgctgcat

SEQ ID NO: 17036 - DNA, 394 bp, Zea mays
  Clone ID: LIB189-026-Q1-E1-A9
caaccaaacccgcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctcgccaa

SEQ ID NO: 17037 - DNA, 257 bp, Zea mays
  unsure at all n locations
  Clone ID: LIB189-026-Q1-E1-B1
agtaatttgctatttttcctcgttctttgtttttgtacttattgagaattgatgcctcggattctctgatgtatgtatgattgggctcaggctcagggcactttgccatccctattttgtcatttcggttcttccttagcgtggaacgtaatgagtgtgagaaagtaaaattggtgaaagtgaaaatgggaactgagagcaaaanaaaaaaaaaaaaaaaaaaaaaaaaaaaaaaaaaaaaaaaaaaaaaaaaaaga

SEQ ID NO: 17038 - DNA, 339 bp, Zea mays
  Clone ID: LIB189-026-Q1-E1-B10
tctgcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagct

SEQ ID NO: 17039 - DNA, 382 bp, Zea mays
  Clone ID: LIB189-026-Q1-E1-B11
agcccacgcgtccgcccacgcgtccgactgcaccggcatgttccggggctgcgccaccgaggacgggttcatggaggtcggcatctgggagtgagctggaggccccgccatctaaacacaaatcaaaatcagtgtgcgtgcagctgcatgtggccatcctgcgattgccatgtgtttaatctccgggtcacaggtgttgtcgatgatccaccactagtagtagcgattgcatggagattggtgctcgggtcaataatgatggtgattgtgacggagtgccctgcaaaataattaataattcgtgtgaaaaagttgattaaaaaaaaaaaaaaaaaaaaaaaaaaaaaaaaaaaaaaaaaaaaaaaaaaaaaaagagcggccg

SEQ ID NO: 17040 - DNA, 480 bp, Zea mays
  Clone ID: LIB189-026-Q1-E1-B2
cgctggcaggtacgggtcaagaatacccgggccaaccaacccttcgagttctcggccaacccggaatcttccaaaacaaccggtgttccccaaattccccggcgggcaaaaccaacttcgcaacccccattcaaaacaattccttttgcaaccccaacggtcctccaaaaaattaaccaaaatgttttggaaaaggatccccatagataaacttgatcaaagctgcaactattgaaaaaaatatcccccagatctactactaacaagcgcaagaagagaacatcaccaaaagttggtcgtcttagagcaaactggaatagtggactagaaaagggtttagttgaaattcttcaagatcacaacaatgattgttataagggtcaaaatgggtggtcaaccgaaacaatggataaaattgtcaagttattccatgagaaatttcctatgtcacatttacaaaatgccaaatccaagataaag

SEQ ID NO: 17041 - DNA, 260 bp, Zea mays
  unsure at all n locations
  Clone ID: LIB189-026-Q1-E1-B3
ggtcgagcacgcgtccacgaggaggcccggccttctttccccttcccccccccggcggacccaaaaaggccattcgggtcccccggaagaacccccccgccttggcccaacggaagccttcccggcaacttcgngctttgatccctggggcctccgatttgaccccgagagcctgcggtggaacgtgcaggcggagctggtgcactgccggtgggcgatgctcggcgcggcgggcatcttcatcccggagttcctgacca

SEQ ID NO: 17042 - DNA, 417 bp, Zea mays
  unsure at all n locations
  Clone ID: LIB189-026-Q1-E1-B4
gggccaacccacgcttcgagcaaattccccaaccaaaatttaaccaattcccacaaaacaagccttaaaggtcggcgaacccaaaaatgcgcccaaaaacgacatccggaaaacaaggcgcctcccgggccttaaggtccactttgcggtaaacccgctagaaacaatcaaaacgcgcatgcaaagccccgactacaataaactatacacaaatggcgccgacgcaaaagtcagccggtcgaagtttcgcggggtataacaaggaattggaagtgtaactctggcgacattgccttcttcaggagcattcttcacgacgtacgaaggagtgaaatctatcctgaaagacaaaantctaaatctggcaatggacacttgcttcgtcaacagtcatccactcagttgcctctgcaaccg

SEQ ID NO: 17043 - DNA, 332 bp, Zea mays
  Clone ID: LIB189-025-Q1-E1-H8
gacccacgcgtacgagctctcatggacatctccctcccctgtttccctccatggtgtctgctctcctcttcccagacatggctggcgcgtctctctccctggagctctctcgactgcgccatctccagcttctcgccagggacgcgcgcaaatccctcaagcttccttccatggcgctcccaatttcaagcgctcggagctccagctcaaccgaccgcccggcaccaatgcgcgcctcaggctcctcgcggcctcgctgggcgggatctccctccagctccaatcccctctaccgcgcccctctgcttgccgcgaacgcgcgccgccgccct

SEQ ID NO: 17044 - DNA, 360 bp, Zea mays
  Clone ID: LIB189-025-Q1-E1-G10
cacccacgctagcgaacctggcgacctgggcggagaagacacatgcctcccttcctccgccactggctgagcctcgtcgggagcatctggctgcagaccgtcaaacggccgaacgccgacttccccgtgtactcgtcccagctcaaagagctgaagcacatcacgcaggtgcagctcaacttcctggcgttcgcgtcggacgcgggcaagctcttcgggtggttctccggggtggcggcgctgtacctgccgctgtggctcgtggccttcgtcggcgccgcgttcggcctcgtcggctacggggtccagtacctgttcctggacagcgccggcctccggtactggcacctgttcctgctc

SEQ ID NO: 17045 - DNA, 393 bp, Zea mays
  Clone ID: LIB189-025-Q1-E1-G11
agccaacaccttcggccaagcctccgaaattttaagaagatgatacaaaccaagggcaattccaatgcatccaatgtggcaaaagcaaggtttgttgcaaaggaaacttcctccaatgggttaaatttggattctggcaatccggtaaaccccgttataaccaacaatttttggagaactcaatgaagcaaaattgcccaatctgttaagagtatctatttgactcattacaaggaacaagagttcttaactgtggacacacaatgcacttgacatgttttgaagaaatggtggcgcataacaaatacacttgtccaatatgctctaaaacagctcttgatttgacacatcattgggaaatgttggatcaagagatcgaagccacgatcatgc

SEQ ID NO: 17046 - DNA, 162 bp, Zea mays
  Clone ID: LIB189-025-Q1-E1-G12
gagaataaatttggaacagaagcccgcatttgtaaagtttcatgccctttgtgctaaaaagaatgggagggacggtttagtgttacttgtgggaaactttaaccctaacaaaggattgggtgatgtattaatagattgagttagttgggtctgacatacaca

SEQ ID NO: 17047 - DNA, 413 bp, Zea mays
  Clone ID: LIB189-025-Q1-E1-G2
aggttctttcagctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatctttgttgggttccttctgagtttgatgtgtggtgttcgtttaattcccctgtacaacccaatttagtaccattgtgaatattttggattc

SEQ ID NO: 17048 - DNA, 361 bp, Zea mays
  Clone ID: LIB189-025-Q1-E1-G3
agaaaatcaagatctcccgggaggttttttgacctagtttatcatgaaaatgcccgtgttctactgcatgatgagagcatataccgatttgaatgttgctcaagtccgacaaggttgtctattcagctgatggaatatggtcacgaaaagccagaagttaccgcagtatcaattgatccaaatttttcttcgtatctttttggcgagtatttatgtagtacgtcagacaagaaattatctgaaggcgtctaacttgcaaggaataagcggaaataatcagataatgatgaaccttcagatttttttgaaggaatggatggtatcaaagttgtgaatggtctcgaatgcaagatatcctgca

SEQ ID NO: 17049 - DNA, 263 bp, Zea mays
  Clone ID: LIB189-025-Q1-E1-G7
agatcgctgtcatggaaacgacgtcatgcttcctgacctccaaagcatcgtccgccagcaggagcacggcggtgctgccgcccaccgcccccggcttcgcaaagcctaaaccttgtctgcaactccttggcaacaaccgccgccgtgcctgctgcgggagcatcagcgcgcggggggcgcccgaggacagcgccgcgccaacgcccatcggtcccgaatggggctcgtttcgcgcgcaactctaattcaaggagcaactgccg

SEQ ID NO: 17050 - DNA, 371 bp, Zea mays
  unsure at all n locations
  Clone ID: LIB189-025-Q1-E1-G9
agcttgtatcatatcatatanaacaagaatccccaccacgcagttgcactggcacgattaacaacccactgcatgtcaagttcctgaagaacatgttacgggtggtcctcaataacttgggccccaacctcctcctccccggcaacgcccggcttgtccccaagacaacccctgagaagtacaggccccggcgcgcgagatccggccggtccactgcctgctggccctgctccttgccgctgcagtcgccaagctgcgtcgcgtgggccggcccaaggacgtgtacctcgtggagtacggctgcttccggcccaagccctggttccgggcgcctttcgcgacgtgcctggagcacgcgcacctgatgccgt

SEQ ID NO: 17051 - DNA, 356 bp, Zea mays
  unsure at all n locations
  Clone ID: LIB189-025-Q1-E1-H1
agaggaccccaccaaggtggaccgcagcggcgcctacgtggccaggcaggccgccaagagcatcgtggccagcggcctcgcccgccgctgcctcgtgcaggtgtcgtacgccatcggtgtgccggagcccctgtccgtgttcgtcgactcgtacggcaccggcacgatccccgacaaggagatcctcaagatcgtgaaggagaacttcgacttcaggcccgggatgatcagcatcaacctcgacctgaagaagggcggcaacaggttcatcaagaccgccgcttacggccatttcggccgtgacgacgccgacttcacctgngaggtggtgaagcccctcaagttcgacaaggcat

SEQ ID NO: 17052 - DNA, 284 bp, Zea mays
  Clone ID: LIB189-025-Q1-E1-H10
cgggctcgagccacgcgtcaggtgagggagcgaggtttgttgggacgtccgtgggggcatcaaaacaagcacgattcctagtcctggaaagttaaaaccaggcatccattcgatcgtcgtcgacggtcttagtaatagctacttattttgcagtgggcgatgaaagaatggtgtcatgtaaatgtagctccagtcgtgtcgcattctttgatttgttgtttcagcagcaccggatgtacaagtactgagtttgggctagcaagaataagtaatctttttcggcc

SEQ ID NO: 17053 - DNA, 76 bp, Zea mays
  Clone ID: LIB189-025-Q1-E1-H11
tcctccggcggatcgtcgccgctgtaccagttccgcgctgagctctccgtggacgtcagctccgtccacgtcgaca

SEQ ID NO: 17054 - DNA, 155 bp, Zea mays
  Clone ID: LIB189-025-Q1-E1-H12
tcatctactttcgcctcctcgccatcctcctcctcgccgtcggcgtccacatttacctcggctagctagtcgccggcgggcggccggctgagcgaggctagctgctggcgcgcggcggcccggcccggctttatttgacatcatctgggtggctg

SEQ ID NO: 17055 - DNA, 366 bp, Zea mays
  Clone ID: LIB189-025-Q1-E1-H3
agcggacgcgtgggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggagcagaagccgcagcggcctgcgtggagcgggcgcgtcaagaacccggatctgaaccgtgcgccgagccc

SEQ ID NO: 17056 - DNA, 201 bp, Zea mays
  Clone ID: LIB189-025-Q1-E1-H4
ccggccaacctcagggaaaggttcaggccaaccaatccggtcgcagaagaaaaattggtaaaaggtggtaacataagtttaaaccccccaaaaataaccaaccaacggttggatggaacaacccaaaagcaataacccaaggtaaccaaacgttacaattccaaaaaccacccaattcaactggccttaacccaaaatcct

SEQ ID NO: 17057 - DNA, 188 bp, Zea mays
  Clone ID: LIB189-025-Q1-E1-H6
accgaattccctgcgaatcctctcccctcgcctcctcgtctccccctaagggattctccgagaagaatccccaaaaaggccctctcaacccaatttaaggaaccctggagccaaaagaagcttggttccaagccccccaaggaaccaacctccggaaccaaaaacgggggctccttcggaaccccggg

SEQ ID NO: 17058 - DNA, 362 bp, Zea mays
  unsure at all n locations
  Clone ID: LIB189-025-Q1-E1-G1
agcccacgcgtccgcccacgcgtccgcggacgcgtgggtttttttttaacatgacatggcttatgtaactggcaagccaagctgctgctggtacagggaaccttcaaaggaaggaaaaatattgcctggcaatggcaatggcagtcacccgacctggcaagaatggaagatgatgatggggctatggacaaataatttacctattccttgtgttcgcctctactgacagcaatcaatcgatcatttacagtgtgtgtttgtgtagattaaccttggacacgacaataccttgtttttgttcctatccttcctcaacaacaacanannaacaaaacaatgaaagaaatgaatcttgccgccac

SEQ ID NO: 17059 - DNA, 426 bp, Zea mays
  Clone ID: LIB189-025-Q1-E1-E2
acgggtcatgtatatcatggtaccatctgtcccaatgtgtaaagtagtatgcttactattttttattcggttcaggttgcagtcatgaattctgcatcaaatgtgctctctacctctgctcaaccagcaacatccgtgtcgagttcacaggcccacctgggtccatcccgtgccctctttgtcggaacggcataatgtctttcaccaagttaccaagcacaccaacagaagggcttaaatcaggttcagcgctcacattctgcaacccatgcatactgaacacccggtccatggactcgccagccactttctccaaagccgaaatcagacggaaccgtgtggcagctgtctcttcggagctggtctgtccaatcaactggaacccaattcccgtcgtccgccctcccaacctgcaggtgcagcgac

SEQ ID NO: 17060 - DNA, 265 bp, Zea mays
  Clone ID: LIB189-025-Q1-E1-E3
agccaacgcgtccgcccacgcgtccgaggatagatataagcgtcataggcactacgactaccatgacgagctatagatcctgtattcttttgaaatctgcacgatattggatgtctgtctacggagagcgcacgtgcaaaacttgtatgttgtactcacggatgaagctgaacctgtgattttggcgatgggtagagattggccatcgcgtctgtaactaaatttccacgttgcgatgcaatatgagctgtagtactgtcctcgc

SEQ ID NO: 17061 - DNA, 381 bp, Zea mays
  Clone ID: LIB189-025-Q1-E1-E9
agctcgatcgcaacgcgcttggcatggcgtccgaggtgtggctatcgccggcgtctcgcctcccatccctctccaacgcaccacctcgcttacgctccaagcctgccaccacaaccgcctctttgctctctccctgtccccgccctgcccgcgccctgcctgtgctgcgtgtccgtcgccgccgccgacttcgcgccaacgagcagcaaggccaggttcaggagcaagatgacgaggtggtggacaggaacatcctcccctactgcagcatcgacaggaagcagaagaagacgctgggagagatggagcaggagttcctgcaagccctccaggccttctactatgaccagaaggccatcatgtccaacgaggagtttcgac

SEQ ID NO: 17062 - DNA, 344 bp, Zea mays
  Clone ID: LIB189-025-Q1-E1-F1
gtgctctgcttcttcggttttcaggagcgtcggccattgctgctggaaaagcagaccattgggactccctcgtgcgttttccaaatcagtcaggttgatggcgatggagggaccagttttatgccgccctgcaatgcaagccaaatcgcctgctgctgcgctggtcaacaactccctgaccagattcgggcagcttgggaccatttcaaaatacaggaacgtttcaagattcatttctcccatctctcagccatctacgaagaacataggtccatgctgtagcttcagctcgtcttctgatggcaatggatacatggctggaaactttagcgacagtgatgaag

SEQ ID NO: 17063 - DNA, 99 bp, Zea mays
  Clone ID: LIB189-025-Q1-E1-F11
agggccaagctcccggaatgataacaggcacctggctagtaccagaaacctttgaatgacatacattcacatctaatgtggacacatacatcaaaggat

SEQ ID NO: 17064 - DNA, 147 bp, Zea mays
  unsure at all n locations
  Clone ID: LIB189-025-Q1-E1-F12
agcggacgcgtgggcgctggaagcccgggtctggggttgggttggggaaagcccttttaaaactgtgttggtcaacttgcaattttaacctttccaatcgccgtttattgtgagttggtcctatannaaanaannanannnnnanaa

SEQ ID NO: 17065 - DNA, 345 bp, Zea mays
  Clone ID: LIB189-025-Q1-E1-F2
acggtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccacggccacggcaagacggccaaggtgatgcacctgctgctctggggacccaagtgaagcggcgagaggccaccgttacgccgggctctcccgctggcgttgctcgttttgctctgcct

SEQ ID NO: 17066 - DNA, 304 bp, Zea mays
  Clone ID: LIB189-025-Q1-E1-F3
ggtactagttaaaccattttacacactccgctctactcccggaagagacgatggcggaggcgacgccgacgatggtgttcgtctacggcaccctaaagcgcgggttccctaaccactcgctcctcgtggcctccgccacccccttcgtgggagccgcatccacggccgagccagcctccctcatcatcggcccctactcggtacccttcctcctccccactcccgcctccgcctcctccggtcgcgtcgtctcgggcgagctctacgccccatcccccgccgcgctcgccgagctcgacgccct

SEQ ID NO: 17067 - DNA, 413 bp, Zea mays
  Clone ID: LIB189-025-Q1-E1-E12
agcccaagcgtcggcggacccgtggggccggcggccacgggcacggcaaggaggcccccgtgcttctgcagcagcccgccgccgccgccgccccggcgcccgtggaggtcctgaagctgcgcgtgtcggaggtgggcgaccgcgtgctggtggtgaacgtgacgtgcagcaagggccgcgacgccatggcccgcgtgtgccgcgccgtcgaggagctccggctccgcgtcatcaccgccagcgtcacctccgtcgccggctgcctcatgcacaccatcttcgtcgaggtggattcggaccagacgaatcgtatccagatcaagcacatgatcgaggccgctctcgcccagctagatgatgcctccgcgagcccgccgagcgtgatgaactactattagaatcggacaaccgtc

SEQ ID NO: 17068 - DNA, 362 bp, Zea mays
  Clone ID: LIB189-025-Q1-E1-D1
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgccgg

SEQ ID NO: 17069 - DNA, 387 bp, Zea mays
  Clone ID: LIB189-025-Q1-E1-D10
agacctgaagaaactccgaccggccggtgggcggtggcggcacggcaggatctgtgccccaatggcaacgtcaaacacggcgcggatggaggacggcggcggccacctgcggacacatcaagaagtggaatatcatctaccctgtctacctcaaactccaagaagacggtccccgagggcccccgcatccccgctgccaaagcctgccccggaccccacctgcatcgagatcgctgactgctgttcgcacctcaagatccccacgccatcgagttggataaggcgtaccctcgggatttcttccaggtggggagggtcagggtgcagcttaagaaagatgacggctcccccgtcaatcctgctattaaaacgaagaagcagctgatg

SEQ ID NO: 17070 - DNA, 421 bp, Zea mays
  Clone ID: LIB189-025-Q1-E1-D12
gacccacgcgtcagatctattatgtcggtgttttccggtacttcggggtcttgtcaaaacctgtcgtacccctggtgtttggaacctattaaattatgcataaacgggttcaatatcaatttcaatgaggccttctcctcgctgcgcatagcaaactataaggcattcacacggctccacatcaagaaaaacggagaccttgaggtcttcaccctggctgtggacaaggtgccaaaggattggatgctggattcagactgggacatggaacccaagcagccattccagatgagctacaccaggaaattcccaagcaaatggagggctgcgtcgggccttgacccaatcaatgctgtgcgcattgttgaccggtttgtcatcccgccaacgccctcaagtcctacaacaccaggaggctctg

SEQ ID NO: 17071 - DNA, 427 bp, Zea mays
  Clone ID: LIB189-025-Q1-E1-D2
agcccacgcgtccgaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaattattagcgaaggccaacctggctgccatacataggtattgtgtggtgtgtgt

SEQ ID NO: 17072 - DNA, 381 bp, Zea mays
  Clone ID: LIB189-025-Q1-E1-D9
agtggacaacatgatcttcgtaaaatacaccctaatctgtatgtaattcagactacttatcagatacgacgcatgcacacaattactagggatccctccacagcagcacattatttcatattttatgccgatcggttgattcgattggttgtcgaacatggtcctggtcatcatcctttccagtaaaagcaggtcatcactccgactgggtctgtttacactggtgtggacttctccaaaaggttgtgtggtatctcactgattacgagtggcgaaagtatggagaatgcactacgtgcatgctgtaaacgtatacagattgggaagattcttattcatccggaaggtgacaatggacaacagctcatctatcataattta

SEQ ID NO: 17073 - DNA, 130 bp, Zea mays
  Clone ID: LIB189-025-Q1-E1-E10
gtacggtctagaattcacgggctcgagcacgcgtcaggccggactcgccgcccgcgccggagctctgcaacccgccgcagccgcatcaacgttcctccaaagtctctagccggggccaccgccaccgccc

SEQ ID NO: 17074 - DNA, 408 bp, Zea mays
  unsure at all n locations
  Clone ID: LIB189-025-Q1-E1-E11
agtgggaagttgccttttgaagatgcatcagttggtgcggttcttgcagtcattaaaaacgtggaaagcttgagggagcaattggttgctgaaatcaggcgggtgctgaaagctggtggaagagtattggtgcagagccctgcaccctcatccagtcagaagcccaacactgatattgagcgcaagttactgatgggtggatttgctgaagtgcaatcttctgctgcaagctcgcaggatagcgtgcaatctgttacagttaaggcaaagaaggctagctggagcatgggctcttcttttccccttaagaaaacaacaaaagcccttcccaagattcaaattgacgacgactctgatctgattgatgaagacagtctcttgactgangaggacctgaagaaacacaac

SEQ ID NO: 17075 - DNA, 424 bp, Zea mays
  Clone ID: LIB189-025-Q1-E1-B1
cggacgcgtgggccgcgccaaggacatcctcgtcgtcgtctccggcctcctcttcggcttcggctgcggcgccctcaccgccgcgtccatgtacctcgtatggtcgctcctcgcctccacctgcgcctccggatacgacgacgacgtctacagcgacgacgaggaccggctgtccgactccgagagccccaagaaggccggctacgtcatcatccacgacgctgacgagtacggcgccggtaagaactagggctggggatccgtcttcggtctcgccggggggtcagcagaaggattttcgtaataacatttgcatgattgcttggaattgtgcagtatactctatgcacctttttaatcatgtgtgtccccgtccgttgggaaggtaagtcttctgggggaaaggaaatttaggttatatgaa

SEQ ID NO: 17076 - DNA, 415 bp, Zea mays
  Clone ID: LIB189-025-Q1-E1-B10
agggagcagctgctgttcaagggcaacccgggccccaagaagctgctcaagatgaaaaaggggaaaccgttcatcccggatttcaaactggcgttcgagcaattctgcatccaagccggggggcgttccgtgctggacgaactggagaacaacctggcgctcaaggattgggaaatggaaccctcccggatgaagctggaacggttccggaaaaagtccagcagctcgctctggtacgagctggcctacagcgaggccaatgggaggatccggcgccgccaccgggtgtggcagatcgcgttcgggtcagggttcaagtgcaacagcgccgtgtggagggcgctccggtcggtgaacccggcggaggagacgaacccgtggatggacgagatcgacaggtttcccgtggatgttc

SEQ ID NO: 17077 - DNA, 364 bp, Zea mays
  Clone ID: LIB189-025-Q1-E1-B11
aggatcgatcggtcgaggcgggtaggacaggttcaaaaggtacctaccaagggcggaggaaccttcggcccctccggggggaacggaaccccccccgggaaaaatgccaatggtgtaaggggccaacaaaaccaaccaaactttcaagcccctcaattggcaatggaacaacttcttccccccgggcaaccgcaacagtaccgcctcgtcatcgtcaccgcaaagcgcaccgccgcctccgcggtcggactcacgggaccaggcacctcggatgtgctgccgtacgtggaggcggatctcaagcgctccgccctgcgcgtcgtcgaaaaatccaaagcctctgcacacaggcgagcgacgctgt

SEQ ID NO: 17078 - DNA, 398 bp, Zea mays
  unsure at all n locations
  Clone ID: LIB189-025-Q1-E1-B12
agccgcttcccgctccgatcgacctgctccctctccaccaccgaaccccaagggggccagcctcacccgacgaccaaaattccccgagttcaaagaaggcctcaacctcctccacaaagaacggggaatggttcctcaagaacaaaggatctggggcactgtcatgcgcaccctggggcaaaatcctacagaagctgagctcaaggacatgatcaaagatgtcgatgctaatggcaacggcaccatcgatttcccagagtttctcaaccttatggctcgcaagatgaacgacaccgactctgangaagagctcaacgaggccttccgtgtgtttgacaaggaccagaacggcttcatctcggacgccgagctccgccatgtcatgacaaatcttggtg

SEQ ID NO: 17079 - DNA, 358 bp, Zea mays
  unsure at all n locations
  Clone ID: LIB189-025-Q1-E1-B2
agcttcgtcatacagaagtttatctcctttaagagatcctgatatccttggaagaaacttgccaggaccaacatcccctattccttcgacatcaagtcgcaggatcgcagcattgaacacatccaatgttcggatgaacatgtcgctgcctgtctctccctgctctagcccgctacggcagtacaggcagtccaaccgaagttgcttgcgctcccctcnccacccagcctattcagctggagcagccaactacaatcctatcaacaatgcactctacccaacgcgaccaagcagcggtctcacagatccatggctcgaaatctctcaggtgaaaacgcaaacttttgattctccaaga

SEQ ID NO: 17080 - DNA, 364 bp, Zea mays
  Clone ID: LIB189-025-Q1-E1-B3
aggacgcagattatgtttgaaaccttcgaatgcccagcaatgtatgttgctatccaggctgttctttcgttgtacgctaatgggcgaacaactggtattgtgatggattccggtgatggtgttagccacacggttccaatctatgaaggatacacacttcctcatgctattctccgtttggatcttgccgggcgtgacctcaccgaccacctaatgaagatcctcacagagagagggtactccctcactacgagcgctgagcgggagattgtcagggacataaaggagaagcttgcctacgttgcccttgattatgaacaggagctggagactgccaggagcagctcctctgtcgagaagagct

SEQ ID NO: 17081 - DNA, 433 bp, Zea mays
  unsure at all n locations
  Clone ID: LIB189-025-Q1-E1-B4
aggcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccagggactcgccanccagaagaaagtcccttcatcagcgacgacctcgagattgagtgcgag

SEQ ID NO: 17082 - DNA, 402 bp, Zea mays
  Clone ID: LIB189-025-Q1-E1-B9
agtataaggtgaagctccaaagtcgttcctaaggggatgcagagcttaaagactccaatgacgtccctaaggggatgcagagtcttgtttgttccagtgtgggcgtgtgtgtgtgtgtgttcggcgtcaccatcatattgtatcatatcatcgcatcattccacataacattatgtaacaccctaaagttcactcttgtgaaaatgaggaaaattctccaatcaaacacctttccttgagaatattcataatttcaaagttgctactccaaaaattaacataattttgttttaaactaaaataaaagatacctaaataaactaaattacccttagagtgaaattataagaattatgattaaactatttcttaatatataatctacaatataaattatattcc

SEQ ID NO: 17083 - DNA, 107 bp, Zea mays
  Clone ID: LIB189-025-Q1-E1-C1
acgcgtcagtgaacgattccatctagatgttgatggcgtggctcacaaaaatggtaagttttgcttcatacatctcttactatttggaatctcaacaaatcccctct

SEQ ID NO: 17084 - DNA, 379 bp, Zea mays
  Clone ID: LIB189-025-Q1-E1-C10
aggttcgataataataaaaggccgggaacccaaccggcaaaaaacccttcaatccttggaaattaaaaaaaaacacaaattataaaacaaaaaaacaaacaagaaaaaggcatttggaaatgggctaatgaaggatggcatttactataataatatcgaagttgagattattagcatttactaataagactgcatttttttcattactgaacttgatatatacatgacttttcctctatctgaagctcgacgtaatctgctcgaccaacggagcagaagcatgggttcagaagctcaagtaagtttttttttgcgacctattcccttccctccccttctctggcaggatttcaacgatgcatctggattgctcgttttc

SEQ ID NO: 17085 - DNA, 405 bp, Zea mays
  Clone ID: LIB189-025-Q1-E1-C11
agcaacctttccggtttccaaccacatttaaaattggtaaaaaggcaatccccactcttgaagggaatgggtacataataaattcaaaaatttcctttggcaaagttgcaacaacaaatgcccaagaactgttagacttgaaacaaagaccaaaaactgggcctcaattgggccaagaaataaagaagcaagcaaatgaagctcgtgattctacaatatcaatgccgtacagaatacagagaattgaagattttgtaggacaacttgagacaggagatctgaaacttaaggtcagagtactggagtcagaacgtgctgcacgtaaagctactgttcttcagatggccaccatgtatacagccttgggtggtactctcttgaatgttggggtcacactgaatagtc

SEQ ID NO: 17086 - DNA, 385 bp, Zea mays
  Clone ID: LIB189-025-Q1-E1-C12
agcggacccttgggggcaacccacaggattggcaaaacaaaggaaacctcaattgcgaactcccaatttggccgtccaacggcccaatccaaaacggaacccctttgccgtcctaacccccggccaaattacaacaactggcccaggttcaaggaggacctcgttaatcccccggtccaccccggaccaaatttcagggcaccagtggacccctactaaaaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgttttttt

SEQ ID NO: 17087 - DNA, 366 bp, Zea mays
  Clone ID: LIB189-025-Q1-E1-C5
cccggctcgacccacacgtacgatgaattatagacaattctattagctttctaaaaagtctaggatcgcctgatttggatttctgaaactccagttatggatttttgaagtaagtagtcgaattctgtccaaatctggacataattaaagtttagcactgtttgaccttttaaactgtcgaatctcattatgatgataataccaaagttgtagaggactttataagctttccaaaaagtcttagtttactatttttggatgcatattttgtgagttatgaataaaacaattgactactgtgctgctgtccagaaaatctgcacacgttaaactgattacttagaatcattcttgcttggctagata

SEQ ID NO: 17088 - DNA, 410 bp, Zea mays
  Clone ID: LIB189-025-Q1-E1-A9
gaggtatgctacctaccaaaaccctcacggatccctggcatttcgatcgcctcactctgtaccccggacgagttgcagttggatctcagatcggtgatcacataaacaatggtgaaagctgttgctgtgcttggtagcagcgaaggtgtcaagggcaccatcttcttcacccaagagggagatggccctaccactgtcactggaagtgtctctggcctcaagcctggcctccatgggttccatgtgcatgcacttggtgacaccaccaatggctgcatgtcaactggaccacactacaatcctgcgagcaaggaacatggagcaccagaagatgagaaccgccatgccggtgatcttggaaatgtgacagctggagcagacggtgttgcaaacattaatgttaccgacag

SEQ ID NO: 17089 - DNA, 437 bp, Zea mays
  unsure at all n locations
  Clone ID: LIB189-024-Q1-E1-H3
aggccccagctcaccaagtcgaactccaacctctcgaaacaggcgctcaatggcctcctctcggacaagaaggacgtggttagctcgaaggcaaaatcaaccagcgctaggtcgacgccgtcttccccgaccagcgcccattctctgcctgcgtcgttcgataaattctcgagtgacatgaaacagagagtgagaaccaaaggagcagagaaatcgccgccgtcaagggtgtcccttgcaaaaaaaggctgcgtctgtgttgaaaggcactacggcaggggaagaagtcctccctgggtaattccattagtaacaccttgttgagcttcgaatctgggcccaaggccttgagaagaagctgggaagggaaagcagatgcgaaggacanaggcaattcggattcaaagcctgccaaagctgaaaagaagtctgaaaat

SEQ ID NO: 17090 - DNA, 448 bp, Zea mays
  unsure at all n locations
  Clone ID: LIB189-024-Q1-E1-H4
acgcgtcagcggaagcgtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccanggcccagtcccgtggcggtggcggtggccgcggtggctacggcggcggtcgcggcggcggcggcggttatggtggcgggcgccgtgacggcggttatggccgcggtggc

SEQ ID NO: 17091 - DNA, 330 bp, Zea mays
  Clone ID: LIB189-024-Q1-E1-H5
agccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagattcagagcaaaacgtacatgg

SEQ ID NO: 17092 - DNA, 307 bp, Zea mays
  Clone ID: LIB189-024-Q1-E1-H6
agcccacgcgtccgcccacgcgtccgcccacgcgtccggccgccactaggctaggagtggaagcctcgggcccgcggcagtagccatggcggcgttcctggcgcctccctgcacttccttctatcgctcgtccgcattccttaccccctgttcctcgaatcgccggagtacagtgctaagggcggcggccgttcgtgggtcagcggtgacgccggcccagcggacggtctccgctaggtgggtcccacccaggtcagcggtggcgacgccggcggccaggaaagcgtgcctagacgagcctgatacc

SEQ ID NO: 17093 - DNA, 303 bp, Zea mays
  Clone ID: LIB189-024-Q1-E1-H8
gtcagcgcacgcgtcggcaaaaagcacgctttggatttgcatgacaaatcaagcttcagatgtacactccccaatgttggggacctttcacagcacagacggtaattaaccgaatttcatgtcgcactgttcacgtcattgctctacctcacgatggcctactgcactcatcgcgttaaactgagatgcgtcagcttggcaaaggtgtacttcgcacggacttcagggagctcatgtgttaaatgcttatgcaaggtaccatgatcaggctgcccagcaaggcacaattgttagagtttcatg

SEQ ID NO: 17094 - DNA, 393 bp, Zea mays
  Clone ID: LIB189-024-Q1-E1-H9
agcggacgcgtgggcgaaaagcaggctttgggtttggggacaaaatcagggttcagattaccctcgtctattttggggagctttcacaccaaacacggtgattaagcaagtttcttgtggagctgttcatgtcatggctctatccgaggatggtctactgcaagcatggggctacaatgagtatggtcagcttggcagaggtcgcacttctcaaggacttcagggagctcgtgtgttaaatgcttatgcaaggttccttgatgacgcccccgagcaagtgaagattgttagagtgtcatgtggagagtaccatacagcagctatatctgaaaatggggaggtgtatacttggggactgggaagcatggggcagcttgggcattgctccctcca

SEQ ID NO: 17095 - DNA, 410 bp, Zea mays
  Clone ID: LIB189-025-Q1-E1-A10
agcatcagcagcttctgcttgctctggggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgaaggggtgctggacaacctgggtcgtctgagccagcagcacgggctgtcaagcaaaggcgccaacgaggtgc

SEQ ID NO: 17096 - DNA, 350 bp, Zea mays
  Clone ID: LIB189-025-Q1-E1-A2
gacccacgcgtaagctcatccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaaggtccgttcccgtcccagatccgtccatggcttcgtccagatctgacctgtcctgacacaccctcacccggatctgtccctccttcccctctcccctgcagatcatcctcgatcgggagacgcagaggtctcgcggcttcggcttcgtca

SEQ ID NO: 17097 - DNA, 432 bp, Zea mays
  unsure at all n locations
  Clone ID: LIB189-025-Q1-E1-A4
agtggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagggggaactctgctggtcttgatgaggatcttcacgtgagatangaacgtgtgtacagttgtccccttatggtattgagttgaggaaacttggaagttccattacttgtctgtagtctccactttatatagatgcgataagcttgagatacacattgcctacaatgtcttttgatgaatangaccagacagcaccgaacccgaactccgtcctccacacgggttgctttgccatctcggtggttttgtggtggtggtg

SEQ ID NO: 17098 - DNA, 146 bp, Zea mays
  Clone ID: LIB189-025-Q1-E1-A8
cgacccacacgtcagcccacgcgtcagccaactcattatcctacattttctgggtataatttctgtatcatgactgatcggttcatggtgtcaatgccatttgttctggatacactcagtggatgcttaaagctggttcatttgtt

SEQ ID NO: 17099 - DNA, 372 bp, Zea mays
  Clone ID: LIB189-024-Q1-E1-F8
ccaagttgcgatcgggggaccgggtggaaaccctttcttggggcaacagatgtcaagccagaaggactactctatggcaacagcggatgttgtggacgccgacgtgagggaactcgtggtgaaggcctactctagagcaaggcagataatcaccacgcacatcgacatcctccacaagctcgcctagctcctgatcgacaaggagaccgtggacggggaggagttcatgagcttgttcattgacggccatgccgagctgtttgtcgcttgagatgtcacaaggcttgcggtgcgtatgcttatcggtgtattgtgtcagagcgagcaatcacaaagcaatggagagcccagcttgtaggaaccacatcgatg

SEQ ID NO: 17100 - DNA, 380 bp, Zea mays
  Clone ID: LIB189-024-Q1-E1-F9
cggacgcgtgggcgagtcaccaccgacccaagcaaaaccgcacgcaccctgccagcggcccccccaactcccaacccaacccctactccagctagctcgcggcggcggccaacggccatggcgttccggctgagcaacaacctgatcggggtcctcaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcatgctgccgcgtcacctggctgctctgggcctacctcctcgccatgttcgtcctcatcctcgtcct

SEQ ID NO: 17101 - DNA, 425 bp, Zea mays
  Clone ID: LIB189-024-Q1-E1-G1
cccacgcgtccgctcataaacaatgcagggatcatggcctgcccttaccagctgtccaaggatggaattgagctgcaattcgcaacgaatcatgttggccatttcttgctgacaagtctcctgctagacaagatgaaatcaactgctgcagagacaggtgtgcagggaaggatcataaacgtatcatcggtcgcgcataaaagaagtgatggtacatgctttgagctgaacaagctaaacgataaggctaggtaccaaccgttcattgcatacgcgcattcgaagttagccaatgttctccacacaaatgagttatccaggcgttttcaggaagaaggatgcaatctgacagcgaattcactgcatcctggagtgatcgtcacaaataacaatcgccaggttgctggaaacagtgcgctgatttc

SEQ ID NO: 17102 - DNA, 379 bp, Zea mays
  Clone ID: LIB189-024-Q1-E1-G10
cggacgcgtgggtaatattctgcagtagtttctcgagctcctgtagcaagaaagaaaccatgtcgggggtatgggtgttcgaggacgggatcgtgcggcgtgcggacagcgacccgcccagcggcgccggcgccggcgggtcccggccgaacaaggtgctggtgcacgttcccagcggggaggtggtgacgtcgtatgacgtgctggagcggcggctacgcgagctcggctgggagcgctacctctacgacccctgtctgctccagttccaccagcgctccaccgtgcacctcatcaccgtaccccgtgacttctcccgcctcaagctggtccacatgtacgacgtcgtcgtcaagacccgaaacgtcttcgaggtccg

SEQ ID NO: 17103 - DNA, 395 bp, Zea mays
  unsure at all n locations
  Clone ID: LIB189-024-Q1-E1-G11
cccacgcgtccggtggcgtataggagcaaagttggtctctgatctttcccctgcaagggaaagagaagaacagagacctctgcccctctcgtcactctctctctctctcacaccaccagtgtagtatagggtttcggcttgcctgtgcgtgttactgtcgcaatggcaggaggtctcttctccatggagcacccatgggcctctgtttttggcattctaggcaacatcatctcatttctggtgttcctcgcaccagtgccgacgttcctccgcgtgtaccggaagaagtcgacggaggggttcagctcggtgccgtacgtggtggctctgttcagctgcacgctgtggatcctgtacgcgctggtgaagnacaactccagcccgctgctgaccat

SEQ ID NO: 17104 - DNA, 154 bp, Zea mays
  Clone ID: LIB189-024-Q1-E1-G12
gttcttggtgtaataaccccaagaacagcactgcgctctcatgcaccgctcgcatacaggcgagtccactccttggctgtttcaacagcttccacctcattggatttccaatgctttgcaatgttatcgggtacagggtcatccggatttggtg

SEQ ID NO: 17105 - DNA, 352 bp, Zea mays
  Clone ID: LIB189-024-Q1-E1-G3
caggcgacggcgagatgtgctcgagctcgcttattagcgcagagctgaagaaggtccagactgccaccattaatttcgacaactccctcagccccgcgcacacgctggtccagatcatatgcgccgaccagaaggggctcatctacgacatactgaggacgatgaaggactgcaacatccagatattttacgggcggttcagatcggacaagaaagggcggccaggcagcaaaggctgccgagaggttgacctgttcgtgaaacaagtggacggcaaaaaggttacggatcctgagaagcacgacgctctgcgggcgcgcctgagattcgagatgctccacccgctcagggt

SEQ ID NO: 17106 - DNA, 354 bp, Zea mays
  Clone ID: LIB189-024-Q1-E1-G5
ggagtcttcgacgacgtcaatagcatgatgcagcaacaacagcagcaggcaccacccgtggtgcagcagcagcagcagcagcagttcttcatccgcgacgacacgccattcatgagccagatgggcgacatcaccagcacggcggagttcaggttcggctctggtttcaacatgtctagcaccgccgccgctgattacccaggcgcggcgcagaagaacgacggggccaattggttctactgaagaataaaacttgtagggctcctcgttataagcttcggattcctccatggctctcccaagttgtcaagtcttataggtcttcgttatataggttttgcagtagctgcaaga

SEQ ID NO: 17107 - DNA, 429 bp, Zea mays
  Clone ID: LIB189-024-Q1-E1-G6
agcccacgcgtccgcccacgcgtccgcccacgcgtccgcaggaaccgagtctatgggttcctctcgttttcttccgcccaagagcttgaggaagcgttaaagctcgacagaacggtcttcttcggacgggatatcgtagtgaaggaagcccatgtagagcgccagacgcgctgagccgctgagtgttacccttgagaactgcactttttttgtctgcctcgttgactgactaagctcatgctccaggcacaagctacacagctgacgaagaagcaattgagcggttcatcgcgaaagagttaaaaaaaaaaacggtagtgtaaattagtaccattgctgcaactttgtcagcgccgccgtggatgctggtgtgagaaattctaggacgaactgagaactggtattgtagtggtaatacatgttgtttta

SEQ ID NO: 17108 - DNA, 412 bp, Zea mays
  Clone ID: LIB189-024-Q1-E1-G7
ccgccccgcgcccgaggacgacgacagggaggagggcgagatcaccgacatcgcctgcgctccttccccgcccgccacgcacccgctcgagcactcctggaccttctggttcgacaacccgcagagcaagtccaagcaggccgcctgggggagctccatccgcccaatacacaccttctccatcgtcgaggaattctgggggctttacaagaacattaatcaccctagcaaattgatcgtgggagctgatttccattgcttcaagaacaagatcgagccacaatgggaagaccctatttgtgcgaatggtggtaaatggaacatcagctgtggaagaggaaaatctgatacgttctggctgcacactctgctggctatgattggtgaacaattccactagggtgatgaaatt

SEQ ID NO: 17109 - DNA, 373 bp, Zea mays
  Clone ID: LIB189-024-Q1-E1-G9
agtagagacaaccgctgcgtaaacgaatccatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaggcggcatcaccacaggcataggtggcggagatggagttatacccgtatctgtggcctggcaacaatgttaaataaa

SEQ ID NO: 17110 - DNA, 374 bp, Zea mays
  unsure at all n locations
  Clone ID: LIB189-024-Q1-E1-H10
gttcattgtgaagctgaggtgagtatataggcataaagagagcatgaacactgttagtggtacaaagcgtgcaccaaggagacagtcgcaagatgggtctggtgataaactagtggtgatcgtggaagcaagctcccggggggtggggagccgtcgtggaccacatgcccctattcctggcgccctaaactcacccattgatgtggaggccatcgaagatgaagttcaggcagtatctccttcgcgagtgcccctgccatgtattctgcanaggaggaacaggagaaccaggagggaacctataacagtggttgacttggaggttgaagctagccgggaagggagcaaaacccagagggttgaaccattaggac

SEQ ID NO: 17111 - DNA, 370 bp, Zea mays
  Clone ID: LIB189-024-Q1-E1-F5
aggggagaagatgacccagattatgttcgagactttcaatgttcctgccatgtacgttgcaattcaagcagtgctgtcactctatgccagtggacgtactactggtattgttctcgactctggtgatggtgtgagtcacactgtgcccatttatgaaggatatgcccttccccatgccattcttcgtctggatcttgctggtcgggacctcacagactccctcatgaaaattctcactgagaggggttattccttcacaacctctgccgagcgagaaattgtgagggacatcaaggagaagcttgcatatatagctcttgactatgagcaagagttggagactgccaagaacagctcctcagttgagaag

SEQ ID NO: 17112 - DNA, 433 bp, Zea mays
  Clone ID: LIB189-024-Q1-E1-D7
cggacgcgtgggcggacgcgtgggttctcctccaccgtcggagctccggcctccaccccgaccaggagcagcttcctcgggaagaagctcaacaagccgcaggtgtccgcggccgtgacctagcatggcaagagctccagcagcaacagcaggttcaaggcgatggctgccaaggaggtggacgagacgaagcagaccgacgaggacaggtggaatggcctggcctacgacatctcggacgaccagcaggacatcaccaggggcaagggcctcgtcgacaacctcttccaggcgcctatgggggacggcacccacgtcgccgtgctcagctcctacgactacatcagccactgccaaaagttctacagactccaccaacattatggatgggcttcaacatagccaagggcttcatggacaagctcgtcgtcca

SEQ ID NO: 17113 - DNA, 369 bp, Zea mays
  unsure at all n locations
  Clone ID: LIB189-024-Q1-E1-D8
ctccctccgccactcccatccatctcctcgctcccagtcccccggaagctacgaagcatggcgtccgtcaccgcccgcgccccggtcgcggcccttcgcccgtcgtcggccttccttggccactctagccgcctcggccgcaccgcgtcgcccacgaggcgcagcctcaaggcggaggccaagggcgagtggctccccggccttccctcnccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctg

SEQ ID NO: 17114 - DNA, 402 bp, Zea mays
  Clone ID: LIB189-024-Q1-E1-D9
aaaaacactcaagggatctttgtttagaggatggagacctaaatctgaccgaccttcattggtggataaatatgcagaaaaagaggagaccttcacctaaaaaacaaagatatatgttgaaatggttctttttaaaagattgcaacgtgatccgggtgtcagagattcagaaggtcttggacatcgccgacgagcgtagcctcattgacaccatcttcttctgctacctcgggtgcaatgcaagctaaggtggtcgacaatggtgttcgcggcggcgaactcgcagcgcagccaggtgatgaagccatcgcgctcgtcgacgagccaggcgacgggctcggccacggcggtgccgggggccggcgaggcgatgacggcggcggtggaggccatcgccgtgcg

SEQ ID NO: 17115 - DNA, 391 bp, Zea mays
  Clone ID: LIB189-024-Q1-E1-E10
agcccacgcgtccgcccacgcgtccgctgatcatcttgtactaggaaaaaatactgattattcagaattacagaattacgcctccttatattttactgagatctccgagctactgaggagattaccaagggttatattgttgatgcttaaaacaaatgactgtttacgtgcagtcagtcatgccctggttgggggcagttccttggagtcgtttatgattattggacgggtatcttctgaagctgtgctggatgctaaaaggatgaacaggaggtcctttctcgatggattgaagatatggctggaggaagccctgctggaagctcgattctttactttgaagctgatgctaagtgttatgcaacttaagaagttgttgcctggctaaaag

SEQ ID NO: 17116 - DNA, 425 bp, Zea mays
  Clone ID: LIB189-024-Q1-E1-E2
agctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtggggggacaagcacggcgcgtctctgccggccaacttcaaagaagatgctttccatccagctccgtgggtccgcagccaagggcaagctcgtgaaggtcaaggcttcgtacaggctctcggacgccgccaagaaggatcccccaagacc

SEQ ID NO: 17117 - DNA, 146 bp, Zea mays
  Clone ID: LIB189-024-Q1-E1-E4
gcgtcaaacgtattgcaggcctagacgttgaatcggataccggagcccaccgtccaggttccgccccaccggccgctgtctaccgatttcgccgacgacaacaagcccgccggattggccaagctgacccccgcgagcgagtatcc

SEQ ID NO: 17118 - DNA, 248 bp, Zea mays
  Clone ID: LIB189-024-Q1-E1-E6
tggaattaataggaactgcttacacaatttggttcatcgcacggtatctccttttcaaggaaagcagagatgacctgtttgcaaagttcgaagatctcaaacagaggattatttgatctatcgtcgaccttttgccacgtgtttaggctttacagccagcttattattaggtttttttccccctttcgtttgaatattactggatggggtaagaaggtcatgtatctaaattgtctcctcagggcttg

SEQ ID NO: 17119 - DNA, 353 bp, Zea mays
  Clone ID: LIB189-024-Q1-E1-E7
ggggctctatccagttacttctgaaaggtgtcagtgagagaggggcgaaaaaaatccgtgtgcacatccttactgatggacgtgatgttttggatggaagcagtattggtttcgtggagaccctagagaatgatcttttggagcttagagcgaagggtgttgatgcacaaattgcatctggtggtggaaggatgtatgttacgatggaccgttatgagaatgactgggatgtggttaaacgtggttgggatgcccaagtgcttggagaagcaccctacaaattcaaaagtgcacttgaggctgtgaaaacactgagagcacagcccaaagccaatgatcagtacttgccccca

SEQ ID NO: 17120 - DNA, 392 bp, Zea mays
  Clone ID: LIB189-024-Q1-E1-E9
aggtgggcgcgtccaagaagtacgagggcagctccaacctggtggacctccgctaccacatgggccccgtcctctccgccgcgccgctccgcctctacgtgctctggtacggccgatgggaccccgcgcaccaggtccccgtccgcgacttcctcctctccctctccgacacgtccctgccgcgcccctccgtcgccgactggtgggccaccgccgcgctctacgccgaccagaccctcgccaacgtcacctgccgcgtcgacctggccggggaagccgccgacgagtcggcctcgctgggccgctcgctctcccggctcgacatccagcgcgtgctcgcctctgcggtcgccgcgggccggctccctgccgacacccgcggcggggcctac

SEQ ID NO: 17121 - DNA, 234 bp, Zea mays
  Clone ID: LIB189-024-Q1-E1-F12
ggaatgcccgctcgacccacgcatcaggttcttggtgtaataaccccaagaacagcactgcgcacccgcgcttggttgacattcatcacattgaaattcatggcagtgggcagaaattaaattgcatcagaatcccagaggactgtcgcattgctttgtattgattaaacagtcggtttcccattgtctgtaacagttctgactcggttgttcgtccccggggaaggcccccga

SEQ ID NO: 17122 - DNA, 213 bp, Zea mays
  Clone ID: LIB189-024-Q1-E1-F2
agggagtcaacggaactgttgcccatgaattcatcattgatctaagggcatttaaggcgactgctggtatagagccggaggatgtggcaaagcgcttgatggactacgggttccacgcaccgaccatgtcatggcctgttcctggcacacttatgattgaaccacctgaaagtgagagcaaggccgagctggacaggttctgcgacgctctta

SEQ ID NO: 17123 - DNA, 383 bp, Zea mays
  Clone ID: LIB189-024-Q1-E1-F3
gactagttctaagcatttccttatgctgcatatttagtgtaactcagtgccttcattggcatatgttatccacatcatcatttcaaggtccactactctgttccctgtgctggtttagatttgtagagcacataagtcaactgtcatatgcagcagtcacgttcaataagctgttagctgtagcaggttggttcctggaccagctagtatttgcgaaaccaatgccctttgcactctgccagaaaaacggtgaaattctatatccatattctaattttactgaaaacctggtgtgccatcattgctcataaccttgtttgtcagttgtcacagtattggttcacagaaaatgtttgcaataactatttgtttgtatttttgtg

SEQ ID NO: 17124 - DNA, 437 bp, Zea mays
  Clone ID: LIB189-024-Q1-E1-F4
ctccacattaggatgtatatattaatcatcctattttaatatatattaatcatcctattttaattaggttctaatccaattagtagtaagtattttcttttttatttaatagtctctgactatcattaaataaagggtagagcaattcttttttctagagattctagagaaagtgagacaaagtgaagcgaaagagttttctttgtataagaattaggtctatatcatatctaaatagaagggaaatcagaaagaagggaagtggggattacattggatgaatccttaaggaagacatatcacactagaaataaaggctaaagtatgcgctccttgcctttggtttgagcaaaacagattcttgtttcaccgaggaaaagagagaagttctggataaattgacaatgtcaacttgaattgactaattcagttccgcc

SEQ ID NO: 17125 - DNA, 335 bp, Zea mays
  Clone ID: LIB189-024-Q1-E1-D6
agcccacgcgtccggttctttactcaagcgttcattttatatgaagaagaaatcacggattcaaaggctcagatcactgcaattcacctgataattgggacccttcagcggatgaatatatttggggtggaaaatagagacaccctcactcacaagacaacagggtactcagcaaaacttctcaagaagcctgatcaatgccgagcagtctatgcgtgttcacatcttttttggactgatgagcaagatggtataatggatggtgaaagggttctcctttgtttgaagcgtgccttgagaatcgcacatgctgctcaacagatggctagcgctac

SEQ ID NO: 17126 - DNA, 365 bp, Zea mays
  Clone ID: LIB189-024-Q1-E1-C10
agacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcg

SEQ ID NO: 17127 - DNA, 408 bp, Zea mays
  Clone ID: LIB189-024-Q1-E1-C11
gagaaagctcaccctgatattttcaacatccttctccaaatatttgaggatggacatttgacagactcacagggtcgcagggtttccttcaaaaatacgttgattgtcatgacttcgaatgttggttcaacatcaatttcaaaaggaagacagagcataggtttcttgaaggaagataccgagtcaggctcatacttcgcaatgaaatccttagtgatggaagagctcaaggcatttttccgtccagagttgctcaatagaatcgacgagatggttgtgttccgtcctctggagaagactcagatgctggccattcttgatatcatcctaaaggaagtcaagggccgacttttggccctcgggataggtttggaggtgtctgatgcaatgaaggacctgatatgccaa

SEQ ID NO: 17128 - DNA, 129 bp, Zea mays
  Clone ID: LIB189-024-Q1-E1-C2
acgcgtcaacctaaacgtccggatccgccgtgactcacatgacttcctccatagtctcccaagtcatgcactctcagtgaccactatgttaaacctatctcggtcatccccaccgggatgcagttcctc

SEQ ID NO: 17129 - DNA, 433 bp, Zea mays
  Clone ID: LIB189-024-Q1-E1-C3
agtgatttgcagaaaagagtagagattaagacccctgatctcatagaaaggatgagagtaacatgtcgaattgcaagagaggttttagatgcagctgctcgtgtaattaaaccaggaattacaacagatgaaattgatagagtcgtccatgaagagacaattgctagaggtggatacccatctccattgaattactatttcttccccaagtcatgttgcacgtctgtcaacgaagtcatttgccatggaattccagatgccaggaaacttgaggatggtgacattgtaaatgttgatgtaactgtatactataaaggtgttcatggtgatttgaatgagacatattttgttggaaatgttgatgaagcttccaaacaccttgtacgttggtcctatgagtgcttggagaaagctattgcgatagttaaacctg

SEQ ID NO: 17130 - DNA, 209 bp, Zea mays
  Clone ID: LIB189-024-Q1-E1-C4
agtagagattaagacccctgatgtcatataaaggatgagagtaacatgtcgaattgcacgagaggttttagatgcagctgctcgtgtagggaaccaggaattacaacagatgaaattgagagagtcgtccatgaagagacaattgctagaggtggatacccatcgccattgaattaccacttcttccccaggtcacgttgcacgtctgt

SEQ ID NO: 17131 - DNA, 384 bp, Zea mays
  Clone ID: LIB189-024-Q1-E1-C5
agcccacgcgtccgcggacgcgtgggtgaaatctcaaatggaagttaggcccagggaatcttgcagcttggtgtgcaaagtaagaggacagtcctgtgttccaagcaggctctctgtgttgaacaaatgtgagattttgcagaaatatatgagatgcaagagtggctgctttcccagccttggaccagatcaacctgctgaagttgttgacgaagctccaaccagcttgaatccaggagcatgcttatacatgcagatggatgagcggctcacatgtgatggtttcgcacatcatacccgggcggctctgtccatgcgcctgagaaggggaaatgaatgtgacactcataagacagcagaggggtagttttctctgaaaaactt

SEQ ID NO: 17132 - DNA, 296 bp, Zea mays
  Clone ID: LIB189-024-Q1-E1-C7
agggccaagcgcaaggaccgcctcgtggagcgcgccccctacgcccgcccgtccccatccgaggaggcggagatggcgaagccggtctcctggctcgggctcggcggcacggacgccgagcgcctcaacatcgcgctgtgatttggatctcggttgctacccacccggatcgaccggtggcgatttgattggctgggttcctggcttcatttgggtcttgctggattggggttggtatggacatcggagattgaggattgtatagatgtactcctggtttttttctctctccctta

SEQ ID NO: 17133 - DNA, 406 bp, Zea mays
  Clone ID: LIB189-024-Q1-E1-C9
atagcaccaacgtgtatgcttacatctcaataatcgctctaattgtttgcattccacctgcattgatctttgaagggcccaagctaatgcagcatggatttagtgatgccattgcaaaagtaggtttgacaaagtttgtcagtgacctattcttggttggactgttctaccatctgtataaccagattgctacaaacaccttggagcgagtggctcctctgacacatgctgtcggcaatgtgttgaaacgtgtttttgtcattggtttctcaatcatcgtttttggcaacaaaattagcacacaaactggaattggcacgtccattgccatagctggtgttgctatgtactcttacattaaggctaagattgaagaggagaaaaggaaaaagagcgcatgactgct

SEQ ID NO: 17134 - DNA, 374 bp, Zea mays
  Clone ID: LIB189-024-Q1-E1-D12
agaggccatccattttgtcaacctgcggacagctggaaggtctagtggaaacctggctatgaactccgtaccgaaaccagcacttgggtccgaaacatcttggagggaggattttgctgtgggggataaggatgctgtggtcattgttgatcatgggtcaagacgccaagaatccaatctcatgctaaatgactttgttgagatgttccgggcgaagactagctatagtattgttgaggctgctcatatggagctagcggagcctactataaaggatgcttttgggaaaagttttgcaacaaggagcatcacgagttattgtcagtccatatttcctttcccctggacgacactggaagcaagacattcctgct

SEQ ID NO: 17135 - DNA, 414 bp, Zea mays
  Clone ID: LIB189-024-Q1-E1-D3
agcggacgcgtgggcggacgcgtgggcggacgcgtggggcaaagctaagcacagagctagcaagtgaccgaccgagagcaaacaggcaaggcaagatggtgcagcaacagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcagcgcgccaccaggggtggcctgctcatcgcggaggccacgggggtgtcggccaccgcgcaagggttcccggagtcccctggcaatcgggacgcacgagcaggtcgaggcgtggaagcccatcgtcgacgcggtcaccggcaagggggccatcttcgtc

SEQ ID NO: 17136 - DNA, 434 bp, Zea mays
  Clone ID: LIB189-024-Q1-E1-D4
cccacgcgtccgctgttttgcttttgtgttgctgttaggttcttggatagtttgatgaatgatactgtgcagcagcagcagcagtagtaattcatagtgggcggtgtgatagcagcagtgagatcgaggagaggatggaggtgttcatccacgaggactacgtgaacaagcgcaacgagctgaggagggagcagaggcgccgggaactgcagaggctgcaggtggagagcaaccccgacgcgtccagggaggcgctggcaagccgggagagcccgaggacgccggcccagtgcctgacgccgaccggcgcgtcgccgtccagcttcagattcccgacttcgaggagcacgctgcagtcgccggccgcagcggcggggcaggctgccggttggccgtccgagcatcgccgcctctacgactgcctcaagccgtac

SEQ ID NO: 17137 - DNA, 433 bp, Zea mays
  Clone ID: LIB189-024-Q1-E1-D5
gggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaggtcatcctcgtcggcggcgccgagtactaccggatcaccaacggactggacctagaggacaagctgcaccccggtgggcccttcgaccccctgggcctggccagcgaccccgaccaggccgccatcctcaaggtgaaaggagattcataacgggccggctggccatgttccccatgttcgccttcttcatccaggcct

SEQ ID NO: 17138 - DNA, 410 bp, Zea mays
  Clone ID: LIB189-024-Q1-E1-B9
agcgaatctcgggtttccttagtagctgtcaccctgtgaatatgtcgtcggcaggtgtgatcgtcttggggccaattccagaagaccctgccttcctgcccatctgcttcaatggcagccggtcacagcactgctcatctgggtcacaactgcaggattccattcttattttccttgctgtgccgggtatgccacccatgcccatgagcgtgctgggatctgagtccattgcatctgtcaagctgcgcatccagcagttcaaggggctttgtggcgacgaagcaaaggcttgtgctggatgggcatgagctggcaagaaacaactccccagtcaaggattatgggctggccgagggaaatgttctgcatcttgttattcgactgtcagatctccgtgtgattaacattga

SEQ ID NO: 17139 - DNA, 385 bp, Zea mays
  Clone ID: LIB189-024-Q1-E1-A2
cccaatcgtccggtacaagaggattggcacagcacggtttggaaggtgtgcgtgtaagtcatcacgctgggcatgctggtgacgctgctgctgggcctcaacatgtcctggagcgccatcaccgccgccctgtcgctcatcgtgctggacttcaaggacactcgcccctgcctggagaatgtgtcgtacccgctgctgctcttcttctgcagcatgttcatcaccgtggacggcttcaacaagaccgggatccccagcgcgttctgggacttcatggagccgtacgcgcgggttcaaacgcccaacgggaacgccgttctcgcgctcctcatcctcctgctctccaacgtcgcgtccaacgtgccgacggtcctgctcctgggcg

SEQ ID NO: 17140 - DNA, 365 bp, Zea mays
  Clone ID: LIB189-024-Q1-E1-A3
acgcgtccgcccaagcgtccggtgatcagagtctgagcgaatttttaatcaaatcgtcctaaaatgccactttttggattcagcctattcaaaaaagtcgtcccgggagtctcggcccaatcggacgacgacgacgaactgatcgaccctcaggtaactataagggaatcgtgcgcccctcactgtgcctctctcaaagcgaaactcgacgaatgcaacgcccgggtgaactcgaggtccgcgaccaccgaaacttgcaccgaggagcttttcgatttcgttcattgcatcgaccattgcgtctccaaatcgcttttctctaaactcaaatgaaagaaggacgacggaaccacccttttagcgtc

SEQ ID NO: 17141 - DNA, 316 bp, Zea mays
  Clone ID: LIB189-024-Q1-E1-A5
agcccacgcgtccggctgctcatggaccgcgtcgtggccttcattgccggggcctgacttgctctcttgtggccttgtgggcgcgacgcagtatcaggtcgcaattgaagattgaagttgtggacttgtgggcaagtttctctcgctgaatattggtcttgtctaaacaaaaagccttacaaaaagcggaaaaagaagatgttgaagaacagataatccggagaagtatgtgaaaatttatgggctacttagcacagattagaccgctttgtgaaaggagctgccagttttaaccaaaaagggggggcggttcaaa

SEQ ID NO: 17142 - DNA, 426 bp, Zea mays
  Clone ID: LIB189-024-Q1-E1-A6
atccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagatctttgtaaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaggctgccgatgtgcctgcgtcgtctggtgccctctc

SEQ ID NO: 17143 - DNA, 356 bp, Zea mays
  Clone ID: LIB189-024-Q1-E1-A7
aatagaagagagcatctacaaattgaacaggagcagagctgtctgctctactataaaccgtaaatccaaaaacttcaaagatgagcctgttttgacgctgaaggatgtggagtcgctattcccgatggcaggacctgatgaacccctagaacaggcagatcaaaattacggcgatagcttgaggagtttgcctccatctgttgccgctgggttagctgctgaaagaaggcgactaatggagcaataagttaatggagtttgcctccatctgttgccgctgggttagctgctgaaagaaggcgactaatcaagggacctccatccatcgttgtggcagttgtgctaattttacttga

SEQ ID NO: 17144 - DNA, 247 bp, Zea mays
  Clone ID: LIB189-024-Q1-E1-A8
ccgggccgacccaaacgtcagaatagaagagagcatctacaaattgaacaggagcagagctgtctgctctactataaaccgtacatccaaaaacttcaaagatgagcctgttttgacgctgaaggatgtggagtcgctattcccgatggcaggacctgatgaacccctataacaggcagattaaagttaccgcgatagcttgaggactttggccccatctgttgccgctgcgttacctgctgaaaca

SEQ ID NO: 17145 - DNA, 263 bp, Zea mays
  Clone ID: LIB189-024-Q1-E1-A9
agctctgacaaatcctgacctaattgaccagtgcgcaagagaggattttgttgagagagttaaaactcaacaagattaagggtgcaatgtccatggttttttagatgtcagtaaagttgccggacaatttcactttgccccaggcaaatgtttttatgaatccaacatagatgtgcctgagctgtcattacctgaacgtggttccaatattacccacacgataaacaaactgtcctttgggacagaatttcctggtgttgtca

SEQ ID NO: 17146 - DNA, 401 bp, Zea mays
  Clone ID: LIB189-024-Q1-E1-B1
agcataagcctgtgtggatgggagcctaggtggcttccaaatgttcaagactgtgaagaaaattcaacgcattcagctaaaaatttaccctcagctggacctgacgaacggttatatccccattttgttgaacataacaaaaattcattttctgcatcagccaagaaagataaggggaaaggcaaattgcccgttggagattctggatgcagcatgaggtcaccgttgttagattgtaacctgtgtggagctacagtcaggatgcgggactttagacctgtattatgtccttctcgtttcagtccaaataacattgttgtgcctggaacaggcagaaagctaacactgacacatggagttagtgctgccagtggtatcaatgaattggtttaccgatgggg

SEQ ID NO: 17147 - DNA, 322 bp, Zea mays
  Clone ID: LIB189-024-Q1-E1-B10
cgacccacgcagtcaggaatactatataagtgaaataaaaacaagtaaaccatgtaaaaataatcaacagaaaagtgaaatcatcttggggccaaattcaaaaaaaccctgccttcctgcccggtctgcgtcattggcagctggtcacagcactgctcagctgggtcacagctgcaggattccattcttattttcattgctgtgccgggtatgccattcatgcccatgaccgtgctggcatctgagtccattgcatctgtcacgctgcgcatccagcacttcattggctttgtggcgacgaatcacaggcttgtgctgggtt

SEQ ID NO: 17148 - DNA, 341 bp, Zea mays
  Clone ID: LIB189-024-Q1-E1-B11
gtcaaggtcaatgcaccacagaaagaagattcttagtatacaagtgtacggtggtctccattctgccgagtacgaaaccatagtgcaaaatgctccgccaccgccgtcgtgtgagataactgatatttatggcttcaggaggtcgaggcctttatatggatcattcaggggaggcgttggtcagatgaagctatacttcaacattttctcatcattctgtaaaattctgaaaaagagtcatctttctgttcaactgcatctacgttgattgttttttcattgcgaacactctagtaggcgatttatctacggttttttcactatattcattaagatattat

SEQ ID NO: 17149 - DNA, 293 bp, Zea mays
  Clone ID: LIB189-024-Q1-E1-B12
gacccacgaatcagcaggcctgcggtggacacctaggcagccagcgacgaggaagggcgtaccaagcgacaatctgccttggggacttgcgaatgagcctagatcaggagattcccacgtcagtcaagctttcgaatcgcttgcagactccctgattatgtacgacaccattctgctcaattgatagctcttagtaccgcgaggtcacgacatcactctcgacgtccttgttatccggctaccgaaacgggatcagcctaaatcgtgaacactgggttgtgggagagcgatac

SEQ ID NO: 17150 - DNA, 386 bp, Zea mays
  Clone ID: LIB189-024-Q1-E1-B2
cccacgcgtccgcggacgcgtgggagtgctaccaagaacaggaaggaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgccggcgcggcggtccgtggcggcgcgcgcggagctgagcccgtcgctggtgatcagcctgagcacgggcgtgtccctcttcctgggccgcttcgtcttcttcaacttccagcgggagaacctggcgaaccacgtgcccgagcagaacgggaagacgcacttcgacgccggcga

SEQ ID NO: 17151 - DNA, 417 bp, Zea mays
  Clone ID: LIB189-024-Q1-E1-B4
agcggacgcgtgggcgacaactctctaccgtccgagaccccaagcaccagcgcggcggcggcggcggcggcggcggcaaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagagtctcgtatccaggacacagggtaccaggattgcttctgagggtctgaatcacagagtctttgaggtttgcctagctgatcttcaaggcgacgaggattaagcttacaggaaaatcacgctccgtgctgaagatgtgcagggcaggaatgtgctcacaaacttttgggggatgaattttaccactgataaattgagatcc

SEQ ID NO: 17152 - DNA, 427 bp, Zea mays
  Clone ID: LIB189-024-Q1-E1-B5
agcccacgcgtccgcccacgcgtccgcccacgcgtccgcccacgcgtccggaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtccccgggggcggggcatcctgccgatggacgagtcgaacgcgac

SEQ ID NO: 17153 - DNA, 138 bp, Zea mays
  Clone ID: LIB189-024-Q1-E1-B6
cgacccacgcgtcagcccacgcgtccgcggacgcgtgggcggacgcgtggggtgttcttcagtaactcctgtatttggtgtatgaaccgaaagattgcgagggtcactggcatggtacagccggagtgagagtgagtg

SEQ ID NO: 17154 - DNA, 226 bp, Zea mays
  Clone ID: LIB189-024-Q1-E1-B7
cggacgcgtggggaaatgcttggaaacaagcatatatgcaggacctggtgaacaatctcatcaggtaagcttgtattctgcatagactgaaatactgacatatttttccattctgctacttataatgctcatttatgtcctatttagttcgatcccttgattcactcactggttagtctttgaatttactgcctaggcatggaatacctggttttgtaagtttggt

SEQ ID NO: 17155 - DNA, 314 bp, Zea mays
  Clone ID: LIB189-024-Q1-E1-A12
acccacgcgtcaggagtcagtcctataacaccacccggaacctgtgccaggccggcacggtgaaacggataagggaggtgaacttcaaggtgacccgtcagccgccgctgtccagggagttcgccagagaagaacaacgcgcaccggaatgagacaacctgaaaccgccagccactacccaccgggcctggaagacacgcgcatgctcacgatgacgggcatccccgctggcacgcacaacactggccaggccgcttctcttcactcaccttcagaatgcagcgcaataatcagcttccggacggtggcgtttt

SEQ ID NO: 17156 - DNA, 301 bp, Zea mays
  Clone ID: LIB189-023-Q1-E1-G12
ccacgcgtacgctatgcgattcgctcgctcgatcctatcttctcttcacatgaagcgcaacgcccatggccatggccatgcatggctccgccgccacgcgccatctgttggtcgctgcctgggcgccggtggatattcgacggtagcatggcactcatgtcgcactaccgttttcgtaatcacgtgcggttgacgtgcaacttgcctaaaccgatgaggtggtttaagtctcggtgggttcataggatgcttacctgttgctatacaatctgtctctattcttcctacgacattgacgagg

SEQ ID NO: 17157 - DNA, 397 bp, Zea mays
  Clone ID: LIB189-023-Q1-E1-G2
cccacgcgtccgctgctaccagcaccacagcctagcaccccaccgcgtctagggttttctgctccaatggccgccgcgagggcatacggggagcgcaggatctgggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatccccgctgatcccactctccgagttccgggagcccgaggtgatgcagggctacggcgtgcgccccgacgccgaggtgctcgacgcgatcgacacggcagcgcgccagaagcagctgaacgtggtggcgaagctgtactggggcg

SEQ ID NO: 17158 - DNA, 315 bp, Zea mays
  Clone ID: LIB189-023-Q1-E1-G4
cggacgcgtgggcggacgcgtgggcggacgcgtgggttagaggttaatttggactgtttaatatttaaatgttgtgggtggattaaggggttatttagtgttttaagtacaaacagaggaggacaattcatgcacatactttagctttttattgcaatgatagataatttatatgaagtttaggacttattttggatataatatgtcagaatgacagagattcacctgatatgcgagcatgagttctcgctaaaatgtagcattgagtattgactgcagttcagtaagtaaattaaagcatgatagtattgttga

SEQ ID NO: 17159 - DNA, 380 bp, Zea mays
  Clone ID: LIB189-023-Q1-E1-G6
agaagagaaggttgtgaagaataaagcaagctcaaaagcagatgaatctgagctcagattagcacagcttcaacatcagctcccaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttatttataattccagcgtttggagggactgtttcatgggaaggagaaggagctccatttaaagaaatagacgaagatatcactcaccagattgttgataggccgacacaaagccatgttttcctctccagggattatgttcaaccacagtggg

SEQ ID NO: 17160 - DNA, 408 bp, Zea mays
  Clone ID: LIB189-023-Q1-E1-H10
ccacgcgtacgctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggaaaagttgaacaagtacggtcgtcctttaatgggatgttctattaaaccaaaattgggattatccgc

SEQ ID NO: 17161 - DNA, 361 bp, Zea mays
  Clone ID: LIB189-023-Q1-E1-H11
agcgaagagaatgaaatgatgctggaccagatggcggatgcagctgagaccattgcagtgactccagaggagaacgaagctatacttcgtcttgaagggatgggctttgaccgggcactggtcctggaagtgttcttcgcgtgcaacaagaatgagcagctgaccgccaactacctcttggatcacatgcacgagttcgacaacgatgacgggctcggagggccaccgctatgagggcgctctcgatccctacatcatgcgaacgaaggctgtagggcagtagtaagaaaacgttttgggaatcctcccgtccggtcgctcactctacaaattcgtttggctttgctgtttaatacaaaat

SEQ ID NO: 17162 - DNA, 349 bp, Zea mays
  Clone ID: LIB189-023-Q1-E1-H12
ccacgcgtacggaagaagtggaagtccctgaagagaagacaacaccacctttggagtctcaggcagggtctcgtctctactttagcatctgcgggcctgagactaactcatctataaacaaaggtgaggaagcgacaaatttttgttgcttttgctccaaggtggtatcaaatgaagaaaaacaagagtgaagatgcgggaggacgtggtcctccatataggacttttgtttaaagctatcgggaggagtttttgcctcccttgaaatgtgtactacgcaacactcgtttatagctctggtctgtaataagtaacttgatcttaccttctaaataaatgtaactttatg

SEQ ID NO: 17163 - DNA, 411 bp, Zea mays
  Clone ID: LIB189-023-Q1-E1-H3
cccacgcgtccgcccacgcgtccgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggctttaacccgggctctttctcttatggtgacctggttaagagggtgctgaggtgctttggtccaactgagttttctgttgccgtgaccatcttcggtgatcgggacaatgcgaagacctgggggacgaaactggatgctgaggcctatgcttgcagcaacatggttgagcaggtgctgccgtttggtggct

SEQ ID NO: 17164 - DNA, 303 bp, Zea mays
  Clone ID: LIB189-023-Q1-E1-H4
gcctgacactgctcacgcgaaaccaaaacagcgccctgtacctgtgtcaattgacgtcccagaccccgacttccatgatttcgataaagatcgaacagagaaggcatttgacagtgatcaagtgtgggctacatatgacagcgaagatggcatgcctcgcctatatgtaatggttcagaaagttctttcgatgaggcctttccggatccgcatgagctttctcaactcaaagtcaaatatcgaactggcacctataacctgggttgcctccggtttccagaagacatgtggcgatttcagggt

SEQ ID NO: 17165 - DNA, 408 bp, Zea mays
  unsure at all n locations
  Clone ID: LIB189-023-Q1-E1-H5
cggacgcgtgggcggacgcgtggggaagattttccggtgccaattgccacggaataatgccttctactcagctcaacctccaaagcatgatggctctgacaaaccactctgtccaggagctcctgtatgccactggtgtggtacctggaaaggtgataaaatatgtagtagctgcaagaaagcaaggtactgttatgagaaacatcaggcactgcattggcgtactggtcataaaaatgattgcctccagataataagttctgttgcttcaaattcagttctgccagctgtaggaatagggatttgtttggcttccaaatggtttgttggtcctaaaatagtcagaatcacatgacatctgtgctatagatatggacctcggtggttttctccacattangaaagctg

SEQ ID NO: 17166 - DNA, 138 bp, Zea mays
  Clone ID: LIB189-023-Q1-E1-H7
acccacgaatccacggacgcgtgggcggacgcgtgggtcttcactatcaatccacttccgcaaaaaatcctctctattcaataccatccatcaacatggttgcattcataaatctcatcaactccgcagtggctttgg

SEQ ID NO: 17167 - DNA, 378 bp, Zea mays
  unsure at all n locations
  Clone ID: LIB189-023-Q1-E1-H9
attggaaagggaaattcctacattgcttcaaaagtcccaccgcagcccatagagatatgggcatgtgagggatctcccttctgtaaattagtacgagagacacttgtcgagttggaattgccacatctgctacacagctgcgcacgaggcagccccaaacgacaagaatttttcaagaaaaaggggcttttccaggcgccgtacatcgaagatcctaacacgggagtccagatgtttgaaagcgctgaaatcatagactacctgaaggcaacatatgccctgtacccaagctcgtantgatgtatcagaaatggtcattgtaatgttgcgtgtagattcagttcttcccggtaataaaaggaaaagaaatagtgggcc

SEQ ID NO: 17168 - DNA, 439 bp, Zea mays
  Clone ID: LIB189-024-Q1-E1-A1
agcccacgcgtccggagccaaggagttctcgaaagcaaagaataaaagagcggctatccaatccttgaagaggaaaaaactttatgagcaacaaattgagcagcttggaaattttcagttgagaatccatgatcagatgatcatgttagaagcagctaaagctacaacagagactgttgatgcattgagaactggagctgcagctatgaaagcaatgcaaaaagcaacaaacattgatgatgtcgacaagaccatggatgaaattaacgaacagactgaaaacatgaaacaaattcaggatgctttgtcagctcctcttggagcttttgctgatttcgacgaggatgaactggaagctgaacttgaagaactggaaggagcagagttggaatctcagcttcttgagcctgttgcagctcctccggtgcatccagtgcag

SEQ ID NO: 17169 - DNA, 376 bp, Zea mays
  Clone ID: LIB189-023-Q1-E1-G11
cccacgcgtccgcgatctgaacctcttccagctacactcatgatgacaattcgcaccccctcgagtccaatgaccatggttctcggaaagtgtgtccgtctcgtcgagtcacggcgcggtacggacgcggccaagatggtagtggtggtcacctaccgccttgtggaacactgtgcaggtcacatgcaccgcaggacgacatcatcgtgcatgtcaagaagttggtggcggcgcaaacggggacgcgcaccgagaagatccgcatccacatgtggtacaacatctacaaggaccacatcacgctcaaggactactaggtccactacggcatgggccacgagctctactacaactgatccgccgcgcttctctccct

SEQ ID NO: 17170 - DNA, 240 bp, Zea mays
  Clone ID: LIB189-023-Q1-E1-E3
aagaagagtgtcaagtgaacctgaaacttgcggtgtcactggctggtaccctgagtgtgagtgagtgatcgagctagctgagctccgatcctcgctagctatgataccgccataccacaggtcttcttcacatgtttaggagtgacagcagcaagacatcgatggcctcagccaccgtgctcaagtcctccttccgtcccaacaagtccgaatggggacgccacaaggcatgccgccgcg

SEQ ID NO: 17171 - DNA, 413 bp, Zea mays
  Clone ID: LIB189-023-Q1-E1-E6
aggaccgagcaaagcgcaaagccccccaaccgcggatcaatccgcagcatcgatggcgcccaaggcggagaaaaagccggcggcgaagaagcccgcggaggaggagcccgcgaccgagaaggcggagaaggctccggcagggaagaagccgatggcggagaaacgcctccccgcgggcaagtccggcgccggcgagggcaataagggcaagaagaaagccaagaagagcgtggagacctacaagatctacatcttcaaggtgctcaagcaggtgcaccccgacatcggcatctcgtccaatgccatgtccatcatgaattccttcatcaacgacatcttcgagaagctcgccgcggaggccgccaagctcgcccgctacaacaagaagcccatcattacctcccccgagatcc

SEQ ID NO: 17172 - DNA, 411 bp, Zea mays
  Clone ID: LIB189-023-Q1-E1-E8
agcttcgtcatacagaagtttatctcctttaagagatcctgatatccttggaagaaacttgccaggaccaacatcccctattccttcgacatcaagtcgcaggatcgcagcattgaacacatccaatgttcggatgaacatgtcgctgcctgtctctccctgctctagcccgctacggcagtacaggcagtccaaccgaagttgcttgcgctcccctccccacccagcctattcagctggagcagccaactacaatcctatcaacaatgcactctacccaacgcgaccaagcagcggtctcacagatccatggctcgaaatctctcaggtgaaaacgcaaacttttgattctccaagaagattgtagagattccaaaaagaagcaatactttgtatacaggcagggaaaga

SEQ ID NO: 17173 - DNA, 326 bp, Zea mays
  Clone ID: LIB189-023-Q1-E1-E9
agcaaaggcatacacatgtttatctcatttaccagatcctgatgtccttggtagaagcttgcaattaccaacatcaccgagtccatcgacatcaagtcgcaggatcgcagcattgagcacatccaaagttcggatgaacatgtcgctggctgtctctccctgcgctagcccgctacggcagtacaggcagtccaagctaagttgcttgcgctcccctcccgacggagcctattcagctggagcagccaactacaatcctatcagcagtgcactctacccatagcgaccaagcagcggtctcacagatccatggctcgaattctctc

SEQ ID NO: 17174 - DNA, 238 bp, Zea mays
  Clone ID: LIB189-023-Q1-E1-F2
cggacgcgtgggcgaacgcatgggcgggatcgtgctcagtcactagttcgtcaatctcgtctcacggttagacaacgacttgggcaacagcaaccgcattgtgaaggtgatcctcaatatgctcatgacccactgtacgggatttttctacctgcttgtaagggatggatgcagctagtgttcgcctaaaattaaagttcatagtactagccactgagtcgccagcttcatgcagagt

SEQ ID NO: 17175 - DNA, 283 bp, Zea mays
  Clone ID: LIB189-023-Q1-E1-F4
aaaaaaaataaaaaagaaaaaagaaaaaaaaaaaaaaaaaagaagaaaaaaaaaaggggggaaaatcaaaacggataaaagcttaaatgggcggggattcaaatgtgatagttcttcgggtgggtctccatgagatcttttcactgggcgtcgttttaacatgacttgattgggatgcccttggttttactaaaccttctcgggttgaatcctgtcttcctttccctaagtggccttccagtgaaatcggccttttccgatcggccttctcaacaattgggcc

SEQ ID NO: 17176 - DNA, 364 bp, Zea mays
  Clone ID: LIB189-023-Q1-E1-F7
ccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaa

SEQ ID NO: 17177 - DNA, 381 bp, Zea mays
  Clone ID: LIB189-023-Q1-E1-F8
gctgtttgattattactgagattcaatcatttggtcagatgagagttctggctggggacttacaagtgtagcactgttgtcggcttgtgactaaatagcatcacttcacatacaacactggataatggatcgtagggatacttcagggtttgttagtggaggatgcaaaaataatgaagcctactagtttctctatatcttctaacttggtagctttattgacaattatttaacccagaagtgaggccagctggtacttcccataaagtttggttactctaatagcaatggaacccaggcatgggcgttcagcattcactataagtttctcaaatccaaatggctttgctaatcagtgcaccgccattccagccgtcagtt

SEQ ID NO: 17178 - DNA, 383 bp, Zea mays
  Clone ID: LIB189-023-Q1-E1-G1
acggacgcgtcggcggacgcctacgcggaccagtgggccctcagcagattcatccccgatcgtctcacacggaccaggatcacgttcagctacgccttatgcttcaacggcggctcacacatcttcagcgacggcaggttggacgacctcgggaacacgagcatcatcgacgcggagagcatccttgccatcttggcctgccagatcatggtcatgggcgacttcgacggcgaccgcatcgcctgcggccagctcggcgaggtcgtcaactcgctctaacccggcagcagcatccatgcgctcggcctctccaacgatcccaaagcattcgccaaactcaaagtcatcgagctcagtaacggtcgcctcgccatgttctccaa

SEQ ID NO: 17179 - DNA, 435 bp, Zea mays
  Clone ID: LIB189-023-Q1-E1-G10
cccacgcgtccgcccaaggcaaccaaaccatctcgactcgtggggaagattcgctctcgccggcgtcgacggcctagggttcgaggaacgtccgtccgtccgtccggtgaaggagcggtagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccgcccctctctccctctcgtcaggtactagcagtagcagcgactggttccctctacaactcgatttcctttcgattc

SEQ ID NO: 17180 - DNA, 394 bp, Zea mays
  Clone ID: LIB189-023-Q1-E1-C8
agcccacgcgtccgcccacgcgtccgcccacgcgtccggttcaaggagctagctcaggcttatgaggtcctcagcgaccctgaaaagagagagatctatgaccagtatggcgaggatgccctcaaggagggaatgggaggcggtggtgggatgcatgatccctttgacatattccagtcattctttggtggtggaagcccttttggaggtggcagcagtaggggcagaaggcaacgacggggagatgatgtggttcatcctctgaaggtttctctggaggatttgtacaatggcacatcaaagaagctctctctgtcccgcaatgtcctctgctccaagtgcaatggtaagggttccaagtctggagcttcgtcgaggtgtgctggttgtcaag

SEQ ID NO: 17181 - DNA, 287 bp, Zea mays
  Clone ID: LIB189-023-Q1-E1-D1
accacgcgtcagaaaatcgagccgaaaaagatcaaacgaaaaaaaaagaagaaaaaaaccctaaccactccgatcgaatcatccgagggccgcagcagcccggcgaggctatgtctcaggcaaccgccgcctcccgggatcgcttcgcctggtgagacaactcgggccgttcatttcgtctttccgtggggatatgagggccgctccgaccgattcgcccacggcgccggcgaagtccatgctgaggctgctgttcgatccccagctcctgcggattcccccagcgg

SEQ ID NO: 17182 - DNA, 369 bp, Zea mays
  Clone ID: LIB189-023-Q1-E1-D10
agcggacgcgtgggatctggcgcttccttggaccatggctacaccgaccacggaacaagtgcacaaaagtcatctttggtttagttggcatgcaacgtaaagtttaatctacctatatcacaagattttgatcaagagttgacaagcttaatggaccatgactatttttcaccaaaagggcaaagtttagtttcattatcaattatattaaccactctgttcaaatttaagatcgaattgggttcttcctttatttagcatacttgaagttcattgcttgtttcattcgtaccaactaatacatttgttcacgattttattccaggctaaaagaactcgtgaaaggacccctactcctggaaaatactg

SEQ ID NO: 17183 - DNA, 416 bp, Zea mays
  Clone ID: LIB189-023-Q1-E1-D11
ggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgctggatgtgcatgtccatgtgtcttcatccatattcttatgaagcttgaactgggtggtactctgagttagagctttgtatttacttgggacacc

SEQ ID NO: 17184 - DNA, 385 bp, Zea mays
  Clone ID: LIB189-023-Q1-E1-D12
agacattgtgaccaagagtctgaaactttggatcatattttggtttcttgtgtttttgcgagagaattctggttccggctgatgtgcattttcagactacaaaatctggctcctacacctagtacggtgtcttttacggggtggtgggagatgattgacaatggctctggagatatgattatgaagggtgtcaactcccttattgccttgggagcctggattatttggaatcaccggaatcgaattgtctttgatggactctcccctagtgtttctgcagctctttgtcaggcaagggaggaacaacaattgtgggaaatggcaggagctaaaggtctctcctttcttgccgcaaccatcagaagcacctaactgcctggttttt

SEQ ID NO: 17185 - DNA, 414 bp, Zea mays
  Clone ID: LIB189-023-Q1-E1-D2
gcagcagaggcagcgacacgatcgcgagcgcacgcacgtaagcacgttgtcggaagctcaagttagaagaagcaccagtgactgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctaggcgcggtgggcgccat

SEQ ID NO: 17186 - DNA, 411 bp, Zea mays
  Clone ID: LIB189-023-Q1-E1-D3
acccacgcgtcaaaaaaagacgagtgtcaagtgaacctgaaacttgcggtgtcactggctggtagcctgagtgtgagtgagtgatcgagctaactgatctccgatcctcgctagccaggataccgccataccacaagtcttcttcacaagtttatgagtgatagcaacatcatatcgatggcctctgccattgtgctcaagtcctcgttccatcccaccaactccgcatggggcgccaagacacatgtcgttgcgctcaagccactcactctcctaattcgattgcacgcttccccgtaactatggcttcgacctactgggcctctcagactcggatggcaccgggggcttcatctagcccaagtggatggcctacggagatgtgatcaacggccgccatgccatgctagg

SEQ ID NO: 17187 - DNA, 410 bp, Zea mays
  Clone ID: LIB189-023-Q1-E1-D4
gcggcggggtagcatttgtgctacgagggcttttgcaatggcggcttcggggttcggcggcggcgaggcgttccggctctcggccgcaccaggggccggcttactgaagctgcacaagggcgacatcaccctctggtccgtcgactgcgccaccgacgccatcgttaatgctgctaatgagcgaatgttaggtggcggaggtgttgatggagctatacatcaagctgctggaccagagctagtgcaagcatgccggaaagttccagaggtcaaaccaggagtccgttgtcctactggagaagctaggattactcctgcttttgagcttcctgcctctcgggtgattcacactgttggccctatatatgatttggacaagcatcctgaggtgtcattaaagaaggcctatg

SEQ ID NO: 17188 - DNA, 414 bp, Zea mays
  Clone ID: LIB189-023-Q1-E1-D6
caactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaa

SEQ ID NO: 17189 - DNA, 415 bp, Zea mays
  Clone ID: LIB189-023-Q1-E1-D7
agaagacagacggcaaggcagccagaacccttgccaagctcatgctcttccgccagttctatgttgccgttattggatacctctacttcaccaggatcattgtgtatgccctcaagacaattactaactacaagtacagatgggtcagcgttgcagcggaggaggtggccaccatggcattctacatgttcatgttctacatgttcaggccagctgagaggaaccagtacttcgcacttgacgaggatgatgaggaagccgcagagatggcgctccgtgaggaggagtttgagctctagacgaccacgtggatgtccaatgacatgggaatgcagccatctcccattcattttctcctcgatgtgatgttgatcatactatacagattcagggtttagctaatatatgtctacgt

SEQ ID NO: 17190 - DNA, 67 bp, Zea mays
  Clone ID: LIB189-023-Q1-E1-D8
gacccacgcagtcacccacgcgtcagcggacacgtgggcggatgggtagggtgatttgatgggtttg

SEQ ID NO: 17191 - DNA, 133 bp, Zea mays
  Clone ID: LIB189-023-Q1-E1-D9
cacgcctatataatcagtcgtagtaacggcgtcacgctctgccgccgcgtcaagtcacaacgagatcaatattaccgaccacaatagactctgcgttcctgccgccacggctgtctggcccccggtacggcaa

SEQ ID NO: 17192 - DNA, 348 bp, Zea mays
  Clone ID: LIB189-023-Q1-E1-E10
ctcctccgtcgccggcctcggtggctgcccgtacgcgaagggtgcgtcggggaatgtggcgacggaggatgtggtgtacatgctcaacgggctgggcgtcaagacgggcgtcgacctgggcaaggtgatggccgccggcgagttcatctgcaggcacctgggacggcagtctgggtccaaggcagcgaccgctctgagcaaagttaccgcgaacgcctccaaactctgacaatttaccatgatcacctactgcagataattgcagtaaaattagcgcatggtaataaatagactgaggctattcaaataaatacggcctcggagctaataatgagtaaatttttaatt

SEQ ID NO: 17193 - DNA, 262 bp, Zea mays
  Clone ID: LIB189-023-Q1-E1-E12
gaagtactgcaaggacaacccggactccgaggagtgccgcatctacgacaactagctagtcgtatagctatataggccatcgacatgaaggacgaaggttgtagcacactacgaaagaatgatactctcgatcggcgcgtcatacgtggaatgaacttgtttgtatcaagctatctatacctcaatgcttctctacctgccgccgccgcaccccgtatgatatgtgatacacagctgggatggtatactgatattttgggtt

SEQ ID NO: 17194 - DNA, 405 bp, Zea mays
  Clone ID: LIB189-023-Q1-E1-C7
cggacgcgtgggcttgctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggctttcccgcaaacgtcgtgttccacgaagacgaggtgccgagc

SEQ ID NO: 17195 - DNA, 333 bp, Zea mays
  Clone ID: LIB189-023-Q1-E1-A9
cccacgcgtccgccctcatcattgccgacctgccgtccgctcagccggccaggcggccagccgctgtcccgcctgtccgccgagcgcccgacgacccgagcaggcgagcagctccgcgccgcgcgacgtcccgagcagctcctgttcggtatccctgtttctcgcttggcggctgcctgaggcggccagcagtcatggcgactcgcgccggacgaccgcccagtccggcgcccgctcttctgctcctcctcatcttcctgtttctgttgcggggagttcttccgtcgctagccggggacaccgtcgccgccggccgcccgctgtccgatgcgc

SEQ ID NO: 17196 - DNA, 330 bp, Zea mays
  Clone ID: LIB189-023-Q1-E1-B1
agactagctctcacgtgcgcaccgcctgctcgacgcaattccccactcgcccaccaaccttcccgtccccgatggcgatcatggcggccaccgccactgccgtggcttccccctccagctccacctcgccaggtcccctccaacccagcccccgcttcctccctcccgtctccacgcccgctcgctgccatctcctccccaagccgcggcggtgttgcgcgcgcctccacatcgagcgtcgggtggccgtcggcagcgacgtgtcttcgtcccatgacgtggctgccgaggaggccgctgctgcgcccaaggtccggaagcgcgtgcgcg

SEQ ID NO: 17197 - DNA, 392 bp, Zea mays
  Clone ID: LIB189-023-Q1-E1-B12
ttccggggcgccccacgcgtcagatattaattaggttctaatccaattagtagtaagtattttcttttttatttaatagtctctgactatcattaaataaagggtagagcaattcttttttctagagattctagagaaagtgagacaaagtgaagcgaaagagttttctttgtataagaattaggtctatatcatatctaaatagaagggaaatcaaaaagaagggaagtggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaa

SEQ ID NO: 17198 - DNA, 427 bp, Zea mays
  Clone ID: LIB189-023-Q1-E1-B3
acccacgcgtcaggcaaaacgagcatccgcgtccctggctctattgatttatttttaagtagaaatcggtgctgtttgtgtacaagtgttgtcgcagcctccaagtgggattttgagcacgtgtataaagttatagggctcgtgttcttacaaaaaaaaaaaaaaaaaaaaatcaaaaaaacaaaaaaaaaacaaaaaaaaaaaaaaaaaaataacaaatcaaaaaaaattaaaacatacaaaaaaaaaaaaaaacaaaaaaaaaaaaaaaaaaaccaacaaaagaaaaaaaaaaaaaaaagggggggccccccaaaaggttccaactttatttaccctgaaaggcaggtttaaacccctccaaaagggcccccaaatttcaattcaggggccgtcttttaaaaaagtccgcctgggaaaaacccgg

SEQ ID NO: 17199 - DNA, 418 bp, Zea mays
  Clone ID: LIB189-023-Q1-E1-B4
acccacgcgtccggataagcactccagatgcaacttctcttcttattcaaccatatgataagtcaagcctcaagcttattgagaaaactatagttgctgcaaatcttggtgtgacaccaagcaatgatggagaagtaatacgagtgactgtcccaccattgacatctgatcgcagaaaggaattatcaaagacagtagctaaattagctgaagatggcaaggttgctataaggaatataagaagagatgcaatcaaagcttatgataaactagagaaggaaaagaagctttctgaggacaatgtgaaagatttatcagctgatttacaaaaagtcacagatgagtacatgaaaaagatcgaatccatccagaagcagaaggaacaggaactgatgaaaatttagacctcaagctgact

SEQ ID NO: 17200 - DNA, 261 bp, Zea mays
  Clone ID: LIB189-023-Q1-E1-B5
gaccacgcagtcaccgatgcgtccgcctaggcgtcggaccaggcttccgattttgaacactcaggttcacatcaggtcaatctccctatgaagagtttatcgatttgggtacctggaaatgaactcttcatgcgcttcatgactctattgtgaagtcacgttatcggtgaactaatttaaaaagtacacgtggattaaggaccatgactggattattcccccgaacatttaattcgttggggcccccgggcataggcgggg

SEQ ID NO: 17201 - DNA, 360 bp, Zea mays
  Clone ID: LIB189-023-Q1-E1-B7
cgacccacgagtcagcgctcatccaggagcttgcggattgcttgattcttccgcccaagctcctcgctcagctcccgagcgaccttcgtctcgacctcaatgacgctgcgtttgatctctccaacgggccagttctcgacgagtgtggccaggaagtgggtgatctgctcctgaacctggcaaaagcatgggagttagctgagacgtcaacatcaaatagcattgccaagcagctgccgttgatggagccctacttgacgcgcagcgccaaatcagcgtttggcaagcggctggtgtcagctggaaggaggtttcagtcaatgggacagtacaaccagggataactcagaccgattgctg

SEQ ID NO: 17202 - DNA, 216 bp, Zea mays
  Clone ID: LIB189-023-Q1-E1-B8
acccacgcatccacccacgcgtccgcggacgcgtgggggcgtcgtccatgctctccgctaccaccgtgccactccagcaggggggcggcctgtccgagttctccgggctcaggagctccgcgtcgctgcccatgcgccggaatgccagctcgggcgacttcatgtccgccgtctccttcaagacccacgcggtcggcacgatctgcgggtcgccgc

SEQ ID NO: 17203 - DNA, 391 bp, Zea mays
  Clone ID: LIB189-023-Q1-E1-B9
ccacgcgtacggaatgatacagctgatggtttggtcaaggagccagatctgaaggacatacgcatcacctttgaggagtttaaggcatttgctgacttgcgacaaagattggagccactgtcgatggctatctttgctcatgggaaagtgaatggattattgacaaaggaggatctaaaacgtgcaacacaacatgtttgtggtgtcaacttaactgatagagtggtagacatcattttccatgtgttcgacacaaatcaggatgggaacctgagctcggaagagttcttaagagcattatacagaagagaaactgacattcgtcaaccaccacctaccaggtccatggcggtttatctgtcttgctggttcacgtgctacgacgtgttca

SEQ ID NO: 17204 - DNA, 260 bp, Zea mays
  Clone ID: LIB189-023-Q1-E1-C1
cgtatggcccaaagaatagcacctccacgttgaatttctgcaggatttagatcaaccggaataccaagtgcgcgagcaacacttctgtcgactttccagagatgggcggtcggagcttgtgtactctcggggacaaggcgcgtatctagcgcacacgtccgttgcctctcggtgggctgcattgagccatttcgccggcaacgatgcacgcttcaccgtcaagtaaatgctcgttcatgaatgtcgctgctgctgccgct

SEQ ID NO: 17205 - DNA, 357 bp, Zea mays
  Clone ID: LIB189-023-Q1-E1-C11
cgtaccggaccggcagttcgcgcgggcgcacccacgcgtacgcagacgcgtgggcggacgcgtgggcggacgcgtgggcggacgcgtgggcggacgcgtgggctcagaagccgcaagactgttcagctagaacatccgggagtacaaccgcagtgtccgcgagattgtggagctcagcgggacagccgactagtgcacgaggatgcccatcgtgcccgcgagggcacaatatggaaccatgaacgaacatccttgtgtctgtggttcgccagacctgtcgaaccattgagtaagtccacttctagtctgtcgtcgtcacgcgctcggtctgatccgagagatcggttgcccaaggtg

SEQ ID NO: 17206 - DNA, 446 bp, Zea mays
  Clone ID: LIB189-023-Q1-E1-C12
agcgagacgcgtgggcggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaaaggttcaaaccttatttacccttgaatgcaacttcaaacctcttcaaaattttccccaaatttcatttcatgggccttcttttaaaaacttcttaattggaaaacccctgggtttacccaatttaacccctttgaaaaaaacccccttttcccaatctggcttaataccaaaaaggcccccacctttcccctttccaaaaatttccccaccctaaatggcaaatggaaccccccctttaccggcccattaacccccggggtttttgtggttaaccccaactt

SEQ ID NO: 17207 - DNA, 319 bp, Zea mays
  Clone ID: LIB189-023-Q1-E1-C6
gacccacgaatcagaacaagcactacgtgattcaatgaatcctgaagagatctaccttcttttgcaccacaaggtcgaggatgtcttgcaactgcggatcaagctgcggatgcggctcaggcggcaagtgcggcaagaagtaccctgacctggaggagacgagcaccgccgcgcaggccaccgtcggccgcggcgtggccccggagaacaaggccgcgcccgagttcctcaacgatgcggccggcgtccggccaagccgccaacggccgcacctgcagtggcacctgcaagctgcgaaccctgcaactgctgatcacag

SEQ ID NO: 17208 - DNA, 216 bp, Zea mays
  Clone ID: LIB189-022-Q1-E1-H12
gtcctcaccaccgccgtcacggcgctccccaggaatgggcagcgggcgtcgtcctccttcctcggcgggaagacgctgctgagacaggccgaggcggcccggccgtcgttcgccgtgcgcaccgcggcggaccccaacaggccgatctggttccccgggagaacccctccgccgtggcttcgacgggagccttcccggggacttcggctttgatcc

SEQ ID NO: 17209 - DNA, 369 bp, Zea mays
  Clone ID: LIB189-022-Q1-E1-H2
cacgcgtacgcagacgcgtgggtgcggactcaacctgtttttcattgtcttcacgttgattcttgtttttgcgtttgctattgttgccctgcacccaaaggtaccatcatgtagcctgtttttctccgttttactgattttgcatttgtttatattacttgatttgaccagaaaccgttgcttgataagttatactggatgggtttggggtttggggcagtattatacttgcaactctagattattgggttggtttgattgttttagattccatcttggccatcgtatgaccatgctttccaaaaactatgtctatacatttcccttgaatgtaactatcttttttgtgctaaataatgctgaactttg

SEQ ID NO: 17210 - DNA, 361 bp, Zea mays
  Clone ID: LIB189-022-Q1-E1-H4
ccacgcgtacgcaaacgcgtccgagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggg

SEQ ID NO: 17211 - DNA, 434 bp, Zea mays
  Clone ID: LIB189-022-Q1-E1-H9
ggggccacgcacgcgtccgcaaacacgtccggtttggatcggatcggacaacccctgccaaaaccgcgtgtgccggcgctgttctgcctctgatcgtgtgtgctgctgttggttttggttttggtttggctagggaaggaaccgtgggagggaagcggacggacatgatgcacgccaagtcggagtcggacgtgacgagcctggcggcgtcgtcgccgcctcggtcgccgaagcggggcggcggcgccgccggcaacggcggctactacgtgcagagcccgtcgcgggagtcgcacgacggcggctacaagtcctcgtcgatgcagcccacgccggtctacaacagccccaacgagtcgccgtcgcacccctcctacggccgccactcccgctcctcctccgtcagccgcttctccggcaaactccgcaagggc

SEQ ID NO: 17212 - DNA, 376 bp, Zea mays
  Clone ID: LIB189-023-Q1-E1-A1
agcggacgcgtgggcggcgtgctgcggctggaaccactgtggccgccgcctcgccgctggcgccgtcgatggctccgtctccgtctatgactcccagccgccaccctcgttcaagtggcaggcccatgagcaagccattgtgaatgtcgtctggcttcctccagagtatggggatgctatagcttgtgtttgtgctgatgggacactgtctttgtgggaggaggttgctgctgatgatcaacttccaacctggagaaattgtaaaatcttcgaggatggcaactctcatatactaaatgtacattttggattacatctgggaattctgaaaatggttactgcatactcagatggccaagtcaaggtctacgagctc

SEQ ID NO: 17213 - DNA, 364 bp, Zea mays
  Clone ID: LIB189-023-Q1-E1-A10
gcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagttt

SEQ ID NO: 17214 - DNA, 425 bp, Zea mays
  Clone ID: LIB189-023-Q1-E1-A11
gacccacgcgtacgggaaaaatcgccccatcccctgactatcactggctcactgcccttccacctacaggttccaggttaagtttaagattgataaagattgccgtcctctccctgagagtagtctcaagcaagccatcaaggaaaattacaatgcaaagagcaaatttgatccagagctcaccacaaaacaagtccaaaggttacttttgctgtttaagcctgttagtgcacctcaatctgtttcaaataatcaccttggagaaaggcgccactatgaaaaacgaaggaagccacgccattttgaagaaaggcggcctattgaagcaacgcgtcggccacgatttgatgaggaaaggcgccctgcggttagacatgttccttttgaggatccatacagggcaccacgctatgctccaattcctg

SEQ ID NO: 17215 - DNA, 375 bp, Zea mays
  Clone ID: LIB189-023-Q1-E1-A2
ccggccgacccacgctcacagtaagaatgaggccatacccgattcaggacacccaaacaacgttccagttcaggcaaccgatttatacggtcacctaaggaaaaaattctctaagacaacatttcccactgaccacaagattccggcatgtaacggttgaggaaacggcggcggtgccttccggggccaagcagatccctgcagctggttccaagtaccagaattttacgcgcctagatgatgatgtccaggttgattggaggcagcagggtgctgtcactcctgtcaagaaccaaggccaatgtggctgttgctgggcgttctctgcagtaggtgccatggaaggtttgatcatgataacgacaggaaacctgg

SEQ ID NO: 17216 - DNA, 419 bp, Zea mays
  Clone ID: LIB189-023-Q1-E1-A3
acgcgtcagcccaggcgtccgcgtcgacccgctctaccccggcggcagcttcgacccgctcggcctcgccgacgatcccgaggccttcgccgagctcaaggtcaaggatctcaagatcggccgcctcaccatgttctccatgttcggattcatcgtccaggccatcgtcaccgggaagggcccgctcgagaacctcgctgaccacattgccgaccccgtcaacaataacgcttgggcctacgccaataacttcgtccccggcaagtgagggaggcgccgccggtgacctttatgtgtccggatgcatgtgaacgcacgctggttttcggtttgtaccatgatgtaaactattgttcaatcgacaaggaataattgtgttcattgtcaaaagaaaaagtctgatcatgataacgacaaga

SEQ ID NO: 17217 - DNA, 418 bp, Zea mays
  Clone ID: LIB189-023-Q1-E1-A5
agcccacgcgtccgaatattttgagcattcagaaacacacctagcgaagcgcactagcaacgacctaacaacaatggcttccaagacattatccctccttgcgcttcttgccctttttgtgagtgcaacaaatgcgttcattattccacaatgctcacttgctccgagtgccattattccactgttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaaccca

SEQ ID NO: 17218 - DNA, 417 bp, Zea mays
  Clone ID: LIB189-023-Q1-E1-A6
ggtaccaatcagccaatccccgtccgacccacgcgtcaggactaccgcatcatgcgcggggacagccggatgcacaacatgcgagacgcactaatagggatctaacaccagtggcatctaagacattatcattccttgcacttcttgccctttttgtgagtgcaacaaatgcgttcattattccacattgctcacttgctcagagtgccattattccactgttcctccctccagttacttcaatgggcttcgaagacccagctgtgcaagcctataggctacaacaagcgcttgcggcgagcgtcttagaacaatcaattgcccaattacaacaacaatccttgggacatctaaccatacaaaccatcgcaacgcagcagcaacaagcactgagccacctagccgtggtgaacccta

SEQ ID NO: 17219 - DNA, 412 bp, Zea mays
  Clone ID: LIB189-023-Q1-E1-A7
agaggacactactcctcagaactctcccttccctcttgtaggggccaaaagggtcagagatctaggaagaagagaactagtccccaagcctaacaagaaagcaagctcttctgcaactgttggcattcgccttaatttgtatccatcccaatggcaggcctatctctggaacacccctgggcattcactttcggcctcctaggcaacgttatctccttcatgaccttcctggccccgataccgacgttctaccgcatctacaagagcaagtcgacggagggcttccagtcggttccgtacgtggtggccctgttcagcgccatgctgtggatcttctacgcactgatcaagtccaacgagacgttcctcatcaccatcaacgcggccggctgcgtgatcgagaccgtctacg

SEQ ID NO: 17220 - DNA, 367 bp, Zea mays
  Clone ID: LIB189-022-Q1-E1-H11
ggggcccagcacgcgtccggatgcaccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgccgcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaataatatacagattattcgcccaaagagacgtatgttatatatatgag

SEQ ID NO: 17221 - DNA, 383 bp, Zea mays
  Clone ID: LIB189-022-Q1-E1-F3
cccggctggccccacgcgtcagcacacgcgtccgcccacgcgtccgggcagcctcggcctgcagctcatgtcgcccatgccacctgatcgggacacgaagccactgctcccgagagctggtttcttgcagcagcatgggcatcacaatgccccacaccagctccacgcacagcagccgcagcattaccgtgactccgctggtggcggagtctctggtggcacacctgccgagcagcaccctatccacatggacttctcgcgcaatgaagcttggctgcacccatcacaccaccagcatccccatgaacagaaggtccttcattctcgccctatcggaccagctgggcatgttgggcatccaggccatgttgcccatcctgtgc

SEQ ID NO: 17222 - DNA, 352 bp, Zea mays
  Clone ID: LIB189-022-Q1-E1-F4
cccggctggccccacgcgtcagcacacgcgtccggagcaagggatgctgctcttaacgccatccagtcgccgctgcttgatattggaattgaaagagccacaggcattgtgtggaatatcactgggggaactgacctgactttgtttgaggtgaatgctgcggccgaaattatctacgaccttgtcgatccaaacgctaatctgatatttggcgccgtcatagacccgtcactgagtgggcaggtgagcataaccttgatagctactggcttcaaacggcaggatgaaccagaaggccgcgtgtcgaagggtgggcaacaaggtgagaatggccgacgcccatccccagcag

SEQ ID NO: 17223 - DNA, 412 bp, Zea mays
  unsure at all n locations
  Clone ID: LIB189-022-Q1-E1-F8
aagtccgggctcgacccacacgtacgcccacgcgtccgcccacgcgtccgatctttgataggcatagtttgataattgggtgtgtgcaagagtcaaatttaggttcatattgtttacgccccctgccatttagctaaacgcacattggtatgcggtgaatttcagaccagaaggtagatttcttcaaggggaacaatgtggtgtaacttgatcagcacaaccactttactgaaggtgtccggatcatgatgcagacaacaacaactggtgtactcattaccactttgatggtaatcgaaatggggacaaacacaattggagggaaaatatccaaagacaaaaggagtgagttttcacttcttcagattccaacantcagaataagaactagacatcatagagaccaactttt

SEQ ID NO: 17224 - DNA, 342 bp, Zea mays
  Clone ID: LIB189-022-Q1-E1-G1
agcccacgcgtccggtgctatccattgctctgggcgacacggtatacctgtgggatgcctccagtggatccacgtctgagcttgtgaccattcacgaggacagtggtcccatcaccagcgtcaactgggctccagatggccaccatatcgctattgggctcaactcatccgatatccagctctgggacaccagctccaaccgactggtatgtgcactctcctgcttcaaccagaaatgcatgcacgctctgtcattgaatttaggttgttttttgcctgcagttgagaactctcagaggtgtgcatgaggaaagagttggctcactggcatggaacaacaac

SEQ ID NO: 17225 - DNA, 263 bp, Zea mays
  Clone ID: LIB189-022-Q1-E1-G10
gcgtccgcacagaaatccgcagacgcttgggaggtcacatcgccgtgaccgtcggttgtgcatttcctcaatttactgctatcatgtgcgccagatagcatttttgtttaagtcgtggatcggggtggaaacattccatataatttttcgtttcgtattgacaccaatgtcgtcatatcataaaatcatcccggggaatctttctaatatctgtcacactatccgaaagaacacgcccctttaatcagtatcatccttatatt

SEQ ID NO: 17226 - DNA, 416 bp, Zea mays
  Clone ID: LIB189-022-Q1-E1-G11
ggggccagccacgcgtccgcaaacgcgtccgcccacgcgtccgcccacgcgtccgagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtcccaggggaggcatgcagattcttgttgaaaaccctgacgggaagactatcaccctccaagtggagtcctctgaacacattgaca

SEQ ID NO: 17227 - DNA, 352 bp, Zea mays
  Clone ID: LIB189-022-Q1-E1-G4
acgcgtacggaaagacggtggaagcggtggccgagatcaccgcgccgttgctgcccatggagcagctcctctccgcaattccctccaagagggaacaacgccctgcagatcgatgagctagacggcctcaaagcattgcatatgcttctaggttttgttttgtatgcaatgttgtgatatcagagagatatctaagtttttatattttatatgatgacgatgagaactaagtacaagtgcttttattttttattattcctaaagacaacttttgtatatgtaacatcatgaatgtttgaggtgtctcatgtgtaactttaattaatatcaatttatgcatgaaatattatgg

SEQ ID NO: 17228 - DNA, 337 bp, Zea mays
  Clone ID: LIB189-022-Q1-E1-G5
gacccacacgtacgggcttggcttgggactgggccgcccggccgcgaggaataaactcactcctgccttcatacgtatccatagccgcggcagtacgtgtatgtggttagctatacgcgacctcagctcgggcgcaagctacaagcccgaccacgcgagaagaagcatcgatagtgtgacgagctaacccaccagcagcaacgtaatccaaatccatggacaagcagccgctgccctactccacaggccagccccctgcccccggaggagccccggtggcgggcatgcctggcgcggccggcctcccacccgtgccggaccaccacctgctccagca

SEQ ID NO: 17229 - DNA, 370 bp, Zea mays
  Clone ID: LIB189-022-Q1-E1-H1
agcccacgcgtccggctccgcaactaccccgataccattcccaaatcctccgtcgacccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaacttgcagagcaagatgttcccggcctacttcacgcttatatctgcatgcgcagccatctccgt

SEQ ID NO: 17230 - DNA, 411 bp, Zea mays
  Clone ID: LIB189-022-Q1-E1-H10
ggggccagcacgcgtccggactagctctatagctcgagtattgcttgctctccacaagaaacaaggcagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggccggcaccagctccggccgcgtgtggggccgcaccggctgctccttcaacggcaacagcgggagctgccaaacgggcgactgccgcggcgccctgggctgcacgctgtctgggcaaccgccgctgacgctggccgagttcaccat

SEQ ID NO: 17231 - DNA, 369 bp, Zea mays
  Clone ID: LIB189-022-Q1-E1-F2
tcccggctggccccacgcgtacgcatgtccacgcgtgcagccgaggttgatcgcggtgtcggagcccatatcgttcaagaaccccaaggcgcccgtgttcccgcgcctggcgcagggcacgtcccacgacgagatgacggtgacgtggaccagcggctacgccatcgatgaggcgtacccgttcgtggagtggggcgccctggtcgccggcggcgtccggcacaccgcgcgcgcgcccgccgggacgctcaccttcaaccgcggcagcatgtgcggcgagccggcgcgcaccgtcgggtggagggaccccgggttcatccacaccgccttcctcagggacctctggcccaacaaggagtaccactaccg

SEQ ID NO: 17232 - DNA, 422 bp, Zea mays
  Clone ID: LIB189-022-Q1-E1-D9
ggggccacgcacgcgtccgcaaacgacgtccgcccacgcgtccgcagagaggagcttcatcagctcattcaattctcgttccatccctcgtctcttgtgtcccgcctccgttccataattcaccagcgtcgtcctacccatatctcctatcgtcttctccctcgcgccatcagcttccccaagccagcggcgaccatgatctccccggacaccatccgcacggccatcggcgtcatcggcaatgggactgcactcgtgctcttcctctccccagtgcctacgttcatccgcatctggaagaaagggtcggtggagcagtactcgccgatcccgtacgtggcgacgctgctgaactgcatgatgtgggtgctgtacgggctgccggcggtgcacccgcacagcatgctggtgatcaccatcaa

SEQ ID NO: 17233 - DNA, 100 bp, Zea mays
  Clone ID: LIB189-022-Q1-E1-E1
acgcgtcaccaacgcgtccgctgacgcttgggcggacgcgtcggccgtcgcgtgttctgatgcttggtatctcccttggtcggtgcttgtcttttcatcc

SEQ ID NO: 17234 - DNA, 392 bp, Zea mays
  Clone ID: LIB189-022-Q1-E1-E10
ggggccagcacgcgtccgcacccaagcccgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatcggagaggacatcgccaaggagacggccaaggactggaagggcctccgcgtcaccgtcaagctcaccgtccagaaccggcaggccaaggtctccgtcgtcccctccgccgcggcgctcgtcatcaaggcgctcaaggagccagagagggaccgcaagaaggtcaagaacatcaagcacagcggcaacatcagcctcgacgacgtcatcgagatcgccaggaccatgaggcac

SEQ ID NO: 17235 - DNA, 458 bp, Zea mays
  Clone ID: LIB189-022-Q1-E1-E11
ggggccagccacgcgtccgcagacacgtgggcaccgacccatacgagttctaccagtatgtgcatttgtcggaggttggtaactgtgtcggatctggtattggtggtactactgccctacgaggcatgtacaaagaccgcttccttgacaggcctgtccagagggatattctgcaagagtctttcatcaacacaatgagcgcctgggtgaacatgttgctcatgtcgtccactggaccgatcaagactccagtcggagcttgtgccactgctgttgaatcgattgacatcggttatgacaccattgtggaaggcaaagcacgtgtctgcttcgttggtggtttcgacgacttccaagaagaaggttcgttcgagttcgccaacatgaagggctacaataatgccgaagacgaatttgcgcacgggcgcacaccgcgagaaatgtccgccctaacaaaa

SEQ ID NO: 17236 - DNA, 441 bp, Zea mays
  Clone ID: LIB189-022-Q1-E1-E12
gggtccagccacgcgtccgtccatcactggtaacttcatttgccttcttgtcgtgtggatatcttctcagttcatatcatgaggtgagatctgttgtactaaacaccctgaatagggcaaggttcactgtggctgtggattctttcatcaggactgggtatgtaccctcgctgaaggatggaaactcacaagagacaatatttaatccaccttggcgacatgagccagttgcaataggatcaagatttggagatgcgtttcaagaacctgcttcgtttcttgctataaaacctttgttcgaggatgagaggtatattgttacatataacccaacaaaggacaaggtatatgctttgctcaaggaccaagcaaagccagatgacattctcaaagctgcttttcatgcacatgtgttactgcatttcatcaaatgctcacatg

SEQ ID NO: 17237 - DNA, 417 bp, Zea mays
  Clone ID: LIB189-022-Q1-E1-E2
agtacatggccatatcgataatatcgataaaagaacaaacttaatcctggcgccgggggaaaatgttcaaatgggcaaactgggttaacaaggccaaagaaaggagaatcccgttagaaacaaaaacaatttaaacttaacaagggaaaacgttccaaaattcaaggctaaactgagcaatatctgtaatggcatcctgaagctgcttgactcccacctagtgccttcttttactgctgctgaatcaaaggtcttctacctcaagatgaagggtgactatcacaggtatcttgcggaatttaagactggtcctgagaggaaggaatctgctgagagcacgatgatggcctacaaaggtgctcaaggaaattgcccgggttaacctggaacctacccatccgataaggcttgggcttg

SEQ ID NO: 17238 - DNA, 372 bp, Zea mays
  Clone ID: LIB189-022-Q1-E1-E4
ccggctggccccacgcgtacgaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaaggccgccgcggcggcggcggcggcggcggcggcgaagcctgccacgagggcgtacgtgacgttcctggcgggcgacggcgactactggaagggcgtggtggggctggccaagggcctccgcaaggtccgctcggcctaccccctggtggtggccgtgctgcccgacgtgcccgagtcccaccgccgcatcctcgtctcgca

SEQ ID NO: 17239 - DNA, 317 bp, Zea mays
  Clone ID: LIB189-022-Q1-E1-E5
gacccacgacgtacgcccacgcgtccgaaaaaaaaaaaaaaaaaaaaaaaaaaaaaaaaaaaaaaaaaaaaaaaaaaaaaaaagaaaaaaaaaaaaaaaggaaaaaaaaaaaaataaaaaaaaaaaaaaaaaaaaaaaaaagggggggcggccccaaaggttcaatccttagttccgtttgcttgcaatttcatacctcttcaaaggttgcccttaatttaatttcacgggctgtcgtttaacacccttttgccgggaaaacccctggctttccccaccttaacgtttttccaacaaatccccttttcacaaggtgg

SEQ ID NO: 17240 - DNA, 457 bp, Zea mays
  Clone ID: LIB189-022-Q1-E1-E9
ggggcccagcacgcgtccggagctgtgctctgctctgctctcgcctcgcacggactcgtggtaaaggatggagaccatgtcggctctcgcgaggacggcgccgccccttgctgggaccattcgccggccctcatgcgcgctgaggccgacggcgtccctctccttcgccgccgcttcaacgacgccccgcggccggctcgggctggggctgagcacggcgccggcggggagcgggagggcggccagggctcgcgccgtcccgcggcgcatcgtcgcctcctcggaggttgagcaaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaagggataaactttc

SEQ ID NO: 17241 - DNA, 189 bp, Zea mays
  Clone ID: LIB189-022-Q1-E1-F10
cgagaaattgtgcgggacatcaaggtgacgcttgaatatctagctcttgactatgtgcaggagttggcgactgccaatatcacctcctgcgggttgtcaagagctatgagctgcctgatgggggggtgatcacgatcggcgcagagagattcacgtgcccggaggtcgtcttccatgcatccatgtttg

SEQ ID NO: 17242 - DNA, 443 bp, Zea mays
  Clone ID: LIB189-022-Q1-E1-F11
ggggcccagcacgcgtccggaaaatgagcataacagatcgagcagccctgttattcatttagaggacccactagtgtctttgaaggatgttgagcagcatggtccaactcctactaaggactttgttgtacctaacacagaagaccaacaagaagccagagatatcagcttgcaggtacaagctgtggattccatgaaagattgtggcgaagtaccagatggaacaatagaggcttcgacgaatgatgatgaattagaactgggtacttctgcagatgtagaaaagaatgatcaacctaccttgctggaaccaagatcggagtctgtctctgtcccagaactgtccgtcttggatgaatctgacgataaaatgcaatgtggtgtttctggcaaggatgaggaagcacatgtggaggagaaaactgtaactattgctgttgaca

SEQ ID NO: 17243 - DNA, 430 bp, Zea mays
  Clone ID: LIB189-022-Q1-E1-F12
ggggccagcaccgcgtccggagtcaagctctgctttggtgtattgggaggttcgagtggcgctgatgggttctctgctggcacacctggtggtggtaccttgctgctaggaggtagcgacagctttggcaacagtaacgttggtgctcgccagctttggcaacagtaacgttggtgctcgccaggcgctcaacaaaacacctgaaaccaaagttcgtatagtacctgtcaagcgctcgacaaattgtctgcatcggaaaatcattagcaacctcgcggattcgagtcaaatattgaaatggtgagctaatttgctattttattgactggtttgatgaatgaattgataggtgtgtaaaaaaaaaaaaaaccaaaggaaaacaaacagcgccacaaaagaacaaggaggagccacgccgacgagcgaggcc

SEQ ID NO: 17244 - DNA, 376 bp, Zea mays
  Clone ID: LIB189-022-Q1-E1-C2
cccgggcggccccacgcgtcagcacacgcgtccgcatcgacctactccagtgaaaaagcgtccttctgtgtccaactctatggccaactccgctgttgccaagaacacgtcagcaccatgctcaagatcatcaactccaacctctcggtctcgaaccttgtccagttcatcttcaagcagtacaagtgcagtgagccgtcccagctcatcctctggtaaagttcctgcaataacttatagcagttcttcatcaagtacagtttcttcagtgagccgtcctagctctcggtcatccacacccactcgtcaacctgccatgcgttcgtcaacaccatctgctaggcggatttctggtagcaataacatgacatccaat

SEQ ID NO: 17245 - DNA, 352 bp, Zea mays
  unsure at all n locations
  Clone ID: LIB189-022-Q1-E1-C3
ggctggccccacgcgtcagcacacgcgtccgcccacgcgtccgcagcttcaacacggccacggcaccggcgcctgctgccccggccgagaactgcaaccttgagctgacactcgcaacgggaccgagcagcagcggcagctgcgacgccggaaggtggcaggggaagcggctcaaggcgtcgcccaactcgggctccgccgccaccgcggtgtcttccacgtcgacggattcggagctggcgcggttcggggacatcgacgtcgtggcgacgccggtggccaggtttcacggcgaggttactangaggatggacgaggtggcgcagggcccgtggatgtaccgctgcctgag

SEQ ID NO: 17246 - DNA, 448 bp, Zea mays
  Clone ID: LIB189-022-Q1-E1-D11
acgcgtccgcaaacacgtccgcccacgcgtccgatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacagtgaacgactggactgccttttg

SEQ ID NO: 17247 - DNA, 330 bp, Zea mays
  Clone ID: LIB189-022-Q1-E1-D3
acgcgtaagcaaacgcgtgggcaagaaccaggcggacccgccgcctgccgatggcctgcgcgtggaccgctgggccggggccaggtacccggccgtgcaccgcttcgtgggcttcgtggcggacgtcgacgtcggggaacaggcggcgcgcctcgaggccagcctccagggcacccggtgggccgccgccgtcaacgacgcgcgcatggccgacccggcctcgccctacaccgtcgcgcagtacaactcgcccttcgagttcaccggcacggtcaaccagatctgggtgctcttccgacccgacgactacgccagtacttcgtgatgcga

SEQ ID NO: 17248 - DNA, 331 bp, Zea mays
  Clone ID: LIB189-022-Q1-E1-B1
caaaggctaggcaccacaagtgctggggcttcattctttcttgatggaacattctcattgaaccaaacagggactgcgaatcaaggtgctcgagataaaataattagtttggcgaacaggtacatgactgaggtgaggcgattaaaccttccacagaaccaaacggagaatgtctaccgtggtttccgtgaacttgaggagaaattactatcttcttattaagcagattgcagtcattcctcaagatagtgaagaatgatcttgcatctgttgtaccacaaaaccaaggaatagagtccagggcttctggattcacctcagcatgatctgt

SEQ ID NO: 17249 - DNA, 464 bp, Zea mays
  Clone ID: LIB189-022-Q1-E1-B11
ggggccagcccgcgtccggacgcagcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagccgttccgcgagtgcgagctcatccacggccgctgggccatgctcgccaccctcggggccct

SEQ ID NO: 17250 - DNA, 331 bp, Zea mays
  Clone ID: LIB189-022-Q1-E1-B2
cccacgcgtccgggcgcgggttgccgagacgcgtacgcggcattctccttgggtgcgggggttcctctcgagtctcggcaacgacgaaaacgaaaataccgagtcgagtcagcgatgaatcccttcgccaaaaaaccaacaccgcgagaggtgatgcggagcagcaagcgggacctgacgaatgctacgcgagggatcgagagggacattgcgtcattacagcaggaggagaagaaactcgttgctgaaattaaaaggacagcaaaaactggcaatgaggcagcaacgaaaattctagcccgtcagctgatcaggttaaggcagcagattt

SEQ ID NO: 17251 - DNA, 302 bp, Zea mays
  Clone ID: LIB189-022-Q1-E1-B3
cacgcgtcagcaaacgcgtccgtaaacaaatggaaagacgtggcaaatgattcacgcaaacaattgcatgacaaagaacaggatgttctagacctgcggcaagaagttattgggttaaaacattctctaaaagaggctaacgaccagtgcatacttctgttcaatgaagttcaaaaagcctggacagtttcatcttcactccaagctgatctcaagtctgaaaatttaatgcttgcccagaagcacaatactgagaaagagcagaatagacagctaagggatcagatttctcatcttttgaa

SEQ ID NO: 17252 - DNA, 347 bp, Zea mays
  Clone ID: LIB189-022-Q1-E1-B4
acgggctcgccatgctcgccatcctcggttacttcatccaggggctcgtcaccggcgttggcccgttccagaacctgctcgaccacctcgccgaccccgtcaacaacaacgtgctcaccagcctcaagttccactagaacgttggtgcatcagcatacctgctgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggtaaatcaatgtacaattcctccct

SEQ ID NO: 17253 - DNA, 409 bp, Zea mays
  Clone ID: LIB189-022-Q1-E1-B9
acgcgtccgcagacgagtgggcggacgcgtgggcaacaacgacgggaactggaggaactgagcggtggggtccgctgaggcctagttatcttgttcgcttctgctaccgtgttcaccctagtctagagggggtttatcttcgtctgtggtcgtctcgtgtccgtttgtttcgtttcgtgttcattgttgttgttgcccatctgtgtttttgaccgcaagctcgctcctctgatgttgttagtgatgtctacaatcgtccaatcccgagcctgcattgagctccaccgattatcttatctggctatacctgcagttgtgcatttgattccgacgggcctaaacctgaacacgccaatattaaacattgtacaaactacaagtgctccaataaagaacacaaagattcagg

SEQ ID NO: 17254 - DNA, 368 bp, Zea mays
  Clone ID: LIB189-022-Q1-E1-C1
ccggctggacccacgcgtccgcaagaagttcttgaaggttcacgttgaggctgaccagatcgtcgcttggttgaaggagtactttgatggcaaattgacgccgttcaggaagtctgagcctattcctgaggtcaacaatgagcctgttaaggtggttgtcgctgacaacgtccacgacttcgtcttcaaatctggcaaaaatgtccttattgaattctatgccccctggtgcggacactgcaagaagctggcgcccatcttggacgaggcagccaccactctccagagcgacgaggaagtcgtgattgctaagatggacgcgactgccaatgacgttcccagtgagtttgacgtccaaggctacccga

SEQ ID NO: 17255 - DNA, 438 bp, Zea mays
  Clone ID: LIB189-021-Q1-E1-H10
ttcgcgcggtccacccacgcgtacggatgatcttcctctctatgacattctaaatgagttccagaaaggtcacagccacatggctgtggtagttaaacgaacaaaggaagcaggagtatccactgaaaaccaaaagagcacaactgcagattataaaataaacccaaagatgctcatgctgatggctcatccccttcttatgctaacaacactgctggaagtcgtagatttaacatagagaagcatggagacgggcgctcatgtaataagaaatcagaaaagaagcgggaaaatattcttgattttaacacagatccacttccaagctattcaatggatgaggcggcaatccgaataatcacgatggaaaatgttatgggagaacttctacaggaagaaatctatgatgaaacagatgagtatgtttaagttcaaaac

SEQ ID NO: 17256 - DNA, 283 bp, Zea mays
  Clone ID: LIB189-021-Q1-E1-H12
ccacccacgcgaccgcaaacgcgtccgcggacgcgtgggcgacgtgcggcatgggtgggaggcgcagcaacgggcagttgaagttctggggcttcgacgcgcacaacgaagccgtcgagcaacgacgcaagcgatctgctcgtctgcaccggtatcgacgtcgaggtctttacggcggaggtggtcgattccagcagcatcgctgagctgaggatctactgcagacttctcgggaacgacgactttgattgcgtgagcctccactctggccccgaaatccggc

SEQ ID NO: 17257 - DNA, 346 bp, Zea mays
  Clone ID: LIB189-021-Q1-E1-H5
aaggacaggcagcggttcgggtcgtcgcagctgctgcacgattttgtggcgtgagcggctgcactggacgtcgttggggaataacgtgcgcggacggcgtcagaagcctgggatggccggccggcgccgccgcgggtatacctaccaaccatatgatggccgtcatggtacatggtctcaaattaaccagcaaggttaagcatgcatatatacatacacacatatatatatataaggtgtggtaagtgaggtagcataagcagggtaagctgtatatgatatgaggtgtggtataaagtgtagggattattattggtattatttttggtagcttgaagattcgtct

SEQ ID NO: 17258 - DNA, 342 bp, Zea mays
  Clone ID: LIB189-021-Q1-E1-H7
aggacgcgtgggcggacgcgtgggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgca

SEQ ID NO: 17259 - DNA, 423 bp, Zea mays
  Clone ID: LIB189-022-Q1-E1-A10
ggggccagccacgcgtccgaaaaaacacactagtgtaccaacaatggcagccaaaatattttgcctccttatgctccttggtctttctgcaagtgctgctacggcgaccattttcccacaatgctcacaagctcctagagcttcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattggcacaaaacatcaggggacaacaactacaacaacttgtgccagcataccttgctggctactctcagcaacatcagtttcttccattcaaccaactagctgcagtgaactc

SEQ ID NO: 17260 - DNA, 447 bp, Zea mays
  Clone ID: LIB189-022-Q1-E1-A12
ggggccagccacgcgtccgcaaacgacgtccgcggacgcgtgggcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcagccctccgccgtggctcgacggcagccttcccggcgacttcggctttgattcctggggcctcggatctgacccggagagcctgcggtggaacgtgcaggcggagctggtgcactgccggtgggcgatgctcggcgcggcgggtatcttcatcccggagttcctgaccaagatcggggtcctc

SEQ ID NO: 17261 - DNA, 424 bp, Zea mays
  unsure at all n locations
  Clone ID: LIB189-022-Q1-E1-A2
agcacacgcgtccgatccgtttggatgatgcgcaacattattcacttcaacacattggcaaatcaggctgtggagcgggcagctggtactgacggccataagataacatacagtgtcataaagcatcggttgggggatctattttatcgcctagtatcccaaaagttcgaggatcctgcagaaggcgaagaagctttggtcggcaagtttaagaaactgtacgacgaccttaccactgggttccgcaacctagaagatgaggcacggtgaactgctgtagattttgtgtaagacaataatggctgccaaatggtttataaggtacggaagttgtanattgagaccatgtttgagaattttccccaacggtaatcaattccttggcaacaacaattttagccatcattgctggatgggcaccctg

SEQ ID NO: 17262 - DNA, 349 bp, Zea mays
  Clone ID: LIB189-022-Q1-E1-A3
acgcgtcagccaacgcgtccgggaccgttaactctccagctccccctcgctccgttcccttccgcccaaatcactgggaccaccaccgccttcttcaagatcggcgggcgggcaccggccggcgatgacatccaccgtcaccacaaccgttgggtgcggggggctccccgtccgcccgttgtcgacagcgaccagaggacgcccacgcagatgcgccgtccgagcccaggccgcgggagcggatgcctccaatgataagtcagtggaggtcatgcgcaagttctccgagcagtacgcccgccgctccaacactttcttctgcgccgacaagacagtcactgccgtcgtc

SEQ ID NO: 17263 - DNA, 340 bp, Zea mays
  Clone ID: LIB189-022-Q1-E1-A4
cccacgcgtccgcggacgcgtgggtttttttttttttttttttttttttcaatctgaaaacacatgcactgatgcacacttgtgtttgtgtagaggcgcttatatatcatccaaaagacaagtcactcacacgcaaattcgcattggctaacagaagctatttggaatgcagttcagtcgactaacaacgtaggtacccccgtctccttgttttgccgatgttggcgatgccatcatatgtcagcagcaaggaagttgccagacaaggaaacctgccaatcggagaagcagcagcagtgaacgttcaagatccagagtacaatcgacagacatattttga

SEQ ID NO: 17264 - DNA, 232 bp, Zea mays
  Clone ID: LIB189-021-Q1-E1-F4
cgcgtccgaccacgcatccgcccacgcgtccgcccacgcgtccggactagttctagatggcggtggcgctttctccggcaaggacccaaccaaggttgaccgcagcggagcctatgtcgcgaggcaggctgccaagagcatcgtcgccagcggccttgctcgccgcgccatcgtccaggtgtcctacgccatcggcgtgcccgagcctctctcggtgtttgtcgacacgtac

SEQ ID NO: 17265 - DNA, 397 bp, Zea mays
  Clone ID: LIB189-021-Q1-E1-F5
atccctccgccactcccatccatctcctcgctcccagtcccccggaagctacgaagcatggcgtccgtcaccgcccgcgccccggtcgcggcccttcgcccgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccggggctgatcaaagcgccg

SEQ ID NO: 17266 - DNA, 342 bp, Zea mays
  Clone ID: LIB189-021-Q1-E1-F7
agccgccctttttttttttttttttttttttttttttttttttcaaaaatagttcatcttttatttaattatccattactcactgagcagaggtggtctctacaccctcaaggccaagcccttacaacacaccagcatatttctcagttaacccgttgaattaggcctctttaagcttcttgacggacattgctgtcagaagcgaatcagacccagcctgatggcaaattccaatccttgaaacatcaatgcagtaggcaccatccgtgggtcagcatcagcagcagcagaagttcttcatccgcgacgataagccattcatgagccacatggggtacatca

SEQ ID NO: 17267 - DNA, 449 bp, Zea mays
  Clone ID: LIB189-021-Q1-E1-F9
gccacccacgcgtccgcagacgcgtgggccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggccaccgcttctcctccgcctccgcctcgggcagccgcctcctccatgacggcgcctggcgccccttctgcatcttcacctccaaccgccagcccgagcagcaccgcgggagccgcagcgaccgccatgacggaagcgactacaaaca

SEQ ID NO: 17268 - DNA, 361 bp, Zea mays
  Clone ID: LIB189-021-Q1-E1-G11
gtaccggtacgtacattcgcggcgtcacccacgcgtacggaccttgtcatgcagataatgatttgttttgagaccagagtagtctagagtagagattaggctctgtaaaattagatagctaggattagaataactgggcaaacgaatatatggtatatgtcgatatgtaaagatgcaatatagagcagcatatatggtaccgtcgttattagcattttttcagaaaatgtaataatattcaaaacacaaactacggggcatccttgttggcaaacagcttgaggacgggccagacgcatgccgactacaagattccaatacagataggaagctgcaccttgctgctccgtcgcatggaaag

SEQ ID NO: 17269 - DNA, 362 bp, Zea mays
  Clone ID: LIB189-021-Q1-E1-G2
gggtccgaggacgcgtccgaccacgagtccgggtgctcaggatgcacccgccgggcccgctgctgtcgtgggcgcgcctggccacgtcagacgtgcacgtcgacgggcacctcatccccgccgggaccaccgcgatggtgaacatgtgggccattacgcacgacccagacgtgtgggccgagccgacggagttccagccggagaggttcatggggtccaccgagttcccgatcatgggggtcggcctcaaggcccccccgttccgggccggccggcccaactggcccgggaaaaacctccccatgggcaccgtggccttctgggtcgcgaccctgctgcacgaattccagctgctcccctcg

SEQ ID NO: 17270 - DNA, 432 bp, Zea mays
  unsure at all n locations
  Clone ID: LIB189-021-Q1-E1-G5
aatacactagccctgatgtcccaggttttatcctagcaacaggatttggtgcatcactgtatttcctggcaaagaaaaatatgaacttaggtaaggctgcattgatcactgtcgggggacttgcagctggtgcaactgtcggatctgcagtggaaaatttcctgcaggttgatatcgtgccctttctaggcatccactcccccgccgtcgttgtcagtgaatttattctgttctcccagttgttggtatcactgtttgttaggtaggatctgaaatcaagctgtcatcctgatcatggcatgtaagtaactgaaatggttcgtgttcaaacttcaaagggtcagggaaatgcttattttccgctcaaggtgcaagcagctgtgtatagcanacaatacatggacatctctgtcccttataaagatcacttgt

SEQ ID NO: 17271 - DNA, 425 bp, Zea mays
  Clone ID: LIB189-021-Q1-E1-G7
agctgtgctcactgcctactttttcattctaggcattgttgctctctctgcaacactgcttccttctataaaacgttttcttccaaaagagtggaatgataatctcattgtctggcgtgctccacttttccactcactctcggtggagttcacaaagtcccagattgttgcttcaatacctggatttttcttctgcttgtggtatgcgtcaaagaagcattggcttgcaaataatgttctgggattggctttctgtattcaggggattgagatgctgtcattgggatcatttaaaaccggagccattctcttgggtggactttttgtgtatgacattttctgggtgttcttcactccagttatggtcagtgtggctaaatcttttgatgctcctataaagcttctgttcctactgcggatgatgc

SEQ ID NO: 17272 - DNA, 83 bp, Zea mays
  Clone ID: LIB189-021-Q1-E1-D5
cgacccacgagtccgaccacgcgtccgcccacgcgtccgcccacgcgtccgcccacgcttcagcggacgcgttcacggtcgtg

SEQ ID NO: 17273 - DNA, 443 bp, Zea mays
  Clone ID: LIB189-021-Q1-E1-D7
accacgcgtccggtctgctagtgttggagagaagagaatacactacactacgcatggcgaagcagcagcagggccagggcatggcggcagtggcgctggtgctgctggtgctggcggcggcggcggccgagacggcgtcggcggcttcgtgcaacgccgggcagctggcggcgtgcgcgccggcgatcactgccggcgcgacgccctccgcgtcgtgctgctccaacctcaaggcgcagcaggggtgcttctgccagttcgtgaagaaccccacctacgggcgctacatcaacagccccaacgcgcgcaaggtcgtcgcctcctgcggcgtctccgtgccgcgctgctagtactagtacgtgtgctgtgcatgcatgcatgtacgtgcgcacgtgggctgatcttcctgcttgtttcgtgtcttgccgcgcgccatcaggtgt

SEQ ID NO: 17274 - DNA, 363 bp, Zea mays
  Clone ID: LIB189-021-Q1-E1-E12
cagacgcgtgggcggacgcgtgggcttccgcgacatgtccctcatgcgccgcatggagatcgcggccgactccctctacaaagccaagcttatccgtgggttctgccacctctacgacggccaggaggccgtcgccgtcggcatggaggccgccatcacccgctccgattccatcatcaccgcctaccgcgaccactgtacctacctcgcccgcggaggggacctcgtctccgccttctccgagctgatgggccgcgaggctgggtgctcccgcgggaagggcggatccatgcatttctacaagaaggacgccaatttctacggtgggcacggcatcgtaggcgctcaggtgcccctcggatg

SEQ ID NO: 17275 - DNA, 361 bp, Zea mays
  Clone ID: LIB189-021-Q1-E1-E3
ggtccacgacgcgtccgaccacgagtccgcccacgcgtccgaatcgtctctctcccgtcctcccctccaccgccgcagccgccgccgtacctcctcctcccgcgcagcagccaccgccaccgccggaaatgaagaccatcctggccacggagacgatggacatccccgagggagtcacggtcacggtggcggccaagctggtgacggtggaggggccgcccggtaagctcacccgcaacttcaagcacctcaacctcgacttccagctgcaggacgggggtcccaagcccaaggtcaacccctggtttggaacccgccgaaccatggccgcaatccgaacggccattccccagttcaaaaa

SEQ ID NO: 17276 - DNA, 363 bp, Zea mays
  Clone ID: LIB189-021-Q1-E1-E5
aaaagggtgaaagaaactgtgaaggaggttggtgctgggctagagtgtggtattggggtagatgacttcgatgaatgggaggaaggtgacatcatagaggcattcaataccgtgaataaggcaagaaccctcgaggaggcctctgctaccgtgactgccgcactcaaggatgcaggggtccagctgtagaattggcaacacgctgatactcttttttattaatggtatgaaatgttaatttatatatactttgaagctgaatggtgagctgaagctattgtgctgaagctgttgtgagctggaccggtggaccgtttccctgattccttcggtggtggctgaagctgaatggtgagctgctgg

SEQ ID NO: 17277 - DNA, 134 bp, Zea mays
  Clone ID: LIB189-021-Q1-E1-E6
aaaaaaaaaaaaaaaaaaaaaaaagaaaaaagaaaaaagaaagggaggcagcgtcgatagcgatcatagcttactttatcgtcaaaacgaaggtctctgctcgacaatgtcgtcactgtatttcacttcactgg

SEQ ID NO: 17278 - DNA, 367 bp, Zea mays
  unsure at all n locations
  Clone ID: LIB189-021-Q1-E1-E7
accacgcgtccgcccacgcgtccgaaacttcttcgtaatactaaaaagttttattcaggtcacgnagcttattgatcgtaattcgtacaggagctgagtgcgtgcacgtacgatggccaagtacgatgaccctgcagaaccagtcagccacagcaatccacacatgcacttcgacgtcacacgggcgctgcgcacagacacaccaagcgtcggcatcagtggcttactaccaggaggtggactacagctcggaggaggtgaggtcggtggcccccgccggagtcggccgccacggcggcggcatccaccaagacgtcgtcagagagagcttcccggaggtcgacacgggcccaagcgccggcgccac

SEQ ID NO: 17279 - DNA, 301 bp, Zea mays
  Clone ID: LIB189-021-Q1-E1-E8
cgcgtccgcccacgcatccgctagttctaaatcgctagtgggacctttttttatgtttttctgcccatttttattgctgtgcaacaactccatgttattcgtggctgtggtaataatgctctcttcttgggcttcataagcataattcttggtctccgaaaataattcccaccatgtgtaagagcgccggatcatgggcatcctccgcgaagtaaatgttctacacctccacaaatcattacttcaacctcacattcatttcctctacggtaggaataaccttggcttaggtttcaaacct

SEQ ID NO: 17280 - DNA, 426 bp, Zea mays
  Clone ID: LIB189-021-Q1-E1-F11
cccacgcgtccggatcgttgctgttcgagcggggtaagcttagccagcctctagcaagagcaagagcaagggcaaagggcatggcggcggctgtctccttctcccgggtgcgagctctcccgacgtggtccagctcggtttccggcgacgaccaccacgcctactccgtgttggcgacgtcgtcggtgtcagccagacctcggtctggcgcgcgaccgctgcggtcgccggcgcagatgatgggcaacgtgaacgatggcaaggggctgttcgcaccgctcgtcgtggtggcgcgcaacatcattggccgcaaacgcttcaaccagctgagggggaacgcaatcgcgctgcactcccaggtcatcaacgagttctgcaagaccatcggcgcccactctaatcagcggcagggcctcatccgcctcg

SEQ ID NO: 17281 - DNA, 421 bp, Zea mays
  Clone ID: LIB189-021-Q1-E1-B9
cacacgcgtccgcccacgcgtccgcccacgcgtccgaaaaaaaaaaaaaaaaaaaaaaaaaaaaaaaaaaaaaaaaaaaaaaaaaaaaaaaaaaatagggaggccactctaagggttagaaactttattttggcttccatgcaatgtcatttcttttttattctggccgtcaatttcaattccctggccttcgttttatacccttcttttcgggaaaatccctttcttttcccattttagttttgttacatcccgtctctttttcaagttctgggtttttatccatgtgcccctttcggttcccccttttctacatttgggccccctttttgtcgactttaatttcccttggggggtgtcattaattccgggggttttcctggttccgttcaacttgtccgggcccctttgcttctccctt

SEQ ID NO: 17282 - DNA, 428 bp, Zea mays
  Clone ID: LIB189-021-Q1-E1-C10
cagacgcgtgggccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaggagctgc

SEQ ID NO: 17283 - DNA, 411 bp, Zea mays
  Clone ID: LIB189-021-Q1-E1-C12
cccacgcgtccgcacacgcgtccgcggacgcgtgggcggacgcgtgggcggacgcgtgggcaaggctatggaggaagctgatgtgaagactaagtgggagaacagctcatggggcaagaagctgattgtccagaagaggagggctgcactcagtgactttgacaggttcaaggtcatgctggcaaggatcaagatgggtggtgctatcaggcacgagctctccaagctgaacaaggcgtccactgcttaagtcccttttggtggatgacatgttagtttttggtttcatgttggatcagcaatttgttttgagtgttgtcaaagccagaattagtaatatgtttcctgtgtaccagtttcaaactgtcatcaaaatgggtgtgctctggatattttgtccggaatgatatg

SEQ ID NO: 17284 - DNA, 316 bp, Zea mays
  Clone ID: LIB189-021-Q1-E1-C8
aagacgcgtgggtatctctgcagaatgaacaggagtgggcaatatgtatgggaagatcaccgaccgcgatctggtgtctggaaaggcactagtggtggggaagctatttcctttaatggttgtgatgatgatcagacctctgcagatacctctgctttatcaaagatcacttcgactggtgcaatgacattctgcttcatccaagctattgaacgtggacagggcaccacctacggtagtatcctgaactctatgcgttccacaatacgcaacacaggtgactcagcgggtgtatgtggccgtgctgttacatcac

SEQ ID NO: 17285 - DNA, 368 bp, Zea mays
  Clone ID: LIB189-021-Q1-E1-C9
ccacccacgcgaccggatacacgaccggcatcaagatgtgtactgcccagtatcctgatcatttccctaaggactaacttagtggccatttatggagcagtttactcagcggtagacacattgggcgaccgctacgacgaacgcaaaggtaagggatcacgcagggcatctcactggcccgttcggtagggcttacatgagagaggaaatgcgactggcatgcctatgcgcctgcatgtggcgctgcaggcggatcgtaaagagccaggtgaacactcaccgcatccctcgctcctgctgctgggcatgctgccagggagacgctgctggacagactacctaactgcacagctgagcagagagacgag

SEQ ID NO: 17286 - DNA, 86 bp, Zea mays
  Clone ID: LIB189-021-Q1-E1-D10
cacgcgtacgcacacgcgtccgcccacgcgtctcggatcctccccatcttttgtttgatcttcacccttttgttcatggtcctagg

SEQ ID NO: 17287 - DNA, 420 bp, Zea mays
  Clone ID: LIB189-021-Q1-E1-B8
accacgcgtccgcccacgcgtccgagctggagccggaggccaaggcgctccttgaagcggcgctgacggaagccaacatggagagggaggagaagatcctcaggggcaccaagcactctccgcatcctcccacctgggaccacgcgagcgacgccgccgacgccgacgccatcgacgacgcgtcctcagatgccagcgccagcgacgcggagctgtgctgcatctgcttcgaccaggcgtgcacgatggatgtgcaggactgccggcaccagatgtgcgcgccgtgcacgctcgcgctgtgctgccacagcaagcccgacccggtgacgctagcgctgccgtcgccagcctgcccgttctgccgcggcagcatctcgcggctgctgctggtggcccgggcaagcagcgacgacgcagaca

SEQ ID NO: 17288 - DNA, 403 bp, Zea mays
  Clone ID: LIB189-021-Q1-E1-A10
cacacgcgtccgacatgttgtgctccaatacaactgtaccaatacaattcctgaacaattgcttgaacaggttattgtttttgttgatgcttctgaggctgatgaatttttagaagttgcttcgaagcctttagaatcattaccatatgattctcctgggcagacctttgtcgcttttgagaagccagaaggtgtcattgctactggcaagttctcaaatatcctgaaattcattgttaaggaggttgatccatccacgggtgaaactgaagatgatggtgttgaggatgagtaccagcttgaagatcttgaaatagtttctgctgattatatgttgaaggtgggagtatctaacttccgaaatgcctgggaaaacatggattcagagactgagcgagttgat

SEQ ID NO: 17289 - DNA, 393 bp, Zea mays
  Clone ID: LIB189-021-Q1-E1-A12
caccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggacta

SEQ ID NO: 17290 - DNA, 441 bp, Zea mays
  Clone ID: LIB189-021-Q1-E1-A6
atggcacacagcttgcagaatacacacagccttatattgagtcagggcttgtgatagtagcgccggtgaaacatgtaacttcaagtgcatgggctttccttgaacctttcacattggagatgtggtgtgtcacagttgctctttttattttggtgggcatagtagtgtggcttcttgaacatcgtactaatgaggaatttcgagggtctccaaggcgacaagtcataacaatgttatggtttagcttctcaacaatgttcttttcacacagagagaacactgtaagcacacttgggcggttcgtgctgataatatggttgttcgttgtgctgatcatcacttcaagttacacagctagcttgacgtcaatcctcacagtccaacagctctcaactggaattacagggattgatagtttggtttcaagttctttacctattg

SEQ ID NO: 17291 - DNA, 344 bp, Zea mays
  Clone ID: LIB189-021-Q1-E1-A7
aatggcacacagcttgcagaatacacacagccttatattgagtcagggcttgtgatagtagcgccggtgaaacatgtaacttcaagtgcatgggctttccttgaacctttcagattggagatgtggtgtgtcacagttgctctttttattttggtgggcatagtagtgtggcttcttgaacatcgtactaatgaggaatttcgagggtctccaaggcgacaagtcataacaatgttatggtttagcttctcagcaatgttcttttcacacagagagaacactgtaagcacacttgggcggttcgtgctgaaaatatggttgttcgttgtgctgattatcacttc

SEQ ID NO: 17292 - DNA, 307 bp, Zea mays
  Clone ID: LIB189-021-Q1-E1-A8
acgagcgtgggctctctcctttctcgacgacgactgggccaccgtcgctgccgcctgccgcctgccgccctgcgccaggtgccaagcagccaggtgttcttggggcccttcgccggcgacgagcaccaccagctgaaagatggcgaggataccgtctctgaagagcctcaatgcgtttccacatgcggaagagcacttgttgaagaagacttactctggcgctgttgtgacaatttttgggctacttataatgattacactgtttgtgcatgagctgcagttttatcttaccaacctacacggggca

SEQ ID NO: 17293 - DNA, 354 bp, Zea mays
  Clone ID: LIB189-021-Q1-E1-B6
atcagcttactaggatgaagcctggaacggtggcactgctcattttgttgaacatgatgtgcatagttgcatactttgatcatggaagctttcctggaacgatggccgaagaaaccaccttgctggcaaattcgtatggaagaaatgaaggaaccaagggcatacatcgtggaagaaagctgatggacgccggtactgattcaaaccgtgggttttctatcagtgatatgcgtcacataatgagctcaggcaaccctcatccttagctccagctggttgcattccctaaagttcgtacatgtatagccttccactcatcatatgctgggtatccgacctatagacacatacggt

SEQ ID NO: 17294 - DNA, 104 bp, Zea mays
  Clone ID: LIB189-021-Q1-E1-A1
aagagagagacgcggagccaccgcgttccggagagagacgcggagagccaaggcaaggcagctgtcgccgcagcgacgatgtggagctcgggctctgaccgcga

SEQ ID NO: 17295 - DNA, 390 bp, Zea mays
  Clone ID: LIB189-020-Q1-E1-G11
agcccacgcgtccgggccagaaccctagtcacttccccgccgcccactccatggaggacgacgccatctcgacgctcatggacatcgacgactcgccgctcagcgctgcgggggccgggttcctcgacgaggaggacggggaaggcgagatgttcttcgccccgcaccgcgcggcccgcggcggcgctggcgatgcccgcgggcccctccccttttccgggttcttcaacagcttcgacggcgccgatttcgacgacgacgacctcgcctgagggaactgccgcccggttcggtaacggatgttgttcgtggatcgcgaatcgtgttatgtcgataccgtgatggggtctcttaattagcgcatcgattcagactcgtttgggcaatctg

SEQ ID NO: 17296 - DNA, 329 bp, Zea mays
  Clone ID: LIB189-020-Q1-E1-G12
gccatttgaaccccccacgtctcctcgcctcgttccccatttgctgcgtctccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgagaaggagtggtggcaagccacagacaccaagttccaggcctggcctcgcactggtgggccaccggttgtcatgaaccccatca

SEQ ID NO: 17297 - DNA, 417 bp, Zea mays
  Clone ID: LIB189-020-Q1-E1-G3
cggacgcgtggggtgagcgcgactggtgctctcttactaaaacacttctggacattcttgccaagagaagcctggccagcgaggaactatcaaaggagactatggagatgctggctgagattcacctcctgaacagagcagtaaaaagaaagagtaggaacatggtgcacctacttgtgaagttcgttgtaatttgccccgacaattccaaggtttaccccttccttccgaacttgcctggccctggtggtttaactccgctgcatcttgctgcgtccatcgagaatgcagaggatatagttgacgccttgacagacgaccctcaacagactggtgtaacctgttggcagacagttctagacgacgacggccaatctcccgaaacatatgccaagttgaggaaccataattcctata

SEQ ID NO: 17298 - DNA, 293 bp, Zea mays
  Clone ID: LIB189-020-Q1-E1-G6
gtctcgccaagtcgccatgatgcagcagcccccgccgcagcagccgcagccgggcatggcgccgcctccgcctccgcaagctgctggcgggcaaccaccgcaatggggtgggattcccccgccgatggggcaacagtacggggcaacgcctccgcagcagcctccggcgatgtggggccagcctccgccgcaggcgcactacgggcaggcaccaacccctcagcagtactacgccgcgccgccggtgccggtgcaagcgccagccgcccccgctgcggcggacgaagtcaaga

SEQ ID NO: 17299 - DNA, 259 bp, Zea mays
  Clone ID: LIB189-020-Q1-E1-H11
gtgcgctatgccgcagcttggatctcgccgtgggccgtgtcgtgtgtttcctcctgctctgctatgtatgtcatcactgacggtgtgtggaggttgggttcatatatatgcttgtaatgttagctggtttgaggtgtggactacgagagtacttttgttcagtgtctggtatctagtagctgaaggtgtttgcttgaactctgtgaactgtgatgtgggataatgctaagaagatgaatagatgatcgttgggttgtct

SEQ ID NO: 17300 - DNA, 421 bp, Zea mays
  Clone ID: LIB189-020-Q1-E1-H3
cgacccacgacgtagcggacgcgtgggcacgcgcgcagtcactcacgcacgcccccagctctctccttctccctgctcgctcgctcgccatggacgctccgagcagctggaagagtcctgcgcgcgccaagtgaccggagaagctgcgagatcagagtagttgcttgccgctcccgtgccaccaaattagattggacgtagctagcagctagctgagccgtagtgcgtatcggcagctaggctgctagctcgatcgttatagctgcgtactagtggtgtcgcagcaaaagcaataccagcttcagttaccgatccggtggtaaaagcaactttttttggacatggcggcggagggaggcccggtgctggtgaggcatgctggcgggctggaggagctgcggcagctcccgccggggttccg

SEQ ID NO: 17301 - DNA, 329 bp, Zea mays
  Clone ID: LIB189-020-Q1-E1-H4
aggcgatcagacaaggtaggcaggcactcctcacgagccggcggacgcgaacacgcagctgtttcctctcttcctcttcgccctctgcggctcctcctccgcaacagcgcgcgcgtatacctgtacgcattcagcagcgcacggcatgacgaagcaaaagatagtgatcaagctcagcatgccatctgagaagagccggtccaaggccatggtgctggtcgccagaacggacggcgtcagctcgatggagatcgccggcgacggcaaggaccatctggtggtggtcggcgtggacgtcgacaccgtctgcctggtcatgtgcctgcgca

SEQ ID NO: 17302 - DNA, 417 bp, Zea mays
  unsure at all n locations
  Clone ID: LIB189-020-Q1-E1-H5
agcgcctgggcaggtgcagccagcgacgtcgccgaaggcgctgttggaggttgccgtagaggtgcccgatctggagttgaagagatcttctaatgctgggagtagtgtatctgcagaacaactgcagtttgtccctatcattcgatctggtagctttgctgatattggacctaggcggttcatggaagatgagcatattagaattgatgatctttctggtcatcttggctcactgttgatggtctctgcgcctagcgcgttctacggggtgtttgacggtcatgggggttcagatgcagcagcctacatgaaaacacatgcaatgaggttgttctttgaagatgctgacttccctcaagcatcacaagaggataaaatatttgctgaatctgttgaggattcggtccgcanagcttt

SEQ ID NO: 17303 - DNA, 311 bp, Zea mays
  Clone ID: LIB189-020-Q1-E1-H7
ccacgcgtcagtaatccttggtgatagcacatcggatatcctcaagggaaattcatctcctcaaacttctgttaaagtggtgtcaccaaacaagaagcgaatctctcccctgcgaatgggtaccgggctatctccaatctgtaggagtggcaggaagctgattttaaagtccattccttctttcccttcccttggcggtgatgtaaacaatgaggatccagaaaccaagttgccagccccttgaatttaccatattttgtcactggtttatttctaccataccatctgatagtggacagccaagcgacttt

SEQ ID NO: 17304 - DNA, 356 bp, Zea mays
  Clone ID: LIB189-020-Q1-E1-H9
cggacgcgtgggcgaggtgaaggcccggctccccgccgtggagtacggccagctcctggccgagcacgacgagcagcagcagtccggcgaccacgactgcgacggggacgccgcgtcgtcggattgcatcgtgtgcctcgagacgctggaggcggcggacgaggtgcggcggctgggcaactgcgcgcacgccttccaccgcgcctgcatcgaccgctggatcgacctcggccgcgcgacctgcccgctctgccgctccgacctcctgccgcgcgcgccgggctgggccagccggctcggcctgggccggctcacgcgcgttcggtgaggaggaccgtcttccagggcagttttgt

SEQ ID NO: 17305 - DNA, 413 bp, Zea mays
  unsure at all n locations
  Clone ID: LIB189-020-Q1-E1-F7
agcccacgcgtccgcggacgcgtgggatctggatacctcgtggactttatggtgatgaggatacaaacggccacgttgacaacatgtgctgcttcatcaaacccggtgtgatcctgctgtcgtggaccgacgacgagaaggaccatcagtacgaacggtcggtcgaggcactgtctgttctctcccagtccgtcgacgcgaaagggcggcagctccaagtggtgaagatccacgtccccgggcctctgtacatgacagaggaagaggcacaaggcgttgtttcatcgggacattctgtgccgaggccagcgggcacgagattggccgcctcgtacgtcaacttctacatcgccaatggcgggatcatagcgccttccttcggcgacaggtgggacgangaggcgtacgcggtt

SEQ ID NO: 17306 - DNA, 387 bp, Zea mays
  Clone ID: LIB189-020-Q1-E1-E11
agcccacgcgtccgagggaaagatccttgaggtgttgaagaactggccagagaggagcattcaggttatagttgttactgatggtgaacgtattttggggcttggagatctcggatgccaggggatggggattcctgttggtaaactttccctttacactgccctgggaggagttcgtccatctgcttgcttgccgatcacattggatgttggtacaaataacgaggagctgcttaatgacgaattttacattggcttgagacaaagaagagccactggccaggagtacactgattttctgcaagaatttatgactgctgtgaaacaaaactatggggagaaagttcttattcagtttgaggattttgccaaccataatgcttttga

SEQ ID NO: 17307 - DNA, 377 bp, Zea mays
  Clone ID: LIB189-020-Q1-E1-E12
agcccacgcgtccgtgtctgggacagtcgttgggtcgtctgctgggactgggagcaaccgcagatacgtccatgacaagtgctttgcagaattccacaagtcgctgacgctctacactgaacatctcagggctgagtttgctgcaaacacaagacgagtgatggagctggaaacagaagacgagatcgtgcctagcatagcagctagcgtgaaatcgtgttgaaggcaaatgccccacggtgttgtatgttgctctcatcatcagatatttgctggcttagctatttccagcctcattctacttcattcatgtcacttgaataatccaattcatggcaatttgtactgtccctaaacctagatggcctaaaatccga

SEQ ID NO: 17308 - DNA, 401 bp, Zea mays
  Clone ID: LIB189-020-Q1-E1-E2
agcggacgcgtgggcggacgcgtgggccagattgggggttccttggttcctcgtcgagttgctgcttctgagaagaggcaacggaaactgaagagtggacaaaagttgcgccggtttcaggagagctcttacatggatccaaatcaaagtctttgccttggagcactatttaacatagcagcaacaaatggcctagacatgggcagaagattatgcatctttggcttttgccgttctattgaaatgttaagcgatgtagtggaagatacggtattggagcatggcggtgaggttgtcactgcagagaaagcaagcagtaacggcctccaggagaagccaaccatgtctgtcccagttacattgctgtggggcattcctccagcatcagagaccctccatgt

SEQ ID NO: 17309 - DNA, 407 bp, Zea mays
  Clone ID: LIB189-020-Q1-E1-E3
cccacgcgtccgatttctggtgaggaacctgatgcggaagttgtggagaacctgctccaaagcattgagaagcacacgctcgccagccatctagtatggggcctctggggaataatttcggaccatgttaacgacattgacttcgactacaaggagtatgcgaggcagagattcgagcagtactggcacaagtctgcgatcttaacatcttgaacatgtgtataaacacccgtacgtggtctcaggaactccctgagggcctgtggctgcacacacgaaattgtgcagtgccactgacacatagataagctgtgaaagaagaaatactgacgacgacgacgaataatcccgttttgggctcgggaggttatttctccgcaactcgatgagcttcaggcttcagcttc

SEQ ID NO: 17310 - DNA, 221 bp, Zea mays
  Clone ID: LIB189-020-Q1-E1-E5
ccacgcgtaaagcaacgcgtgggccgacgcgtgggccagattgggggttccttggttcctcgtcgagttgctgcttctgataagaggcaacggaaactgaacaatggacaccagtggggccggtttcaggacagctcctacatggatgcagctcaccctctttgccttggaccactattcaagataccagcaacacatggcctagacacgggcaccaagat

SEQ ID NO: 17311 - DNA, 424 bp, Zea mays
  Clone ID: LIB189-020-Q1-E1-E6
cccacgcgtccgcggacgcgtgggcagcccaatgctaatgaccaatacttgcccccatttgtgatagttgatgacagcggcaaagctgttgggcctgtattagatggtgatgcagttgtcactatcaacttccgggctgatcgcatggttatgcttgctaaagcactagagtatgcagattttaacaattttgaccgtgtacgtgtccccaaaattcgatatgctgggatgcttcagtatgatggtgagttgaagcttccaagtcgctaccttgtttccccaccagagatagatagaacatctggggagtacttggtgaagaatggcatccgcacctttgcttgcagtgagacagtgaaatttggccatgtcacatttttctggaatggtaaccgctcgggatactttgatgaaactaaggaag

SEQ ID NO: 17312 - DNA, 323 bp, Zea mays
  Clone ID: LIB189-020-Q1-E1-E7
cacgcgtcagcgaacgcgtgggagaccaataagcagcatagaaagtggaatacagtagcaacaatagagcaacaatggcggccaagatattttccatccttaagctccttgctctttctgcaggtgttgcttacgccactatttttccacaatactcaaagctccgagtgctgcccgtcgtcattcatacattccatcaatgagtgcttgattatgtgaacatgcagctctttatacctacaggttcgtgctcgcaatcgcaccaagcaggccagtttcagcagacccgttcttgtaaaatgccgccagccccatctttggtc

SEQ ID NO: 17313 - DNA, 292 bp, Zea mays
  Clone ID: LIB189-020-Q1-E1-E9
agggccatagggcgatgaaggcgccagttccatctgttcttcaaagagagagtggaccagatcatgcacagggatgatccaatgaagcagctaccgcttgccagtccaatgagatatgtatatttttgtaaaggagatacatcgtcggcagatttttttttctgtgctgtctttcttgttcgtaagaaatgtatagaccttcgagttctgttgtgcatttgagctccgtcatgcatggttgcttctgatgtgaggcacgattattgaagagacctctcgtttgctgctcggt

SEQ ID NO: 17314 - DNA, 410 bp, Zea mays
  Clone ID: LIB189-020-Q1-E1-F1
cacgcttttctaggactgcgggcaggagtttcctgcctctgccatgtaagtcggatgtcctgtatgtgtcagatccatgcgagcatcttgatcagggggaagaaggcgacataggtttcttccgaggcatctttatgtcatttgccacttcaagggtaaagaagatgttgattgagaagcgggcgaggtttcatccaagggagttgtgcccttattgtaaggccaagctatggaacatgtttcaggaaaatatgatcccaaggagtgcttccgcaaggctgggtgcctatgatgactctgtggagtattttgtatgcctgaatggacatgttattggactcggtaccctactaccactctcagactcagaggaggcagcagatgagtgatcatcaggagcatgaatcagg

SEQ ID NO: 17315 - DNA, 383 bp, Zea mays
  Clone ID: LIB189-020-Q1-E1-F10
cggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgagcgccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggaaccctacgtggtcacctccatgatcgccgagaccaccatc

SEQ ID NO: 17316 - DNA, 398 bp, Zea mays
  Clone ID: LIB189-020-Q1-E1-F11
agcaacaagagtagtagtcggagccgtccgtagtagctagcgtacgtacgtgtgagtttgtgaccaattcagagaagcctcgatcatcgttcgcttcgcttcgcttgtgtgtcgatatatatggcgagatcgccgtttgttccgatggatcaggggaaagagcaaggcgccggacgaggagcggccggcaataataaggagcggcaggaggaggaggtgctgctggtgcacagccaggtgcggcggatcaagaaggaggacgaggaggccttcagggagcgcctcctgaagctgcgcctgctggagacccggcccaacaccggcgccggcggcgtggcctggcgagccccgcgctccctgtcgccgctccgccgtgccggcagcgccatcatcccggt

SEQ ID NO: 17317 - DNA, 369 bp, Zea mays
  Clone ID: LIB189-020-Q1-E1-F12
ccaacgcgtccgcggacgcgtgggcggacgcgtgggctagtctcctcttcgcacgagcgcaacaccatccacccaccagttcgaagcggaggcgaccggcaacctgcggcggagatgtcaggcacgggcaatggcggcaaggggctcgggaagggcggcgcgaagcgtcaccggaaggtgctgctcgacaacatccaggggatcacgaagccggcgattcggaggctggcgaggaagggtggcgtgaagcgcatctccgggctgatctacgacgagatccgcggcgtgctcaagatctttctccagaatgtcatccgcgacgctgtgacctacacggagcacgcccgtcgcataaccctcaccgcctat

SEQ ID NO: 17318 - DNA, 116 bp, Zea mays
  Clone ID: LIB189-020-Q1-E1-F4
acgcgtcagccaggttctcgccatgggcgccggcgccaacaaccacgaggagtcgagccccctcatcccagctgcggttgccgcccccgcggatcgagaagcccccgcaggctccg

SEQ ID NO: 17319 - DNA, 403 bp, Zea mays
  Clone ID: LIB189-020-Q1-E1-F5
agcccacgcgtccgcaagttccctggccgccaaaagattattgagagcagaaagtggtgagtgcatgatgaattcattgctgccatgaaaccaaaatgccatagcctaatagcttgcataagttattttttattattgttttttgatttgcactgtcttgtccaggggcttcaccaagttcagccgtgccgactacctgaagtacaagagtgagggtagaattgttcctgatggtgtcaacgcaaaggtacagctatcacatatcttgctacatttagatatatctctgaattagttttgggatagtaatgtaatttccattgatacgcatattttgaaatggagctattcttacaatgtttgctccgtcttctcttcggcagtatattaaccagttcataat

SEQ ID NO: 17320 - DNA, 393 bp, Zea mays
  Clone ID: LIB189-020-Q1-E1-E10
agctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccg

SEQ ID NO: 17321 - DNA, 184 bp, Zea mays
  Clone ID: LIB189-020-Q1-E1-B7
ccacgcgtcagctaacgacgacggaaacagtagtgctgccagtacagctctcagaactcgggaaaaaaaatgtcagaggccgccgtgcgtgtgatcggcctatggccgagcccgttcgtgatccgcgtcctgatccccctcaagctgaagggcgtcgagttccagttcgtggaggccgtccccg

SEQ ID NO: 17322 - DNA, 361 bp, Zea mays
  Clone ID: LIB189-020-Q1-E1-B9
agccaacgcgttcgaccagacgcagatggacaagctgacgctcatgctcgacccccaggacgagttcgcctggaccgacgaggcctgccagatggtcttcaacgagttccaggacctcgtcgatcactacgagggggctgagctgtcggagtacacacttcggttgatcgggtcagaccttgagcactacatccgcaaactgctgtacgacggggtgatcaagtacaacatgaggtccagagtcctcaatttcagcatgggcaagcctcgcatcaagttcaacagcaaccagataccagaaaagatatagaatgtacttatccaacgcccttaaaagaatggtttctctccattcgattaa

SEQ ID NO: 17323 - DNA, 374 bp, Zea mays
  Clone ID: LIB189-020-Q1-E1-C1
agcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgccgcccgtggaccacgccgccgccgcgaggaggccccggaagacgaaggccaacagggccgcccagctgccggggggctgctgcgggtg

SEQ ID NO: 17324 - DNA, 388 bp, Zea mays
  Clone ID: LIB189-020-Q1-E1-C11
agcggacgcgtgggggaaaacatgccgccgccgccgccggtgaatccacagcggctttcgccggcagagtcccgagagcggacgctgtacttcttccatggtctgggcgtggacgtgcccctcccggtctcggccgagcggcccgacgcctacacctcgctcgtccgcgccatcgtctcctccgccgcagtcacctcctcgcgcgtctcctgcaccctcaccgtctctcccgccgtcgcgaaccagtacaacacgctccacggcggcgcggtggcggccgtggctgaggccgtcgggatggcgtgcgcgcgcgccgcggctggggacaaggagatgttcctcggcgagctcagcaccgcgtacctcgctgctgcgcgactcaactctg

SEQ ID NO: 17325 - DNA, 127 bp, Zea mays
  Clone ID: LIB189-020-Q1-E1-C6
cgacccacgagtcagcgcagctccgctcgtcgatcagctctcggctgatcactcatctccagtgggtccctgcccaccacgtcccgccgctgccaccgccgcggtacacagggcagggagaggggga

SEQ ID NO: 17326 - DNA, 393 bp, Zea mays
  Clone ID: LIB189-020-Q1-E1-C7
cacagaatggttcaaaattccactctattgattgctttgcctgctaatgttactgttttatgatttgggagcaactttgccatattatcagacccatggatagtagcaagggggtttgcaaagccatgaaatttactaacttacccaagtaaataaacctgctttcctatgagtaccaacaatgggtttgtctggtttttttctttagttgtttggtctattatttttgttcacgcttcaggttagcttcactgttcatgctgactgattgtccaatataggttttatctaacctcacattaaccgggtttgccccaaaataaaagaacttggttcctgaagatgcaatcaatgaaaataagcctggctcattccttctggcaaatatcctta

SEQ ID NO: 17327 - DNA, 223 bp, Zea mays
  Clone ID: LIB189-020-Q1-E1-D10
agcggacgcgtgggcagtagtcgtcgcgtttgcagctaggcagatctgagttaacccgggggttcgattcgttgaccttgaatgtgggtcatgtgtgtctccgtggaaatagcaaaagttacacccccaatgggaaacacgtgataaaacaaaaactcgtttttgactccagggccatgggggcgtctagggcttctgtgctcacaaaaggggtccggggggt

SEQ ID NO: 17328 - DNA, 378 bp, Zea mays
  Clone ID: LIB189-020-Q1-E1-D11
aggagaaaaaggaaaggaaaggacaaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcattgacgatgcggaggctcagtacaggaacttccagcaccccgatccctacattgttccatgggcaccaggcggcactaaattcacaagaaacccccctccacctcaagggatcgagatcatctacaattatggcaag

SEQ ID NO: 17329 - DNA, 315 bp, Zea mays
  Clone ID: LIB189-020-Q1-E1-D12
agcccacgcgtccgctgggtccgcgctggtggagtactacgaccaccagcaagggtcaggatcgaaagttcaccaatatgcaaagcagttcctttcatctgatagcaatagcggccaacaaaaggagtagctagctagtgtccttgcgaagtgcaagcagcggagtgggcgttatttcctgatcaaataattttgcctatggcacattctgtggaaactttgacggatctttgcctgcttttctatgcgatgtaagctgctgaaacctgcactcatcaaatgttgtgtatgcagatggtaccatgcatttgtttc

SEQ ID NO: 17330 - DNA, 337 bp, Zea mays
  Clone ID: LIB189-020-Q1-E1-D2
cacgcgtcagaacaaatggaggcaattatggagctggcaactcaggggaaggaaaaggaagggatcaagaagaagggcagcaaggtgacacctctcaaggctcctatcattgaggctgctgagatgctctgagttctattatgagatgtgtgggtagttctagtgcatcatgttatgtcgccggtgtacttgcctatgagtcgcccaggatcttttgttggctgctttgtgtagcatgttgttgtccgggcagtggtgtttgtttctttggctggcaatgtctgtgtttcggtctatctcaatctcggttgtaagttgtttgttggtccccttctgg

SEQ ID NO: 17331 - DNA, 301 bp, Zea mays
  Clone ID: LIB189-020-Q1-E1-D3
gacccacgacgtacggctaagccttcctgcgagatgcaactgtttagcacacaacgcgtgctgtctcagacctagagaatccacaggagctgtgtacacaatgtgatgatgccccacgtcgggacaatgattcaatcgttgaccgcaagatctgctataaagggacacaagaacatttgaaggatagtatgaatcactcatggcgttgaaagttttgaggacttactactggtttgaggatacccacattcccgcgacaagtcgtggccaggcctagcctgagttatctacacgacctgaa

SEQ ID NO: 17332 - DNA, 126 bp, Zea mays
  Clone ID: LIB189-020-Q1-E1-D4
cacgcgtcagctaacgcgtccggtcacatgtaagctgatctgcgaacatgcttgaaatacttcagaaagacctcaggggcttgcactttgtttatgttcaggcctgtgtcaaatggcgctgctggg

SEQ ID NO: 17333 - DNA, 226 bp, Zea mays
  Clone ID: LIB189-020-Q1-E1-D5
cacgcgtcagcagcaatccacacaagcacttcgacgtcgcacgggcgctgcacacagacacaccatgcgtcggcaccaatggcttactaccaggaggtggactactgctcggaggaggtgaggtctgtggccccggccggcttcggccgccttggacgcggcgtccagcctcctgtcctctcggtcacgttcctggatgtctctgcggtctttctttcggtgttct

SEQ ID NO: 17334 - DNA, 319 bp, Zea mays
  Clone ID: LIB189-020-Q1-E1-D6
gacccacacgtaaggctttgccttcctgcgatatgcaactgtagagcaagcaaggcgtgctgtttcagagctaaagaatccactggtgcggggtaaacaatgtggtgttgctccaagtcgggacaatgatacactctttgtcgacaatagcggcaaaacatggacaacagaacatttgaaggataaactgaaaagttatggcgttgaaagttttgacgacttactactggttgaggatacacacaatcctgggatgaatcgtggctatgctttgcttgagttttctactcgacctgacgcaatggatccttccaggaca

SEQ ID NO: 17335 - DNA, 333 bp, Zea mays
  Clone ID: LIB189-020-Q1-E1-D9
gaccacgcgtcaggcagcctccagctcccggcggtcggcggcagcggccatgtcgtcacgcgcatgcgcgggttcgacgggccacttccgttctacctcgaaaccgggtacgtggaggtggacgagcagcaaggtgtgcagctcttctactacgtcgtgcgctcggagcgcgacccctacgaggacccgctgctgctgtggctgtccggcggcccaggctgctccggcatctccggccttgcctacgagataggacccttaaaatttgatgcccgagggcaaggtgaatttcccattcttctctaccgaccggagacatggaccaaggtgagc

SEQ ID NO: 17336 - DNA, 374 bp, Zea mays
  Clone ID: LIB189-019-Q1-E1-G8
atggttacgttggcggtacacatacagggccattggcccaaataatcgtttttcgcccttctaaccttgaactccatttccatactgcttcattcttgtaccaaactggccgtcaacacggcctcacctcggttcatccgtttcaattacacaggatttggctgatatccatggactgattcaaatcttacccgggttggcacatgtttatcgagacgttcaacaacggatgcagccctaggactgacgtcgggtcttacgctgaaatgtccgcggaaccccgatttgggaatcttcctacgcatattcatataagtatccccgcacgagagcatgggactgaatgatgcgtcacaagtctagacggcggtaga

SEQ ID NO: 17337 - DNA, 386 bp, Zea mays
  Clone ID: LIB189-019-Q1-E1-H10
gtgaaacaaagtcgtcgagcgctctttccctctctctatacctctctgtctgcgacgcggttggataggctaccgccgccgccgccgctaggtgccgactgccgaggccctcaccggcggcgaagagcgcccgccagcaatggcagcaagatgtagcctttcctcgtcatccttgtcggtacatggacccctccgccgcaataaacccagcaagagactcgctccatgcctgccatcgtcgccaagaccaggagccgctgctctgagagcgcgtgctgcgaaacttcctccaggggttgaagcgcccagggtgcaaccgaagctgagcgagcccttcttggggttcacccagaccgcggagatttggaactccaaggcctgcatga

SEQ ID NO: 17338 - DNA, 390 bp, Zea mays
  Clone ID: LIB189-019-Q1-E1-H11
cccacgcgtccggtagaagaggagtggcagagcagggtgtggaaggtgtgcgtgtacgtcatcaccctgggcatgctggtggcgctgctgctgggcctcaacatgtcgtggagcgccatcaccgccgccctggcgctcatcgtgctggacttcaaggacgcccgcccctgcctggagaaggtgtcgtacccgctgctgctcttcttctgcggcatgttcatcaccgtggacggcttcaacaagacgggcatccccagcgcgttctgggacttcatggagccgtactcgcggatcgacacgcccacggggactgccgtgctcgcgctcgtcatcctcctgctctccaacgtcgcgtccaacgtgccgacggtcctgctgctgggcgcgcgc

SEQ ID NO: 17339 - DNA, 377 bp, Zea mays
  Clone ID: LIB189-019-Q1-E1-H12
cggcccaacgcgtcagcagacccttgggcaaagatgacatggactttccgcggcggctggcaaaagaaaaaataatgggtggtcctgcaagatgtgccgtccggtacaaaggatgggctcccaacaaccttggcaatggttcaacctccccgggaaaaggggcttaaaaggtccaagtcctccggctggcgatacagaaagccaacaaattgataagataaagtcaccagttctatgcaacagagacaaaaattgttatgaacttctgcacagatatatgatattgtatcatcttcactcgaagatgacatgtttgatgctctttgtctatagtaaataaatgatgtctcttcaaaaaaaaaaaaaaaaaataaaaa

SEQ ID NO: 17340 - DNA, 393 bp, Zea mays
  Clone ID: LIB189-019-Q1-E1-H4
ggtccagggacgcgtcacggttaggaagagctagtacatttaaagaaccagaagaagtgctccatccccactcccatggtacatctactcccagctggcgtagatctaagtcaaaatcaaggactgaaaaggcaaggccaggcttgtctgctacacacgatgcaaaatcttctaaggttaatgcagcagacaaagaggacacgtcatccacaatttctgatcctggacctgtggctgtatgggattcaggaccaaagtgggacgatgaacctaaatgggataatcaacctaactgggaacccgagacttcaattgagctccatagccctcgcgaggatattgagcttggtctgactaaggagctggtacctagtttagatgaaaggtggactg

SEQ ID NO: 17341 - DNA, 91 bp, Zea mays
  Clone ID: LIB189-019-Q1-E1-H6
cctagcttcgctcgttgcggcggctagccggcgatggcgaagtctctgcgatccaaacgcgagaagcggcttcggacgttgcgccgggaga

SEQ ID NO: 17342 - DNA, 402 bp, Zea mays
  Clone ID: LIB189-019-Q1-E1-H8
cccacacatccaaaaaaaaaaaaaaaaaaaaaaaaaaaaaaaaaaaaaaaaaaaaaaaaaaaaaaaaaaaaaacaaaaaaaaaaaagaaacaaaaaaaaaagataaaagataaaaaaaacaatgcaagaaaaaacctagttcaaaattcccggggggcggccctaaagtttcaggccttcgttccccgtcttggaaatctggaccccctcaaaatgtgcccccaaaatcaattttgggggcggtgctttaaaacctcgtggcgggaaaacccctggggttaaccagcttaacccccctagaaaaaacccccttttcaccagcaggggtaaatcccaaggggcccgcacattatgcccttcccaaaaggtggccacccctaaggggacaggggaaccccccat

SEQ ID NO: 17343 - DNA, 375 bp, Zea mays
  Clone ID: LIB189-019-Q1-E1-H9
aaactgctgaggctgcagaagctgctgcttctgcagctcatacaatggatgaacagaggcagcttttgtgttcggagattgagcgactaaaacaagccttggaaagacaaatagaacaatcagtggttaagcttagacaatccgaagagaaggttatcagcctgagcaaagagaaggagcagttgatgaaggaaagagatgctgcatttcaggaggctcatatgtggcgcattgaactagtaaaagccagggagcaagcagtgatacaggaagcaactattgcccgagcagaggagaaggctagagtttctgaagcagatgccgcagctcggatcaaggaagctgctgaaaagttgcatactgttgagaaagaaa

SEQ ID NO: 17344 - DNA, 368 bp, Zea mays
  Clone ID: LIB189-020-Q1-E1-A10
cccacgcgtccgcccacgcgtccgcggacgcgtgggcgcgagagcttgtcggagggctctctgtctccgtgataaaccgatacgcagaggaagctgcggagaggtgtccctgctctgctggtgagctgcggccagcgggtgaagtgaagtggaccggacgtggacgaaggagagagggagagagagagagagagaagaaagggcgccgcgggggccatggctggacacgcgccggcgagggacaagaccaccaccggcttcgccgctacgtgcagcctgctgagccagtttctcaaggagaagaagggcggcctgcagggcctcggcggcctcgccatggcgccggcgccggcagctggagcaggggc

SEQ ID NO: 17345 - DNA, 353 bp, Zea mays
  Clone ID: LIB189-020-Q1-E1-A12
agaatgaatgatccttaaaattatccttctgcataagcgtaaaccggagtttttgggaataaagcttctaaagacgcatgcctatacaaatacagcatcactcatttgttgtgtatgctgtgtatacactataactagctttgcacgttattgattaataacacacacatattaaactaattctatttagctcaatgccttcacatgcccattcctcaagttcgcatcttttaaaggaagcaacgcatgttttaatattctgaatcaatctgggcgaatgtgctgaactcctaaccaatatgcataatccaaacctttattaactttgcgatccactcgccgataaaatctga

SEQ ID NO: 17346 - DNA, 150 bp, Zea mays
  Clone ID: LIB189-020-Q1-E1-A3
ttggtgatcgcacatcggatatcctcaagggaaattcatctcctcacacttctgtgaaagtggtgtcacgacgcacgaaggcgaatctctctcctgccagtgggtaccgggctatctccactctataggagtggcaggaagctgatttta

SEQ ID NO: 17347 - DNA, 287 bp, Zea mays
  Clone ID: LIB189-020-Q1-E1-A4
agcggacgcgtgggatcggagcccgtggccgtcgcctccgccctcgcgattcgccgccgttgcccacgagcgaggcttcctcctcttcgtcgccgccgtcgcaggaggggaaagaggataaactgccatggcgggcaggctcctcgcgaatctaatcgtcatgggcggaaccgtggttggcagggccatgctccaggcctaccgccaggccatcgtcaatgcaaacaaaactggagctgcccaagaagctataaatggtattagacgggctaccagggcatgactga

SEQ ID NO: 17348 - DNA, 156 bp, Zea mays
  Clone ID: LIB189-020-Q1-E1-A6
tcctcaggggacattcatctctttaaacttctgtgagtctgctgtcaccaagtttctatacgagtgtctctcctgcgagtggggtacggtctaggtctagtctgtaggactggcacgcagctcagtttatcgtccattcgttgtttcccttccctt

SEQ ID NO: 17349 - DNA, 409 bp, Zea mays
  Clone ID: LIB189-019-Q1-E1-G5
aagacgcgtgggcggacgcgtgggcggacgcgtgggcggacgcgtgggatcgcacgcgagccccaagagatccccaaaccctacacctgcccgccggcgcactcggggaccgtcgaatcgagcaggttgacggaggagagggagcctcgaagatgttccggaaccagtacgacaccgacgtgacgacatggagcccccaggggcggctgttccaggtggagtacgccatggaggccgtcaagcagggctccgcctgcgtcgggctccggtcgagcacccacgccgtcttagccgccgtcaacaagcccgcctccgagctctcctcctaccagcggaaggtgttccgcgtcgctgaccacgccggggtcgctctcgccggcctcaccgccgacggccgcgttctcccgcg

SEQ ID NO: 17350 - DNA, 373 bp, Zea mays
  Clone ID: LIB189-020-Q1-E1-A9
agcagcgctcgtcctccgtcgcgtcgatctgctccttgcctgctgccaccaccggcaccagctgcggggcgcaggacgccggccccgccgccgcgcctccgccggacctgctccgcacctcctccctgcccgcggagtacatggaggaccggctccgccgccgcgcgatgcagagccagcggcgcctcgaggccaagcgcaagcgcctcgagcgccgcaactccatgagctcgggaaggccggttccggcggccggtggccgcgacgacggcctcgagcacaccgtgcccagcggcttccagctccgccgttcggtcgccttgacgacggcggggtcgccgacgcccagccggccgcagcaagggcccgcgga

SEQ ID NO: 17351 - DNA, 107 bp, Zea mays
  Clone ID: LIB189-020-Q1-E1-B10
agaaaaaaaataaaaaaaaaaaaaaaaaaaaaaaaaaaaaacacaaaaaaaaaaaaaaaaaaaaaataaaaaagaaaaaaaaaaagcaaggaaaaatagtcaacaac

SEQ ID NO: 17352 - DNA, 462 bp, Zea mays
  Clone ID: LIB189-019-Q1-E1-F1
gggtcgagccccgcgtccgcccacgacgtccgcccacgcgtccgcccacgcgtccgatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccaaaggggggaaggtagggccgaaccggtgcagcgcctgcaggaagagggttggacttacgggattcaactgccggtgtgggaacttgtactgcgcactccaccgctactccgacaagcacgactgcaagttcgactaccggactggcggcaaggaaccccattgccaggctaatccggtggtgaaggcagacaagctcgacaagatctaaggggggttccctacggttgggtatcaggaagattgtaaaccgcggtaac

SEQ ID NO: 17353 - DNA, 136 bp, Zea mays
  Clone ID: LIB189-019-Q1-E1-F10
agcccacgcgtccgcccacgcgtccgcccacgcgtccggtttctcttgatgtcatagcaatgagaacacctgggttcagcggagcagacttggcaaaccttctgaatgaaccaccattctggtgggaaaacgggaa

SEQ ID NO: 17354 - DNA, 334 bp, Zea mays
  Clone ID: LIB189-019-Q1-E1-F2
gggtcgagcacgcgtccgatactacctccggccgatctgggagaacccccaaagcccttcacgatactccctcactactaccacgacaacgtctcgatggccaacctctgcaagctgcacggatggagagtcagggagaccccgcgccgcgtcttcgacgccgtgctcttcagcaacgagctcgacatccttgacatccgctggcacgagctgagcccctacgtgtcggagttcgtgctgctggagtccaactcgaccttcaccggcataaggaaggacctccacttcagggagaaccggcagcggttcggcttcgccgagtcgcggctgacct

SEQ ID NO: 17355 - DNA, 221 bp, Zea mays
  unsure at all n locations
  Clone ID: LIB189-019-Q1-E1-F3
accacacgtccgcggacgcgtgggcgacgacgcggcgcccaagtcaccggcgccggaggcgcccaaggagccggcggcggtgcctgcgccggccgcggaggaaggcagcaagtcgtcggaggggttcggcctcggcgacgtcatgaagggcgccgagcagctggtgggagggaataagcanggcngccgggaagagagcgccggcggcggtgggctgttta

SEQ ID NO: 17356 - DNA, 441 bp, Zea mays
  Clone ID: LIB189-019-Q1-E1-F5
agtgactctacatttacgccagtaactataaatggatgctctttggtctatattccaaatgtgggagacatcacaccagctttgaagtattgcccgtctccattgtgaacactctgcagcatatgtagcagataaatgagtgaaactatttgtactgcctgctctgcaaattagtatgaacacccctcaaaaagatttggcccacactctggtctctctgtttgcagctgggaacagggagctccagagcttgtgaattctatagaataaaggtggttgtccgcacagtatagcaaactgcgaagcctgcaactactagagtttggtctgtagcaggctcagttgggaatgtgtagcagagcatgatccatggtgtggatgaattgcagagtactgtgctgtgtgtgtaggaaggaaaagctgccgcctgccgattgtgca

SEQ ID NO: 17357 - DNA, 443 bp, Zea mays
  Clone ID: LIB189-019-Q1-E1-F6
agtttgtcgaatctttgtatcggttgttctttacttggagctttatgcaagctgtgtggagtacatcacgctgcttggagatagcatgtcatcagtgtttcccttagcacattttgacctgaatgcacacactctctttgcgatcacaacggccttggcaattctcccaacactggcggtgtgatggcgacaattgcagtcatcgtcttcctattctgggttggctcctgttctgcttcacggtggtgacggttgcctatgctggaatcgccgtctcagggtttctgatgtttggcgagtccaccatgtcacagttcactctgaacttgccacagcagtacatcccatcgaaaattgccatctggatgacggtattctgcagctgcattcagaatgaagaagatatgctcatttcattacttgattgattactttcagatttt

SEQ ID NO: 17358 - DNA, 442 bp, Zea mays
  Clone ID: LIB189-019-Q1-E1-F7
agggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcg

SEQ ID NO: 17359 - DNA, 299 bp, Zea mays
  Clone ID: LIB189-019-Q1-E1-F8
cccacgcgtccgcggacgcgtgggcggacgcgtgggccagaattgccgcttgatctgtagctccaagggtttcaaggacggtggctggtgtgacgaaagcgtggagcacaaagtgtgctgctgctcccattagaaatataatagcgtatgttatgttgatgcatatatatatgcatcgtccatctacctctgtggtgcaaaattctgaataaaatctggcttttttggtaaaaaacaaaaaaaaaaagaaaagaacaaaaaaaagaaaaaaaaatcacaagaaaaaaaaaaaaaaggca

SEQ ID NO: 17360 - DNA, 414 bp, Zea mays
  Clone ID: LIB189-019-Q1-E1-G1
aggacgcgtgggtttcctgtagctattagttagtccagaacatttttccctatcaaatcttcacctttaaaagcttttgatttgattaaccacattccggtgcaacaaaccttttggggttgccagtaaaaaaattcaaaatgaatcaatgaacttaaatccccgggttaattacctttaaattcttacaccaacaattgctccaaaacggtggttacatcgggctgtgagtaatcaacacccttttttgttgaatgttatcacaacacatggggacgtggtataaagtgaagaaagaatgaggggtccattccttttattccgtaaggaactcagaagctttcgagcatactagttcaagttgggaattttactctgtagatgtagataaacaattcagattcatggggtgta

SEQ ID NO: 17361 - DNA, 204 bp, Zea mays
  Clone ID: LIB189-019-Q1-E1-G10
aatttcaaagaaggcatcaagcagaccggatttcatgatcatagattcatttccggtgcaatgatttgcaacgtaaaaataaaccaccgagagcttctgtacgacaacgcagacaatgaaataatgcacatagccaacatcaatagaaaaagacaaattaaagttaaaagaggacatgttgtctgtagccgcatcatacatcta

SEQ ID NO: 17362 - DNA, 315 bp, Zea mays
  Clone ID: LIB189-019-Q1-E1-G12
aggatcaccggattcagtaggtagacatgattaaagaagccgagaaagaatgcctttctttggtttaattttggataccaacagcatcctgagtttttggcagagtaatgattcatgtgataatgcaaatgctattagaatcgaacattactaattcctgtgcatgattcagatcgattttgtcaaataggatttgatgtattaacatggtatgtttcttttaaaaagaatccttgctaccatcatttgttacttacaggagctagtgcccagatttgtgctgaacactattaacaaactgatctgtgcaatttc

SEQ ID NO: 17363 - DNA, 452 bp, Zea mays
  Clone ID: LIB189-019-Q1-E1-G4
gggtcgaggcacgcgtccgaaccgcaccaccgcaccgcggccaaggccaatagcctcgcctagcgctcactcgctcgccccactaccaccgcaccacgcgctcccgtttccgccgatccgagcggcgcagatcgcggaagcccagcggctcagagtccagggggagggagctcccggcggctgaggaaggcgttcaccagcgtcgcggattttattgaggaagagatggggctctcctttgggaagctgttcagccgtctcttcgccaagaaggagatgaggattctcatggtcgggctcgatgccgccggtaagaccaccatcctctacaagctcaagctcggcgagatcgtcaccaccatccccaccattggattcaatgttgaaactgttgagtacaagaacattagccttcacgtttgggatgtgggtggcaggacaagggaactatt

SEQ ID NO: 17364 - DNA, 445 bp, Zea mays
  unsure at all n locations
  Clone ID: LIB189-019-Q1-E1-D4
accacgcgtccgggctgtcagcaatggaggaggcggctggtgagcagcaaccggctgctgaggtttgggaagaaagggagggagggaggagtggtgtggcttcataccatattggaaaccccaaaccctaatttgggttgggctgctatattaatagatggactagtatatgggctgggcctaagtccattacaactgtaacacacacatgtctaacagatatgacggttacctgatatacaagcgcattctattctaacatatgatacaaagagaagaggtagtttatgttggatcatgtcacagccttgcgactcatttggttttgtttcccagacctagcagatcttttacaaatcgtggaagcatgcatactgaaggaataactgaaactaaaaataaacaacacaggttttcattatctagctttgtanatggataatgt

SEQ ID NO: 17365 - DNA, 439 bp, Zea mays
  Clone ID: LIB189-019-Q1-E1-D5
agcacatgggattctcaagtgttaagcaggcatgctgaatgtctggagctggaggagttgactgcaatatcagtcaatcccagtctgcttccagctttgaatcagttgcttctcgaggcgtatgccattctacgtcccaagccgcttgactatgaccagcgcaacaccttggttgatgtcttcaggaagatggtgaatcaaagatttggtagcaacagtgggtctccggttgtggaaccatttggatcattcacgatggatttatttactcctcacagtgacctggacctctctatcaattttagtgctaatacttatgagcaatatactcgcaagcaaatgatctctattatcaagaaattttccaaggttctattttcttatcagaggagtggaattttctgtggggttttacctattgtaagtgctagggtgccta

SEQ ID NO: 17366 - DNA, 438 bp, Zea mays
  Clone ID: LIB189-019-Q1-E1-D6
accacgcgtccgcggacgcgtgggcaaaaagcagacagaggaccaaggaaggaagcagggatccggctttgctctgcaaccatgagctccctgtacgacgtctcctgcttcgccgctggccttgctggcaacgtcttcgccctcgccctcttcctgtcgccggtgccgacgttcaagagggtcctcaaggccaagtcgacggagcagttcgatgggctgccctacctgctgtccctgctcaactgctgcatctgcctctggtacggcctcccgtgggtctccgacggcggcagggccctcgtcgccaccgtcaactgcaccggcgccctgttccagctcgcctacatctcgctcttcatcttctacgccgacagcaggaccactcggctcaaagtcgcggggcttctggtgctattggtcttcgcgttcgcgctcatc

SEQ ID NO: 17367 - DNA, 441 bp, Zea mays
  Clone ID: LIB189-019-Q1-E1-D7
acggacgcgtggggttctttgaaacccacagatattttggtttggagcctaatcaagtgacatttttccaacagggtactattccatgtgtatctcatgatggaagatttattatggagacaccatataaggtagcaaaggctcccgatggcaatggcggagtatatgctgctctaaaatctaaaaggttgctcgatgatatggctgcaaaaggtgttaagtatgtagattgctatggagttgataatgtattggtccgtgttgcagatccaacattcctaggatacttcattgacagaggtgtatctgctgctgctaaggttgtcaggaaggcatatccacaagagaaagttggagtatttgttcagcgtggaaaggggtggaccctctctgtagttgaatacagtgaaatggatgcagctatgacaactgaaatcaatc

SEQ ID NO: 17368 - DNA, 406 bp, Zea mays
  Clone ID: LIB189-019-Q1-E1-D8
acctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaacttcgacaacatgatggatggcttctacatagccaagggcttcatggacaagctcgtcgtccacctctccaagaacttcatgcacctgccaaacatcaaggttcccctcatcctgggttacctgggaaggcaaaggccagggaaaatcgttcaaatgcgagctggtcttcgccaagatgggcatcacccccatcatgatgagcgccggcaatctggaaagcggcaacgccggaaagcccgccaagctcatcaggc

SEQ ID NO: 17369 - DNA, 399 bp, Zea mays
  Clone ID: LIB189-019-Q1-E1-D9
agcccacgcgtccgcggacgcgtgggctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttccttggtgacagcaggtcgagcatcttcgacgccaaggccgggatcgctctgaacgaccacttcgtcaagctcgtctcgtggtacgac

SEQ ID NO: 17370 - DNA, 353 bp, Zea mays
  Clone ID: LIB189-019-Q1-E1-E10
agcccacgcgtccgcccacgcgtccgcccacgcgtccggacacagcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgccgcccgtggaccacgccgccgccg

SEQ ID NO: 17371 - DNA, 383 bp, Zea mays
  Clone ID: LIB189-019-Q1-E1-E11
agcccacgcgtccgcgtctcgctcgtggctgccctactcgtgctgcttgccctcgccgccgtttcctccacgcgcagcgcacaaaaggagtccgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagttgttgctggcacgatgtactatctcactattgaagtgaaggatggcgtagtcaagaagctttatgaagctaaggtctgggagaagccatgggagaacttcaagcagctgcaggaattcaagcctgt

SEQ ID NO: 17372 - DNA, 84 bp, Zea mays
  Clone ID: LIB189-019-Q1-E1-E12
tcaaaggcggctcccaaattttcaacgaaggcgggctggactaactccggaaacccaacctgattctagcccaaaacaacctcg

SEQ ID NO: 17373 - DNA, 400 bp, Zea mays
  Clone ID: LIB189-019-Q1-E1-E5
gcgctgagacgtgcgtgtcagcctagtaataactaaaataatggccgtgttcatgtaacgtgctcgccgtatgtacaagccgagtgtaataatacagtactatgtgtattattaaatctcatgctttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaaaggtttcaaccttaattacccgtgaaaggaaatttaaaaccctccaaaagggcccccaaaattaaattcaaggggcttttttttaaaaactcgtaacgggaaaaacccgg

SEQ ID NO: 17374 - DNA, 430 bp, Zea mays
  unsure at all n locations
  Clone ID: LIB189-019-Q1-E1-E6
cggacgcgtgggcggacgcgtgggaccgcctttcacctgaaaccgaaagagagaagcagctatttggagaaagtgaagcacgcgataagatgagaaaaaggaagagagaagaacagaagggaggactcgaaaatgggatacataggctccgtgccgaggccgagaggctggacgtgttgctcgcggagggccgtgttttctctgacctgcctgctttggccgatagagatagcatcttgctgaaggatacccgcctggagaattctcttgtctgccagccccaacaacggaacttgcatggtcgaattttcggtggtttcctgnatgcacgagcatttgagcttgccttctcgactgcgtatgcttttgttgggcagagaccttgtttccttgaagtcgatcatgttgacttcttgaaaccagtggacgt

SEQ ID NO: 17375 - DNA, 93 bp, Zea mays
  Clone ID: LIB189-019-Q1-E1-E8
acgacgcgtccgaggacatacacggtctgagataacgcactatacaaggagtcctacatggagatgcactacataggcgtcacgatggggttt

SEQ ID NO: 17376 - DNA, 103 bp, Zea mays
  Clone ID: LIB189-019-Q1-E1-B8
acaaaaagaaaaacaaaaaaaaaaaaaacataacaaaaccatccacaccacaacgatcacctccgcagcaccgaatccatatacagtcacaacacgtcgcttt

SEQ ID NO: 17377 - DNA, 409 bp, Zea mays
  Clone ID: LIB189-019-Q1-E1-B9
agacaggctgcacttgtttttgaatacttggagtgaccacaactaagtcacacaatgaaactttactttccagagtgtaacctgccggacttctgatagaatgaactgaaagacttctctaacaaaagtggagctgaggggagcaagagtgctgaaagtggtccaatgtttttagatgttctcgaatgttatctgaaatatgaggtttatctcttgcttgatcaacaatagaagcaaaaaatcatccttttgtttatttatgtttcccaatataaaggaaaaggggaaatattttggtgcattgtgcccaaatcttttgtctctagaaaactatgtagtcacctatagcaggcgctatagtcagttttagctattttagacaccactactatttgtacacacatttcta

SEQ ID NO: 17378 - DNA, 428 bp, Zea mays
  Clone ID: LIB189-019-Q1-E1-C1
accacgcgtccgcccacgcgtccgcccacgcgtccgcccacgcgtccgcttggatgtctgaaacatgggttaggtcaaggaagaaaaggtggggatgaggagtatgctgcagatgaagatggccctgacacaactgatcatccacgagactttggaacagatgttaccgcccaaatctcagaaacacatttcgatcaccaggccgaagatggcacccatgacaagggtggaatgaggcagcaggggagagggagaggccgtggaggtagaggcagaggccgtggtcagcattatggccacaacagccgagatggccaccatcctattggcactcccccgtcggagcatccagctgtgccgaagccgccccgggccccgcatgccggatggcacaaaagggttcaacatgggccgagggaagccgctca

SEQ ID NO: 17379 - DNA, 387 bp, Zea mays
  Clone ID: LIB189-019-Q1-E1-C11
aggtgacacataaggtggtaccacataccctggctataccgatgataagacagtgcccaaggatactgtgactccaacgtttgctgctgccgcgccttttcataaataatgccagatgggatggagttccctttcatatgaaagctgggaaagctttgcacacactcacgagctgagattacggtacagttccgacatgttcctgtaaatctctacaaggggagttttggcacacatcttgatacggtcactaatgagcttgtgagacgtgtgcagtcggatcaatcaatttacctatagattaacacctatattcctggtcccggtatgctactagatacgagtaacttgagtcgccattatgccgcaaggtactcaaaggagata

SEQ ID NO: 17380 - DNA, 392 bp, Zea mays
  Clone ID: LIB189-019-Q1-E1-C12
agcagacgcgtgggcaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgactacggtttgttttgtggatcgcaagtttctcttctgccactgttgctgctacctttgctggtgttattgctagggtcgaatacttaagttaactatgcgctgacagtctggactag

SEQ ID NO: 17381 - DNA, 254 bp, Zea mays
  Clone ID: LIB189-019-Q1-E1-C4
aacgagaagcacgtccccgtcaacatcgctggaaccaggatttgtgacggcgagtggctctacgccgaccctgatggcattcttgtctccaggacggaactcaccgtgtagacagacacctggttgtatgtgtgtgtgtgtataaggaatcgggcgctcttgctgttaagcccgactgcccgagcttgcaataatggattcttgcttgatcacacatttatacttagaataatcgaatgcttgcttccatggtt

SEQ ID NO: 17382 - DNA, 433 bp, Zea mays
  Clone ID: LIB189-019-Q1-E1-C6
acagaaggagctaactgaaggttcagaaacaaagttggattcttttatgatgttgcttacggaattgttgggagacttgtttttggtgatggagactacattgaaggaatgttcaaagaaaaaatctgtcagtgtcgttgatgaatgtttgaaacttgttttcctcttccacacactagcacaatcaaagaaataccgacaagatgctacaactcttctgctggaggccttgctgatggttttctctctgtccagtgatactgtttcacaggagcttgctgaagtgaacaccattttcagaaagttgttctctcaatttattcagataccgtctgtggctatacagattaaagacataatgctttctgcaccagctgaaatgagactacagcttcaggacatggtccgagcttcagtcagtcaagggcagata

SEQ ID NO: 17383 - DNA, 442 bp, Zea mays
  unsure at all n locations
  Clone ID: LIB189-019-Q1-E1-C8
gcaggcggaggcgcggtgcgcgcgctgtcccagaaggagcaggacatacagatgatgctcgcggccgacgtccacctcggcaccaagaactgcgatttccagatggagcggtatgtctttaagcgtcgcaccgacggcatctacatcatcaacctgggcaagacatgggataagctccagctcgcggcgagggttattgttgccattgagaacccacaagacatcatcgtccagtcggcccgcccctacggccagcgtgctgtcctcaagttcgcgcagtacactggcgcccatgccatcgctgggaggcacacccctggtaccttcaccaatcagctccagacctctttcagcgagcctcgcctgctcatccttactgacccaaggactgaccatcagccaatcaaggagtctgctctggggaacantcccgacattgcct

SEQ ID NO: 17384 - DNA, 402 bp, Zea mays
  Clone ID: LIB189-019-Q1-E1-C9
agcccacgcgtccggggacgtggacctgggcaaggtgtcgccatacatcagacgctgcgtcgacgttaagtacggcataaatcttgtcaatgaaagcagcggacagtggtaacatttgtctaacaaaaatggctacatcatagcgcttagttgcaaaaagattctcaaaatttaagcactggtattttccaaaacaggagtcgacaggtgattcaaatgtcaggaatccaaagttctttgagacattgcttgtgatggattaggcaagaatttaatagctacatcattccaatttctaacaaaccagcatctgttgatgcagtgaaatctcagaagcaaacatatgacagtatcgtgcctggaaaattgttacagaatggctaaaaataagccagttaacag

SEQ ID NO: 17385 - DNA, 438 bp, Zea mays
  Clone ID: LIB189-019-Q1-E1-D1
catcggaggagcagctggacgaccatggcctcgccgctgctcaagtcgcactctcagctcgccgccgccgccgccctgcactccgtgaggagagccgaccgctgccctgcgacaatacacctgggcaagttccatgaccacgggctcaggtccggccgttctaagagatccggttcagcgaaggtgggcgccttcccgtcgctggacgtggtgccgctgatggtgacgatggtggagcacgtggacatgtcgcgggactacgtcgtgaccaagtccatctggcatctcagcgacgcagccctcaagagcgtctataccttctacgccatgttcaccgtctggggagtctgcttcttcgcgtccatgaaggatcccttctacgacagcgagacgtacaggagccagggtggcgacgggaccgtgcactggtactacgac

SEQ ID NO: 17386 - DNA, 334 bp, Zea mays
  Clone ID: LIB189-019-Q1-E1-A3
cgtccaaagtgatcttggttggtgccacggaagctcaccagctccatttgtgttccacagatcgtcgtccttctcgttcccctcgtgtgtagcctttggtacgttggtggaagggcgaggcacacacgagaattgatagaggggggatccccattttcagctcttcgtgtttttttgtaggaggaattcccgttcacatgatccgtgcctggacctgacggttttgccccgctctgctgcttccctttcggggagaagaggactcgactcaaatcatttggtatcgcagacctcgcccttcccagttcagttgacagagatttccggcatgtcc

SEQ ID NO: 17387 - DNA, 378 bp, Zea mays
  unsure at all n locations
  Clone ID: LIB189-019-Q1-E1-A4
atactcgtcaagcacgcttaaggtctaagaagcttgacgatctgcagccaggagagccgcttgcgaaaccggtgtcacctgctctgccgagcgcacggaagcgtgctcctacacgtgctgctaggggcagaaagggtgctgctgggagaggagtgcctcccgcaccaaagcctagaagaaagggggttgatattgtcgtcttagaagctgatcctgcttgtgaaaccccacttaaagctttcaagggactggaagttgctgctgctgcgcccaagaaaccttctttgaagcacgtanccgaagttggtgttccgaaaatgaatggtgaaagtggggagaagattgttggggctgaagatgaatcgacagctacacctg

SEQ ID NO: 17388 - DNA, 445 bp, Zea mays
  Clone ID: LIB189-019-Q1-E1-A6
cccacgcgtccgcccacgcgtccgcaacgacaacggagccgatgcgccggtgcccgggaggtacctcatcaaggatcctagcgccgaggaggtcgtagccgccggcgacagcgcctgcacgattccggtcatcgatttccgcaagctgctcgatccggggtcgtccgaggaggagtgcgccaggctgggagccgcgtgccaccactggggattcttccagctcatcaaccatggcgttccggccgaggtgactgggaacctgatgaaggacgtagctgggttcttcaggcagccgctggaagccaagaaggagtgcgcgcagcaggccggcagcatcgaaggctacggccaggccttcgtcgtgtcggaggaccagaagctggactgggcggacatgctcttcctcatcgtgcggccgagggaggccagggacatgcgcttctgg

SEQ ID NO: 17389 - DNA, 431 bp, Zea mays
  Clone ID: LIB189-019-Q1-E1-A7
cccacgcgtccgagcctctccttcccggtctcctccgcccgttgccttcgtcccctccatctccggctgcgtcgccggcgagcccgacaccgcgaatcggatccgccgacaaggcgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacccagggtctcatctttgttgtggacaacaatgatacggaccgtgttgttg

SEQ ID NO: 17390 - DNA, 410 bp, Zea mays
  Clone ID: LIB189-019-Q1-E1-A9
ctagttctagaccgccgaccggcctggcctacttcttgagataatcaagatcattgcggacacaaatattgatgtggaatcagctgagattgatactgaaggtttggttgcgaaggacaagtttcatgtaagttacagaggtggaaaactaaacagctccttatcccaggcgctgaccaattgcctgcgttattacctccgaaggcctgagacagatgaagacagctattgattgttgtgtttgtcgaaccttcctatagtgcattagaatcagaaactttggcttcagttccttcgctatgggccccttgtactgctgcaaatggagttttccattgtagctgataaagtgcccacaaggtgcatccatatgtgcataggtggcactgaatcggggctcactggaccag

SEQ ID NO: 17391 - DNA, 424 bp, Zea mays
  unsure at all n locations
  Clone ID: LIB189-019-Q1-E1-B1
gaggcctccgagcaagcagcggagagatcaaactgagagatggagagagaaagccagatgccgctgctgtgttggccaccaccaccgactggggcaagagagaaggagagaaggaagatgccgtggtgaccggcggtacggatcttcttcacgcgcgaggtattgggatggatgcactcggttcgttggtcgacggcgagcttcgatgcttgcgttggtcgtcggggggacggagaaggacctcgtggccaccacaatttctcacccatgccgctgctccgccgcggaaccactagcgccgtggtcggagaatatcagcatcctcaccattgcgtaaggtcacnagtcacctgatgagcaagttggtacctggaatctcaagtgccaggcaagttgtgcccttgatcacttcttttacccagtc

SEQ ID NO: 17392 - DNA, 381 bp, Zea mays
  Clone ID: LIB189-019-Q1-E1-B10
agcccacgcgtccgcccagccagggtggtacagggtttattacatcattaataatattcaagagttagtaaccgctctgacccaagagcatccggtggtgctgatgttctgggcggactggaaccagccaagcaaggccacgtactgggatctggccatcgctaaaaaggatgaggccgtattctgccagctggactttgataagtttaaagatgtcgtagagaagttcagagtgaaggctctgccgacgttcctcctgatcaaggagggcgaggagcagcgcagggtcgtcggtgccaaggtcgaggagctcaacatggcattatcagatatcggataatctaggcagctatagcgctcacattctaacttcatcaaatt

SEQ ID NO: 17393 - DNA, 337 bp, Zea mays
  Clone ID: LIB189-019-Q1-E1-B11
agcaaatgcgcaacagccaaagcttttcgtcggcatgatcctcatcctcattttcgcagaagcgcttgctctctatggtctaattgttggaattatcctttcgtctcgcgctggtcaatcccgggcggattaagtgcaccaccattctgtgattaccgcatcgtttattatgctattctgagaggattggaactctattcccttgtctagtttattcttgttaccatgtattaatgtaacaatctgtagctgatggaaggtgacttccagtcatgttttggttttggtggtgtcgagcagaggttatttatttttgggtttaaggcggatggatgct

SEQ ID NO: 17394 - DNA, 431 bp, Zea mays
  Clone ID: LIB189-019-Q1-E1-B2
gcgtccaaccgcatgtgagcacacacgtgagagatcacatccagacatgggaagatgaagccacatgccgctgctgtgatggcgtccaccaccgactggggcacgagagaaagacagagagaagatgccgtggtgaccggcggtacggatcgtcctcacgcccgaggtattgggatggatgcactcggttcgttggtccacggagagcttcgacgcctgcgttgtcgtcggggggaccgagaacgacctcgtggccaccagaatttctcacccatgccgctgctccgccgcggaaccactatcgccgtggtcggagaagatcagcaacctcaccattgcgtaaggtcaccagtcacctgatgagcaagttggtacctgcaatctcaagtgccaggcaagttgtgcccttgatcacttcttttacccagtca

SEQ ID NO: 17395 - DNA, 465 bp, Zea mays
  Clone ID: LIB189-019-Q1-E1-B4
gggtcgagcacgcgtccgcccacacgtcagcccacgcgtcagcccacgcgtccgcggacgcatggggttcgagggtattgcggacgaatttcagaacaacaacaatgtcaggctgcttttgaagtatgatgatgctctggcacatatgatctttgcagcatcagacatgttcattgttccttctatgtttgaaccatgtggcctcactcagatggtatctatgcgatatggttctgtgccagttgttcggagaaccggcggtttgaatgacagtgtcttcgatttggacgatgaaacgatacccatggaggtgcgaaatggcttcacctttttgaaggctgatgagcaggattttggtaatgcactggaaagagctttcaactactaccacagaaaacctgaagtttggaaacagttggtgcagaaagacatgaagatagatttcagctgggatacttcagtttc

SEQ ID NO: 17396 - DNA, 394 bp, Zea mays
  Clone ID: LIB189-019-Q1-E1-A12
aggaaatcgttctcaaatacacacaagggatagatagaggtacagttgagttatacaaaggtttcatcaagtttcttaaagtacagcagagcttccatttcctacatgaccagatagccctagcaaagcaatggaagtcctacaccaaaagccatccatgtttccccacgtactatccaagcggccagctcgggaacagcaatatatatgcaaagtgcaagcaggtgaacaagcgcagctagtagtacccgaggtccttgcgtcgaacacgaggtccccgttgatgagctcgcggtaggcggcgacgggccagatgaaccccctggggaggaggcgggtggcgagctcgacgtcgatgatgatctccctcatggcgggcttcttctcgccgctg

SEQ ID NO: 17397 - DNA, 440 bp, Zea mays
  Clone ID: LIB189-019-Q1-E1-B6
gcagacggcaatgcagacccccgcgcgcctctccgctccatcctcgccgctcgtctcctccgcgccaccgatacctgtacggccacaacgcgtcgctttcccctccctccgccgccgtgatctcctcctcctgccggcggcgctgaccctcccgacggcgcccgccccgttgcctgcctcggcgcgagggctgttccgcatgcccccgccgcggctggtgaaccgttactttctggtgcgcgcgggcgagtccgtgtacgaggggcagggcctcctccgcaccaacccggtcgccaagacctccgtcgacagcggcctctcccccgtggggctccgccagacggcgcgcgccgcgctcgagctccagcgcctcggcgcctgcgaggacgactgctggatatggccgtccatcactcagagagcttaccaggcggccgaga

SEQ ID NO: 17398 - DNA, 418 bp, Zea mays
  Clone ID: LIB189-034-Q1-E1-H8
cacgcgtacgaacttgcaatgaaaggcagagagccactgttcgtaccatgtacgccaaaggggtgcatggagctcttgtcaaggagcggagtcactgttaaaggtaagcgggcagttgtggttggtcgcagcaacatcgtcgggctacctgtaggggtgctccttctgaaggcagatgcgaccgtatctgttgtgcactcgcggacccctgatcctgaaagcattgtacgcgaagctgacatagtcatcgcggcagctgggcaggctatgatgatcaaaggtgactggatcaagccaggtgctgcggtcatcgatgtctttactaactccatcgatgaccctacccggaagtccgggtaccggctcgtcggcgatgtggatttcgcatcggcgagcaatgttgctgggtacctgactc

SEQ ID NO: 17399 - DNA, 398 bp, Zea mays
  Clone ID: LIB189-034-Q1-E1-H7
gcgtccgcaaacacgtccggcaacagcaggaacacagttacacagaggtcctcggccgtggcagcacgttcacgttgaccaccagagctcaaacgcatcagccgcccatcatcagccagccgagcgatcatcaggagagttcaggtcgtgcaagaggggcgggtgaaacaaaacgcatcgatccatccgtcggtcgcccaatcatgattctgggcttgggaggatgctgcggagctgccgccgccgccgccgccgtgtcgccggctgccgtcggcaagcaattgcgaggccatctacaggccactgagcggcagcagttttttttttgggcaagtgatgagcacaagatgaacaagggaggcgagcagggagcggcggcagcagctgggggtaaggag

SEQ ID NO: 17400 - DNA, 398 bp, Zea mays
  Clone ID: LIB189-034-Q1-E1-G5
gcgtccgcggacacatgggcggacgcttgggcggacgcgtgaacacaaatgactgaacaccagccgtattgtcccgactcctgacccctaccgatcctcgcctgctgcatccatggcgacgggggcggcgctctccaccgccgccaatcccagggggggctaccggtcccgcgcttcgctgggcaatcccgtgaacgggcttggcctcagcatgggccgcgagcgcccccagctgagcattgtgtgccagacggcgagcaccatctccgcccaccgcctctctcacatggacaatccgaagctgatgaacctcctccttctccttttcatctcctttcccaccgtccgcattgtcctcccccatggcgccttcttcctccctgccggctcccggaacc

SEQ ID NO: 17401 - DNA, 448 bp, Zea mays
  Clone ID: LIB189-034-Q1-E1-G6
cacgcgtacgcagacgcgtggggaatcgtcgtgcagttggatgaatgagtgctgtgccggctgtacaacaagaagaacgagtgggagaagatgcagctggggaagaccgccgtcgccggggtgggcgccaccaaggaggaggcgatggacagggggagctcgcacacgcactcccacgcccaatcacactcgcactcgtggggcgagacgcgcacgccagagtcggagatcgtggacaacgacccgttcccggagctggactcgttcccggcgttccaggacccggcgatgatgatgacggtgcccaaggaggatcattttttttgctgcagcgccaagagcggcaacctgttcgtggacctcagctacgacgacatccacggcatgtacagcggcctcgacatgccgccgccgccccgggaggacttctacccctcgctcctccggt

SEQ ID NO: 17402 - DNA, 351 bp, Zea mays
  Clone ID: LIB189-034-Q1-E1-G7
gcgtccgccaacaagtccgcaaatccacggtttaataacgaaacgtattaacttaccataacaacaactcaattcctatcgaattccttcctatcgaattcctatagtaaaattcctataggagggaacgtacacacggtgtacacattatagggggtgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgatttgtttttttttacttatgtcaccacacacataaactaaa

SEQ ID NO: 17403 - DNA, 407 bp, Zea mays
  Clone ID: LIB189-034-Q1-E1-G8
ccacgcgtacgcacacgcgtccggagaagaggaggaagaaagttgaagagctgaagacgctcgagaactcgcactacgactaccacaagatgaagctgcggatgcagaccgaaatccagggcgtggtcgagcggatggaagccacaaagaagatgtgggtataggctcctgttaacaatttcatgttgctgctgcttaatgtttcgggtatagactccagctaacaactgcctgatgctgctgctgctgctgaatacctgagatttggtgttgttcgttaggagagtgtccattgttgtattttttttcaccatcttgtgttataatctaaatgctgttgtaacttgcaagtggatgcctagccttgcgcttgctgatataacttggcagcattcactcagttaatc

SEQ ID NO: 17404 - DNA, 435 bp, Zea mays
  Clone ID: LIB189-034-Q1-E1-G9
cacgcgtccaatacaacgcgcaagcaggtgagagcctgaacatgagataactgagcccgtacctggaggccgtgggctctgacttcacgggcggcgccaacttcgccatctccggctcctccacgcggccccgcaacgtccccttcgcgctccacgtgggggtccagcagttcctgcacctgaagcagcgctcgctcgacctcgccgcccacggcgggacggctcccgtcgacgccgacggcttccggaacgcgctctacctcatcgacatcggccagaacgacctgtccgccgcattcggtagcggagcgccctacgactacttcttttatcataggatcccggctatcgtgtcagacataaaggacgctatcatggtacctctgcaaatagtatcactcaccatagattagaacttccaactacggcctttgc

SEQ ID NO: 17405 - DNA, 413 bp, Zea mays
  Clone ID: LIB189-034-Q1-E1-H1
cccacgcgtacgcagaaacctgcagtcgggtcatctcgtccacgaaaagtacggacttcgggcatcggccccaacgccagcggcaccgcaccaccacgcccgtcggcgacatgaatccgcccgcgggagccgcgtccaccggcgcaggaggccaggccggggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccttttttttatatgatggactccgtgaaggacgtgctcggcaagatggggaagaggtttggccaggccgcccgcaagaccgagaccatcaccgg

SEQ ID NO: 17406 - DNA, 389 bp, Zea mays
  Clone ID: LIB189-034-Q1-E1-H10
cacgcgtcagccatcgcgtccgcgacctgctccccgccgcggagcacgagctcgccgacgacgtgtcggacctcctggcgctcgcgtcgcggcagtgccgccgcgcggcggccccggagctggggcggaatgcgggcgtgctcgcgctgatccagggggtggagcgggagatcgtgccggagcgggagaggcttgagggtatcctggaggacgtgggcatcaacgaccccgccagctgcagcgacgagatcgagaccctggagcgggagatcggcgaccgcgtcgccgagaggtggacgtcgtcgatgatcgccctcgtccgttttttctgctacgccaagtgcgtcctcttcagtgccgccacgccgcggcccgtggactccaaggtg

SEQ ID NO: 17407 - DNA, 409 bp, Zea mays
  Clone ID: LIB189-034-Q1-E1-H12
ccacgcgtcagatagagaccaacaagcaacatagaaagtggaatccaatagcaacaatagagcaacaatggcgaccaagatattttccctccttatgctccttgctctttctacatgtgttgctaaggcgacaattttccctcaatgctcacaagctcggagagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattgtttattaccatcagggcacaacagctgcagcaactcgtgctacctctgattaaccaagttaactctgggaaaccttttctccct

SEQ ID NO: 17408 - DNA, 403 bp, Zea mays
  unsure at all n locations
  Clone ID: LIB189-034-Q1-E1-H2
cgtccgcagacacgtgggcggacgcgtgggcggtcaagcatacaatactggaatgacagatttaatcggttacagacatatttggagaactgtgatcattcaacccatgagggttatttgcgagggcttangtccctttcggctgctgggagggggatgcatgcaattgagctggagaaaagggcaatacatctcctaatggaggaagggaaagagctccagcgaatgaaggctttgaatgttcttgggaaggtttccccaaatgcttcgtcaaagctgacaccttcgcagcggtagtctctacaatgagatgactgtttattatcacgagggctgtaatactcaaatacattgcagaaaagacatgtttttcctgtgttacacctttccttttaattccttt

SEQ ID NO: 17409 - DNA, 409 bp, Zea mays
  Clone ID: LIB189-034-Q1-E1-H3
ccacgcgtaagcaaatatccttaggctagacatcaatcatccaccaaatattcatcttcatacgggaatttttgtacgcgctacaaaacgtcaacatcctcttcacaatcataccacaaggggaggactgcctaatcatttcaaagtaactgggggggagacttatcctaacatcagacatgagccaaatcttcaaggtcctgttatcacggttatatctgatcaaaatactgttgactctatcagccacagtcaaaatcccacctccaccaacttgttgcccgacgtcttagacaaagctaccatccatgaattcgttttttttcagcacattaccgatcgaaagcattatgctatacacgctctcaatgatccactcttaagtttacatgatcactaccttatacct

SEQ ID NO: 17410 - DNA, 424 bp, Zea mays
  Clone ID: LIB189-034-Q1-E1-H4
ccgcgctcgcgctcctcgccggcgtcacaaaacatcggcgccaaggcgagccccgccgccgccgcctacggggaagcagccaacgtgttcggcaagaccaagaagagggcgggcttcatctcctacgtcggcgacggggtggggctgctgatcccgtccaagtggaaccccagcaaggagcgggagttccccgggcaggtgctccgctacgacgacaacttcgacgccaacaccaacgtgtccgtcatcatccaccccacctccaagaaggccatcaccgagtacggctcccccgaggagttcttctcttatgtcgactacctgctccgcaaccacgcctacggcggcaacaccgactcccagggcgggttccagaccgacgccctggccacccccaaccttctggagagctccaccccccttg

SEQ ID NO: 17411 - DNA, 438 bp, Zea mays
  Clone ID: LIB189-034-Q1-E1-H5
gcgtccgcaaggtaccgtcccactgcatgcgtcaagagcctgactggttttcttgttctgatttgtcatttgctggtgctcaaagccggcttggtttcctcgaaggatcagcatctactcgtgagtgtggactttgtcacatctgatatcaggggtgggaaatctttatccgagatggcgctgcaaaacattggtgcttcaaacagggatgatgccttctacaggtacaagatgcccagaatgattaccaagatagaaggccgtggtaatggtatcaagacaaatgttgtgaacatggttgacatagcaaaagcacttgttatttttagcttcctacacaaccaagtactttggatgtgagcttggtgcacagtccaaatttgatgagaagacaaggatttccttggttaatggggctcatgatactgcaaagctggc

SEQ ID NO: 17412 - DNA, 343 bp, Zea mays
  Clone ID: LIB189-034-Q1-E1-H6
ccacgcgtacgcacacgcgtccgcccacgcgtccgatcgtttcaaacaatttgagtgggaatactgtacgcaacatgctacagagagagatatatatatatcatcagaacgaaggtttttggagcggggcttaccgtctgtctgaaaccacaggcggggatacatcacaagcccacaggcgctttatttgccatcgtagaccaaactttcagtgctgcctacatcaccaccatgcacacattgactccagccttattcacagctgtcggcctcacgacccctccaagttgtacaataagatccacaacaccttattttttttttctctcacgtaccctacgta

SEQ ID NO: 17413 - DNA, 355 bp, Zea mays
  Clone ID: LIB189-034-Q1-E1-G3
acttggttcgtgagctatatgtgactatttagcaacttcagaattcgcattgcaaattatgtgcgctacacaaagatcacttccaacatgaatgaacgctttccaggggggacatcacaaaagctcgatgtgaatgaggggggggtattatttgccctgaggaaatggctacagcaaagaaactgctcgatgggcatctgttccatgtgcattgtctaagacaaacaggagaacaggctgaacaagacgttcctctacggcttctccatgggagcttcacctccacaggaacgattctctcttttttttatgtcccgtgctgcatgccccaacgtgcaatggttattgtatacta

SEQ ID NO: 17414 - DNA, 154 bp, Zea mays
  Clone ID: LIB189-034-Q1-E1-E12
cacgcgtcaaccaacgcgtccggaaaaatatccccaaaccctaactaccaatctcgatcgcgaaccctcgcgtcttcttcgacatcaccgtcggcggcgccccggcgggccggatcctcatggaggggtaccccaaccacgtgcccaagaccgc

SEQ ID NO: 17415 - DNA, 407 bp, Zea mays
  Clone ID: LIB189-034-Q1-E1-E2
ccacgcgtacgcagacgcgtgggcggacgcgtgggcgcgacgtggaagttcgacacggaggcgctgcccaacgacctcgtcaagcgcgggctggccgtgcgcggggaggacggggagctggggcgtggccatcaaggactacccctacgcccacggggggctcctggtctgggactccatcaagcagtgggcgtccgagtacgtcaacgtctactacaagtccgacgaggccgtggccgccgaccccgagctgagggcgttctgggacgaggtgcgcaacgtggggcacggcgacaagaaggacgagccgtggtggcccttgtcttttacccgcgacagcctggtggagacgctgaccaccatcatgtgggtcacctccggccaccactcggccgtcaacttcgggc

SEQ ID NO: 17416 - DNA, 378 bp, Zea mays
  Clone ID: LIB189-034-Q1-E1-E4
cacgcgtacggaatacccggccttcgcgctcgtcaacaaggtcaacagagaggcgctcaagcactccacggggcagggccaccccgtcaagctcgtgccctacaacccggactaccacgaggagggggtgctctggaccgagagccgcgacggggggggcggcttccgctgcgtccgcatggtcaacaacatctacctcaacttcgacgccttccacggcgacaaggcccacggcggcgtccatgacggtaccgagatcgtgctctggaactcgtgcgagggcgacaaccacccctggaagatcctcccttggtgtattttcttttgatactactacctggtaccctactcataattctgccggctgctgcgatcccc

SEQ ID NO: 17417 - DNA, 275 bp, Zea mays
  Clone ID: LIB189-034-Q1-E1-E5
gtccggaaggaacagggaatattgtatggttctgttggaatcatatatggtcttgtgggacaagggattgctaatttgataatgacagccaaacggagtgttaagaagtcagacgatggggtgcctgttccacctcttctcaaaacttcggcggggtggggtgcattccttgctgtttcttccaacacacggtaccacattattaatggattacagcccctggttgacgcttcacctgttgccaagcgtgtcccggctgcctctttggcattcac

SEQ ID NO: 17418 - DNA, 305 bp, Zea mays
  Clone ID: LIB189-034-Q1-E1-E7
cgtccgcaacatggtcaccacggcggccacggcttcgtggtacgaaagaccacggtccaagaggacatcaacacctgcaccggctacgtccaccagcgcatggagagcttcctcgccagggcgtggtgatccgccctgcggccggcatctaggggggttcgtgcttgcctgcttgccttatgtatgtctgtggttgactggttgttcacggtcatcctacttggctatcttacctgcacgcactcatctcctgtacgaattacgaccataagctcgttacctgaataaaacttcttcgtactact

SEQ ID NO: 17419 - DNA, 289 bp, Zea mays
  Clone ID: LIB189-034-Q1-E1-E8
ggtgccggtgtcttctgtgctattataaaacaaccggctgacaaccttgtgtctttcctgaacaatgccaagggagctacattgggagatcctgttaacaagcgggggctctggggtctcttcactagaagacggcgggggcgtatcgtcatcattggtacccttactggtgctcactggggaatttaccatgcattcaaactcatcgtttgactcccaacaactggaggtgttacacctgccccatcagcatacgctgaattcaaagccactccttgatttttttttc

SEQ ID NO: 17420 - DNA, 354 bp, Zea mays
  Clone ID: LIB189-034-Q1-E1-E9
cacgcgtccgggagacgatgtctcttgccgtggcgtcacccctcgcatcaattccccgcggcatcgccgctcaagctccttgcgcggcattcctgtccatccgcttaggtggcgcgacggcgacggggttcgctggactggcggtggcctctcagcggagcggagcgtcgcgccgctgcgatggtcgctatggcgaacagggagcacgagctggaggagatccgggccatgaccactgaacacatgtaagatgaggtggtagacctcaagggggagcttttcctgctccgccttaaccgctctgctctccacgagttcaccattttttttttttccgcatccgcaagacgattg

SEQ ID NO: 17421 - DNA, 118 bp, Zea mays
  Clone ID: LIB189-034-Q1-E1-F1
ccacgcgtacgcaatagcctccgggccaagtcgctcagcgtcagcaacaagctccccctcgccatctccgtgcacgtcaactactgcggcaagcacgtgccctccagcttccactgcc

SEQ ID NO: 17422 - DNA, 410 bp, Zea mays
  Clone ID: LIB189-034-Q1-E1-F10
cacgcgtccaccaccgcgtccgcccacgcgtccggttaatccaataaaaaaaggacatgagaatcacatgtccaaatgcaaatctaaaaaggaaacaatggcagaagatgattgtacaaacatggggagtgcaacaaatgctgaaactgctgatttggggagctcaatatccagaaacacagaaggccaacaagcagtacaagccgttgacgcaccacatggcccttccaaaatggctaatggaaatgataagaatcatgattctcatatcgaagtgacaccccatgagttgggtttgaagagatcgagaacaaatggagctattttttttatccatgatgagcgaaatattcttaaaagatcagatcaatcagccttcaccaggttacatacatctgtggcttccaatc

SEQ ID NO: 17423 - DNA, 359 bp, Zea mays
  Clone ID: LIB189-034-Q1-E1-F12
ccacgcgtccacaaatcgctccctgcctctggtcacctcgcttccgcacacggctcccctccggctacccagacatcgtccgtgcgctcgccaagagacaggaccggagaccatggcggaccagcggagcgacgaccagatcgccgagttcaaggagggggtcagcctcttcgacaaggacggcgacggttgcatcacaaccaaggagctcggaactgtcatgcgatcactgggtcagaacccaaccgaggctgagctccaggacatgatcaacgacgtcgatgctgacggcaacggcaccatcgacttcccggagttcctcaatcttattgtccgcacgatgaaggacaccgactccc

SEQ ID NO: 17424 - DNA, 315 bp, Zea mays
  Clone ID: LIB189-034-Q1-E1-F2
acccacgcgtacgcaaccgcgtgggtggagcggcccttttttttttaatattatacaacagccagattttataatccaaggaaacaatcccgggtttcaatgcaatgtgtaccaatcatacaaagggggctcttggaacagccagcaaaataacggggggcatagcatatccaacgaacagcggccaaattaccactattataaactatccatggtgcacagcatccgaacaattaattccccacagctcaaaaaccgatgctgaaccgaacgaggaagaaccctgagcatcacatacactcagtaagcaaacac

SEQ ID NO: 17425 - DNA, 391 bp, Zea mays
  Clone ID: LIB189-034-Q1-E1-F6
cacgcgtcaggaacacctgaaacttgcggtgtcactggctggtaaccagagtgtgagtgagtgatcgagctaactgagctccgatcctcgctagctaggataccgccataccacaagtcgtctgcacaagtttaggagtgacagcaacaagagagggatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgccaaaacgatcgcgtctttttttttgggcatcctggccatggaccagttcaacgcgaccttccggaagcggctggcgtccatccggctg

SEQ ID NO: 17426 - DNA, 404 bp, Zea mays
  Clone ID: LIB189-034-Q1-E1-F8
ccacgcgtacgcacgccccggagatcttcggcaagatgggcatcaacacccggagaccgcgctgccgtggttcaagacgggcgtcatcccgcccgcgggcacctacaactactgggccgggggggcacactcttcgtcttcaacatctcgggggggggcttcgccgagcaccgccgcctctagtactggtacaacccgggctccatgggcaaccagtacttcctcggcctcgagaagttcctcgccggctccggcgacccctcctaccccggcgggcccctcttcaacccgctccgcttcggcaacaccgatattgactgatttgatctcaacctcaaggagatcaagaatggcaggctcgccatgctcgtcatcctccgttacttcatccatgggctcgtcaa

SEQ ID NO: 17427 - DNA, 354 bp, Zea mays
  Clone ID: LIB189-034-Q1-E1-F9
acgcgtccactactcttcagacgatatttttaaatcaggtataataaaatccgttttgtacaaatgctggactaacttctcgctttttctatggactcttttatttttttgtgtttgttttttgggtacttagttttttttttgttcttgtctcggagtttggtgtccctttgatgaacgaagactatgtccacgggcactcagatcacatgcctcatggaatacaactcccgcttttgcctcagtcggagtctacatcggagtttcagcctctggaatattaggaagttgaatattttttcgcttcggacgcttctttttttttttttttattcatattcgagtcattttctt

SEQ ID NO: 17428 - DNA, 390 bp, Zea mays
  Clone ID: LIB189-034-Q1-E1-G10
cacgcgtcagagataggtgttcctgatgaacctctctgctcccttaatatgtgagttcttccgtgatgcccaaaagaaggtcctcccgtatgctgactacatcttcggcaacgaaactgaggcagggatctttgccaaagtcagaggatggaagacggggaatattgaggagattgctttgaagatctctcaacttcctttggcttcaggcaagcaaaagaggattgctgtgattactcaaggtgctgatccactggttgttgctgacgatgggaaggtgaaaacgttccctgttatcctattgcccaaggagaagcttgtttttttttatttgccaagtgatgctttcgtttgaggcttcctctcacacttggttctaggcaagggcat

SEQ ID NO: 17429 - DNA, 389 bp, Zea mays
  Clone ID: LIB189-034-Q1-E1-G12
ccggcgccacccacgcgtcagcagacgcgtgggcgacttgtttcattgattcttgaaaagatcgagcttcttttgcaccacaaggtcgaggatgtcttgcaactgcggatcaagctgcggctgcggctcaagctgcgggtgcggcaagaagtaccctgacctgtaggagaggagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatttttttttatggatatgattattatctatctagcttgtggtggtggttgaacaataa

SEQ ID NO: 17430 - DNA, 298 bp, Zea mays
  Clone ID: LIB189-034-Q1-E1-E11
tcccggctggccccacgcgtccagcaacagcagctccgctcgtcgatcagctctcggctaaccactcatcgccagtgggtgcctgccgaccacgtctcgccgccgccaccgccgcggtagagaggggagggacagggggggaaacctggcccacatcgataggtacagcagggaggtgacacgcaatagagataggggaccggagggcagccggcccgggcccaacaccgaggggctcgtgcgcaggacgctgatgatgctcctgtccctcgtctccttcagctcccctgctggaccc

SEQ ID NO: 17431 - DNA, 412 bp, Zea mays
  Clone ID: LIB189-034-Q1-E1-G2
gcgtccgcaaccacgtgggcagcggcacagaggtgcgacgtaagaaaacgacgacgcaggcgccacacatggcatcccagctctccgccgccgtgccccggttccacggcctccggggctggggcggcgcccaggtccgcggtggcagcactggggtgggtgacggtgcgcacgaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgaccgcggcgcttatattttttgcgcgcgactccggcctgcataccggtgaccccgccgggttcaccctcgccgacacgctggcctgctgcgccgtcgggcacatcc

SEQ ID NO: 17432 - DNA, 368 bp, Zea mays
  Clone ID: LIB189-018-Q1-E1-G4
cggcccgcgtcaacccacacgtccgggagtgaaggaccgaggagggaaacagagaagatggcgacgaagcgcgacaccgagtcggacggcaaaggctcaaaccccttcggtggtggcgcaactcccccgccctaaccgccgcccctgtcatatgcctcctccgctccgccggggacttcggtggcggcgccttcgttggatccatcttcggatatggacaaggcttgatcaccaagaagggttttaagggctcattcagcaatgcagggtcctctgccaagtagacttttgcaattctctctggcgttcagagtttggttttgtgcttgttgcgaatgctacgtggcaaggatgacattgtcaatgct

SEQ ID NO: 17433 - DNA, 255 bp, Zea mays
  Clone ID: LIB189-018-Q1-E1-G5
cggtcgcctgggcttcctccccctacctagctagccttccggttcctgcttcgagtcggagatgaggcgcctcgatgagctagctggccattgaggagttattgcttccgaagctgctctcgcagctcacaacagcagcgcgacacttgtcgatgttctcacactgatagaggacttaggctgacgcacagatgatttaacactattagttcatcgcacacggatgaacctaatgataagtatttcaagaggagt

SEQ ID NO: 17434 - DNA, 414 bp, Zea mays
  Clone ID: LIB189-018-Q1-E1-G8
gggccgagggtcgacccaagcgtcagcccacgcgtccgcggacgcgtgggcggccgcgtgggggctgccagcgcttcattcgagatgttcgcagtaccaaagtagacagtgccgttcgtgatgctcgtatacacgaagacgatcccttgcgcggtattgtctaactgcctctggaaagagtatttcacaagcgcagccagatcaaccagatgtttccccttgctggaagtgtacgatatggccgcataagaatctccatggtcttccgaagtgtgcatgtacaactaccaagagatatgctgggctgggactacgggactgtggatatcaaaccctctgtaaaggctattgacgtgccggaggacctaaagccccttcgactcaaggtccgcacgccattggaacgcgcaaagc

SEQ ID NO: 17435 - DNA, 385 bp, Zea mays
  Clone ID: LIB189-018-Q1-E1-G9
acccacgcgtccgcccacgcgtccggcggaatcaactaccagcctcccagcgtcgtccccggcggtgacctggccaaggtgcagcgtgccgtgtgcatgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggctgcgctcgagaaggactacgaggaggtcggtgctgagtttgacgagggtgaggacggcgacgagggtgacgagtactagacgctctactggcgcggcgtcgtcgggcctgtgtgccactgctatcctgtgatctgccctg

SEQ ID NO: 17436 - DNA, 344 bp, Zea mays
  Clone ID: LIB189-018-Q1-E1-H1
cccacgcgtccgccttccgcggactagttttttctgaagattcggcgatggcggcgacgatcgaatccgtgaaggcgcgccagatctttgacagccgcggcaaccctacagtcgaggtcgacgtgttttgctcagatggaacctgtgcaagggcagctgttcccattggagcatcaactggtgtatatgaagctctggagttgagggatggtggctctgactacttggggaagggtgtctccaaggctgtgaacaatgtgaaatctgttattggacctgcactgattggctaggaccctacagcacagactgagattgataacttcatggctcagcaacttgat

SEQ ID NO: 17437 - DNA, 420 bp, Zea mays
  unsure at all n locations
  Clone ID: LIB189-018-Q1-E1-H10
tcccgggacgcgtccaatttgactgctacagatgcaagaaatttgcggaacactattgggccctggaactgtgaactttgtgaagatcaagacatttcatcagaagctgcaaccgttagcgataaatcacattgtaatggcaagaaattaccctttgcacagtgtggcatgtgccatggcacatcaggtgcatttagaaagactgtagatgggaagtgggttcatgctttctgtgctgagtggttgttggacaccaagtatgtaaggggacaagataaacctgtanaaggaacggaaagccttgtagagggaaaggacacttgttgtgtctgcctccacaatgttggcgtgtgcttaaggtgtagcagtggggattgcaacattacatttcatcctaattgcgccaaaaatttgtggttt

SEQ ID NO: 17438 - DNA, 387 bp, Zea mays
  Clone ID: LIB189-018-Q1-E1-H2
gccgacctaaggtccgaaaactgttctctgacaatgaccctggactattcacggagagtctgcggaaatacgaggaagagaaagcgagagagaaggaggttaagtcgaagcaagaggccacatggagacgccttgaagagatggcatcagcgaaagcgacaagcggcgcggcagttctcgtctctcgacccttatcccggcagtcttcggctgtgtagcgaattttcatgtggtggtcgtgagaacattgtacaggattgagttgtatatacgaggtatattaaggtgggcaaattgacaaatgatatcgtcggagaagccagccagatgggttacagggctaggcacacatcattttcttggtcccgaatctgggcttctgctaag

SEQ ID NO: 17439 - DNA, 356 bp, Zea mays
  Clone ID: LIB189-018-Q1-E1-H3
ggccagtctccagcagacgatctcagcgaacatgaggccgggatcatggactacagcatgggtagccaggaagccaactgtggaagcagcttcttgcgcgagtctgttgctaagatgcacttctcgaccgccgaagcttcctgagaggcgtgcctcagttctgtaaatatgatggacgggatgtgtataaataaacccagcatgctgttttttttcgtcgtcgttgtgtgcgtttgagagctcgcctagtgttttggaacaataatttttggacagactatgtgttctgtatgttttggtcgtcagacatatctatcctcagtccatggctttgcttaacggtttaacctggactc

SEQ ID NO: 17440 - DNA, 362 bp, Zea mays
  Clone ID: LIB189-018-Q1-E1-H4
acgcgtccgggggaatgttggtgaggaaaggagattgttggaggaaggtttgaagctattccctgcattcttcaaattgtggttaatgcatggacagatggaagaccggcttggtaatggagcgaaggccaaggaggtttttgagaatggcctgaagcagtgccctagttgcatccctctttggctctctctagctaccctagaggagaagattagtggcttgagtaaatcacgtgctgttctcacaatggctagaaagaagaaccctgctacacctgaactctggctagcggcaattcgagctgaattgaggaatgggaacaaaaaggaagccgatgctctactggccaaggcattgcaag

SEQ ID NO: 17441 - DNA, 386 bp, Zea mays
  Clone ID: LIB189-018-Q1-E1-H6
gacccacgcgtcagcggacgcgtgggtccgtggccgatctactcgatctggatcacaaagagtgagcctgaaatccttagttgttacagttcccatttctagctgcttatctacaagcgggcatcctctgcaaagttgcaatggtctaagggatggcatttggcgaagcagggaacaactttatcacacgtttcttagatgcactgaaacgaagttgcttagtgttgacactactaaagccactcgaatttaaccccaaattgtatcctttgcagcgaacttcttcagttgtgtccttgtatgccaccgtggtagagtcctggctaatttaacacaccaaattgtcttgacattttaactcttaagatatcacctgtagccactga

SEQ ID NO: 17442 - DNA, 315 bp, Zea mays
  Clone ID: LIB189-018-Q1-E1-H7
aggtaggatgttttcttatgaagaactgaagcttgcgacgtccaactactcacctgatatgttaattgggaagggtggaaccagccaggttttcaaggcacaacttgatggcggaacatttgctgccataaagattctgaaaccctcggttgatgcaatacacgagtttgttacggaggttgagaccgtaaccagcttgcagcatgagaacattgtagcactaaggggattcagcttcgagaactacaaccttgtgttggcatatgattacatgccccgagggagcttggacaaagctcttcatgggaagaatga

SEQ ID NO: 17443 - DNA, 193 bp, Zea mays
  Clone ID: LIB189-018-Q1-E1-H8
ccacgcgtccagcggaatcgacggcatccggcgtggctgggccaatcggcctgaaccacctctgcccggcccagattcaacacaatccaggcccagctcatgttccagcaccagcatcagatgggcctgcaccccgcgttcctgcgcccgcgggcgcagccgattaagcaatccgggtcgccaccggcacaat

SEQ ID NO: 17444 - DNA, 343 bp, Zea mays
  Clone ID: LIB189-019-Q1-E1-A1
aggtatctgctgtgggctatgcaatcgcaccaaaataaattctagccgatgataattatgcaacttaatgaatcgatccctacatccagagttacaatttggctccatataagcggtagactttttatatctcatacggttccgatagaacaccagctaacatgtcccaacctattcgggccatatgtgaggtattctaacacaaacggtcccaaataggaaccctttgtggtgctcgattcgtttcacaaacgggcgaaaatataaaaaccgtctgtgatgcgcgattcgtatcaaatgccattcgtaattagacccgaatgggaattgattaccatagatt

SEQ ID NO: 17445 - DNA, 164 bp, Zea mays
  Clone ID: LIB189-019-Q1-E1-A10
agctagttctagaccgccgaccggcctggcctacttcttgagataatcaagatcattgcggacacaaatattgatgtggaatcagctgagattgatactgaaggtttggttgcgaaggacaagtttcatgtaagttacagaggtggaaaactaaacagggcctt

SEQ ID NO: 17446 - DNA, 281 bp, Zea mays
  Clone ID: LIB189-018-Q1-E1-E7
acttcattacagaacttcggttctagattcatgccgtgatggagcttcatttggaccataaggtctaagatgtcatgcaattgctggttaatcagcggatgccgatcaaacttcaactgcttcaacgattttcctgagatagatgagactaccaacttcgcgcatgcaaccatcgtcatgtacttgtcattggcgtatactgagttcagcttattatacctgtgaaagttctattactatcagtctgcattaaactcttcatttcattgaatccaaccgtg

SEQ ID NO: 17447 - DNA, 401 bp, Zea mays
  Clone ID: LIB189-018-Q1-E1-F10
aagaaaaaaaacacgagaaaaatcaaatcaggagacggggattccagagagcccctgtcgggtagggaagggaaggagaggcgaagcggaggcgagatgggggcggccgaatccgtgccggagacctccatacacgaattcaccgtcaaggattgcaacggcaaggaagtgagcctggaaacctacaaggggaaggtcctccttgttgttaacgtcgcctccaaatgtgggttcacggagaccaattacacgcagctgacggagctttatcagaagtacagggacaaagacttcgagatattggcattcccttgcaatcagttcttgcgacaggagccaggtactgatcagcagatacaagactttgcttgcaccagatttaaagctgaatacccagtttt

SEQ ID NO: 17448 - DNA, 390 bp, Zea mays
  Clone ID: LIB189-018-Q1-E1-F11
agcggacgcgtgggaaaaggggtactctttctacaactacattagtattagtctcgaaatgctttaaacgggaaatagctagtgtagaatttatctgatatagaacactcatatcgataaaatagtttgaactatttactagaagggcacgcagccctttttccaatgccaaatcgacgacctatgtataaaaaaaagagaaattttttggatttgaagaaaaaataaaaggaattctatcaatttttattttccatttatttagttagtttttcttaatgaaattgaaattattaactaacagagcaaacacaaataaagaaacaactttgctgaccatgatagatttttatctagttggaagagtcctcttaatattcatctagtcct

SEQ ID NO: 17449 - DNA, 341 bp, Zea mays
  Clone ID: LIB189-018-Q1-E1-F4
acccacgcgtccgcccacgcgtccggtatcctctcagttgctgccattgataagggcactggaaagaaacagaatcacaacatggtgcaatacccaccaaggtaagtttaaaaatggaaaaaaccataattttccagggggacaaagagaagagagatgcaatcgacaccaaaaaccaggcggactcagtggtctaccagactgagaagcaactgaaggagcttggcgacaaagtccccgctcctgtgaaagagaaggtggatgtgaagctccaggagctcaaagacgccatttctggtggatcaacacagagtatgaaagatgccatggctgctctgaac

SEQ ID NO: 17450 - DNA, 396 bp, Zea mays
  Clone ID: LIB189-018-Q1-E1-F8
cccacgcgtccgcttcaattctttgaaaaaccaaagggtgctgatttgaattctatgagagttgagaccaacttcctgagctatgctatagatgatgcacagaaatatccataccttgcatcaatgggcatttatgtcttcaagaaagatgcacttttagaccttctcaagtcaaaatatactcaattacatgactttggatctgaaatcctcccaagagctgtactagatcatagtgtgcaggcatgcatttttacgggctattgggaggatgttggaacaatcaaatcattctttgatgcaaacttggccctcactgagcagccttccaagtttgatttttacgatccaaaaacacctttcttcactgcaccccgatgcttgcctccgacgcaa

SEQ ID NO: 17451 - DNA, 393 bp, Zea mays
  Clone ID: LIB189-018-Q1-E1-F9
agtgaagaagctcaacaagaacaagaagctcatcaagaagcttgctcgcaagtacgatgccttcgtcgcttccgactccctcatcaagcagatcccccgtctcttgggtcctggtctctccaaggccggcaagttccctacccccgtctcccacaacgaggacctttccgccaagatcaccgacgtcaagtccaccatcaagttccagctcaagaaggttctctgcatgggtgtcgccgtcggccacgtcgacatgaccgatgaggagctcgtcggtaacgtcatgttgtccatcaactacctcgtctccctcctcaagaagggctggcagaacgttggctccctcaccctcaaggcttccatgagcccccccaagcgtctctactagacgtt

SEQ ID NO: 17452 - DNA, 349 bp, Zea mays
  Clone ID: LIB189-018-Q1-E1-G12
cccacgcgtccgagggtttccttcctcctccagtgctgtcatcgccgccgccaccccggtttccttcgtaagcccgtcgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgcacgagtctgaaagggaggctaggaggctgcgttgaggcgggatactgtcttggtagttttcgtatggagttg

SEQ ID NO: 17453 - DNA, 384 bp, Zea mays
  Clone ID: LIB189-018-Q1-E1-E5
cgggccgacccaaacgtcagcccgtgggctcattgcgtgcctcctgccgtgttcgatcgatcggatccccatacgatctactagctagctaagctacacgactcgaccgaggaggaggagcgcgctcaggccgtatagaaacttggagcatgtcgttaaccacccaagtgtttgggcctcccggctacaggcggtggtggatctattacatcgtcaacgatactgatcaattgagtaaagctctgaaccgacatgatcacctggtggtgttcatgttctcggcggagtggaacgaaccctgcaaggcgatgaagaaaccgttcagggacatggccagggctagaaagatgcaggccgtattctgcttggtggacatcgacaagc

SEQ ID NO: 17454 - DNA, 247 bp, Zea mays
  Clone ID: LIB189-018-Q1-E1-D1
gcgtcaagtctaggtgcaaaaaagcgggaaacaaagcgaagttggggcggcgagacgcgagacgcgagacgcgagaaatggcggagccgcctttggccgccggctgcacgacaaactggaggagggaggccgatgagcggctgcggtcccgccagtccctcctcttcggcgccgactccgcactcgaccatggggatcctacggtcgcacaggcgctcgctctcttcctccacggcatcctcctact

SEQ ID NO: 17455 - DNA, 373 bp, Zea mays
  Clone ID: LIB189-018-Q1-E1-D12
cccacgcgtccgcccacgcgtccgagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctgggg

SEQ ID NO: 17456 - DNA, 376 bp, Zea mays
  Clone ID: LIB189-018-Q1-E1-D2
agaataaagggtgacagtgaagctgaaagttcgagtgatagcagctctgaagatgctagaagcaagagacaccgccatgggcggaagtccaaggcatcatctcaagtttttgaggaaaatattgctgcagtgtctgctttgaaggatgccacgtcacctcaacgaaagagtggcataccaaacagtccagcacaagatgtctccccgctgcaaaatggggaaaactatacaaatggtgttaatgaatcaaaaattgaaaggaatgcagctgtcatgcctgttctaactggcaaccaaagcaaatctaggagccagagcatgagtgttaatcactcaatgagcaagagtatgagcatcagcccaagaagaagcccaa

SEQ ID NO: 17457 - DNA, 336 bp, Zea mays
  Clone ID: LIB189-018-Q1-E1-D4
cgcgtccacggaagcgtgggcgcatgtgaggtgctgtccagcattgagcacaataatgcagaatacttgcgggatgacccattgacggctgcttcgctggtcaaatcacctctgtgtgcagaaacattaggcacagtataaatgatgaaggatacaacggattgtcacagttttggtgcctttgactgtaattggcagagtttctggggacacagtggaatggattaattgcacctgatcactctgtatgtcgctgtcatgtctgcaatgttcaagacgtacgtgatatagaatggaaatatatgccgcataggtacgagagaagggctgtcgctc

SEQ ID NO: 17458 - DNA, 366 bp, Zea mays
  Clone ID: LIB189-018-Q1-E1-D5
agattctagctaaaagtcaaactgtggctggatttttccttgttcaatatgctcacttgtggcaagatcatcttaacaaactttttgacctgtatgcctctggaaagctaaaggtttccctagaccccaagcaattcttgggtgttgcttcagtcgtagatgcggtcgaatatcttcattctggcaagagtgttggcaaggtcgttgtgtgtattgatccatcatacggtcagatcgttgcaaaattataatccatggacatgatgcgcattgtcttccatggtcacgtaggttactgtcttatagttacacatatacctcaagaccgtattttcccagcgggtgacaaatgaataagggaacatg

SEQ ID NO: 17459 - DNA, 390 bp, Zea mays
  Clone ID: LIB189-018-Q1-E1-E12
cccacgcgtccgcccacgcgtccgattgcagcagaactggaaagtgaagcggcagcgggctgttgggagtccaggaagtgaaggcttcatgtttgatctagttgatagttctcagctagacacaacaacagtgcttcgattatcaccattatctttaattccgattgatcaagactcttcaggcactttgtctgtacaaattccacagaagtctttgcgttccttgagccttaaatttcatggagacatagtcaatattgcagaaagcagtgctatcaaaaagaaagaaggcacatcaaccaacactactgctgaagccgaaaatgatgttttggcagatgatgatgtcaataagtctattagacatgcaaattccatccttcgtgatat

SEQ ID NO: 17460 - DNA, 378 bp, Zea mays
  Clone ID: LIB189-018-Q1-E1-C8
agagtgcatccaaacaggagggctaatagttgtactccctccgtttctttttattagtcgctggatagtgcaattttgtactatctagcgactaataaaaagaaacggagggagtactattttttagctaaaccttgaactagttattagccaactagctagccaacaccagctactttgagctccacatcccaactagtaactagccttagctcatccaaacaagccctaaaacatgaaattgatgcttactatgggcatttggtgagaattttaggcctgatgggattgcagaaatttgagtgcaaacagcaaagtgtttatctctctgttcagctagcttattggtttcattttcatagtcttcttacgagaact

SEQ ID NO: 17461 - DNA, 409 bp, Zea mays
  Clone ID: LIB189-034-Q1-E1-C8
gcgtccgcaatcaacgatgaatccggggagccagcacagcttgttattgagaggagagaagaaagaccatcagtgatgaacgctttcgagttaatctctacgtctcagggcctcaatctcgggaggctcttcgagaagcaaacgggttctgtggagggagaaacaaggtttgcgtcaaggcttcctgcaaatgagatactgtcgaagatctaagcagcagcaggacccatgggcttcaacgttcagaagcccaactataagctgaagctgcaaggggagaaccctggaaggaaaagtcacctggccattgcaacattttttttttttcctgcttgtgcctagacttcctgcatggtctgttgtgctgttcttggaccctctgtgctttagactgaaaccaaagataaaa

SEQ ID NO: 17462 - DNA, 426 bp, Zea mays
  Clone ID: LIB189-034-Q1-E1-C9
cacgcgtcagagacaaccatctaccagcgattcagcgagcgagagcagcacacacgcagctagctaggagcagcagcagcggcggcggcgatggcggcctccatgatctcctcgtcagctctggcggtggcgcctcagggcctgccgcccctcggccggggcgcctcctccttcgccgtcgtctgctccaataagaagatcaagaccgacaagccctacgggattgggggtggcctgactgtcgacgtcgacgccaacgggagaaagggcaatggcaacggcgtgtaccagttcctcgacaattaccgtgccaacgtccactgtttttttttactctacaaccacgatgactggtctcccaccggcgacgtctacctcggtggaaccactgggcttcttatcttggtccgtaccccttcctgggga

SEQ ID NO: 17463 - DNA, 383 bp, Zea mays
  Clone ID: LIB189-034-Q1-E1-D1
cacgcgtacgaaaggggaaagcatcatagcaacagttttcaagaatgtggagcatccggagaacaacgagaagccgatggacaagtgcaaggttaagttcaagattgtcagcctgaaagtcggggggccggtggagtacgtccctgaactggtgggtgagcagaaggaccaggtcgcggttgagcaaatattgcgggtagtattcttggatgctgagcgcccaagcccacaaatggacaaactcaagcgccagctagctgaagcagaaccagcccttgaggcacgcaagaaacctccagaggacaatggtccccttattgtttgtgaaggccttgtgattgacgaatggaacgaacgaagagagaggtaccttgctcgccagc

SEQ ID NO: 17464 - DNA, 377 bp, Zea mays
  Clone ID: LIB189-034-Q1-E1-D10
tccggcggccccacgcgtcaggacgcccttttttttttttttttatatggtatccaacactttgaaaccatcaaatttgatctccttccatatttcacaagctgcggctagttcagcactccatttgcaagctggggggataatttcattaccttcacgagcaagatggcgcccttcgttacgagcttgtacacaggcttctaaagccacacgattagctgctgcaccagctgcatttccccaacgatgtcctaaagttcctccaccaaattgtaatacggaatcatctccaaagatttcggtcagagctggcatatgccaaacatgaatattttttttttcaccggtataacacctggcattgatacccagtcctg

SEQ ID NO: 17465 - DNA, 384 bp, Zea mays
  Clone ID: LIB189-034-Q1-E1-D12
ccggcggcaccaccgtcaccacgcgtccggaagataataaagaaagtccctatagaagtcggcaactgcacaggatttgcagtcaaccgtacattttttccttacacacagggttctcatcttctagttagggggggtattgatgttttcagaattgatcgaggggggagcacctttggcatgccaatgggaccttttcaactccaagatgtggctgggtatggagttgccttggcagtaaaggatatctacgctgatgcctttggacaaagaaatttggactctgaccttgtggatttgatggtaaaggatggacgacacggaaatgttttttttataggttactacatttatgacaagggtgggaagccaaagccagatcct

SEQ ID NO: 17466 - DNA, 427 bp, Zea mays
  Clone ID: LIB189-034-Q1-E1-D2
cacgcgtacgcagacttctccttcgccctcttcaccggcggcctcagcaacccgaggttgatcgcggtgtcggagcccatatcgttcaagaaccccaaggcgcccgtgttcccgcgcctggcgcagggcacgtcccacgacgagatgacggtgacggggaccagcggctacgccatcgatgaggcgtacccgttcgtggagtggggcgccctggtcgccggcggcgtccggcacaccgcgcgcgcgcccgccgggacgctcaccttcaaccgcggcagcatgtgcggcgagccggcgcgcaccgtcgggtggagggattttctttttcatccacaccgccttcctcagggacctctggcccaacaaggagtaccactaccggatcgggcacgagctccccgacgggtcggtggtgtgggcaagccct

SEQ ID NO: 17467 - DNA, 271 bp, Zea mays
  Clone ID: LIB189-034-Q1-E1-D3
ccacgcgtacgcagacgcgtgggcgatcggccatcatctgaatgtacaagcacgagacggggatacagcggattcataaaccgtcagagtgttaggacaagatggtggccaatggtgatgcggctgctagagggagcgcggcggcaactacaggcgggcgtacgcctatgaccacaagcggtgctgctgccggtcgaggccgtgccagctcaatgctccaattctacactgatgatgctgccggccgcacaatgtcactaaacactgttct

SEQ ID NO: 17468 - DNA, 389 bp, Zea mays
  Clone ID: LIB189-034-Q1-E1-D4
cacgcgtacgcacagtcctcctccactaccagagcatgcgcattgaccacgacccgaaccgccgccgccgccgccgctcaccctccgagcgccttcctgctcctcctcgtactcctcggttgcgcgtccctcgcgatcggaggagcaaccatgggggggcacgtcctctgcggcgtcaaggagaacccagccgcggccaacagcgccgattccgacgggctcggccgcttcgccgtcgaccagcacaacacgcgcgagaacgccctgctggagttcgtgcgcgtggtggaggccaaggaacacgtggtggccggcatttagtatttttctcacgctcgaggccgtcgaggccgggaggaagaagctctaccatgccaacgtctgggtca

SEQ ID NO: 17469 - DNA, 414 bp, Zea mays
  Clone ID: LIB189-034-Q1-E1-D5
gcgtccgcaaacgagtccgcccacgcgtccgggtacccgcaaaagttgttctggtggcacatgcacctcgggctcaggaattcaaggggacttcaatcttaataatcttgaagatggtagagtggcctcagcatttatggttgggttgttggtgtggtcgttgatatttgcaagccttgtaaaaagatataatcctttcaggcttattggtgttggcttgttagtgtggactatcgcaacagctggttgtggagtatcatttgatttctggtcaattactatatgccgcatgtttgttggcgttggggaatcttcattttttagtctcgcagctccattcattgatgacaatgcaccggtagctcacaaaacagcatggcttggtatgttccacatgtgtttaccaactgggat

SEQ ID NO: 17470 - DNA, 366 bp, Zea mays
  Clone ID: LIB189-034-Q1-E1-D6
gcgtccggaacgaaaggggcggcgtgctcgccgccgacgccaacaaagacggcggcgtgcatctgggggaggacgacgtggcccgcctcttctccttcgcgcacagccacctccgcgtcaagatggcccagctcgggtactactattactgctgatgggtcgtccgccgatcgatcggccaatatggaggcatggagcatatggcatcgatcgatgggtttgtcactactccatcgtcacttgtttgtcacagctgggtgggttggatgtgttgttgctactttttttttttctctcacgtccgggtggatgtgtgttgttatttactgttacctaaaatcatcacttccacaaaaaaagggcggc

SEQ ID NO: 17471 - DNA, 353 bp, Zea mays
  Clone ID: LIB189-034-Q1-E1-D7
gcgtccggagttagacaaaagataactattgctaccttgtcaaaacaagttccatgcggcttgtgtggacctatggactcacctcatggagaacattctgccctgtatgcaagcgggactcaggtgctggaacgtcagacccccctgtatcaggggcgagccctttgctttcatcatccgccacacgcttgccggaatcaactgtgttggcttccttgctgtctacagcaccagcctctccccccatgacgatcacccagcatccttttgttgccgtcaatatcccccaattactctgttttaagttccactatccttcttttttttttttcctacgttttatccaaactcat

SEQ ID NO: 17472 - DNA, 443 bp, Zea mays
  Clone ID: LIB189-034-Q1-E1-D8
gcgtccggaggcaagggtggcttctcatcccagcgccatcacggcaagtcacagtcccatgtggctttcgagaacacatctaccaatgttgccgcctcgcaaatgcgcaatgcgctcaacaggcgggccgacaccgtcaccgaccccgccgaggggaggtacttcgagacggaaatggacaacttcttcgctctgttccgacgatacctcaatgacaaggccaagggtactgccattgactggaaccgcatcgctcctcccaaggccgaccaggtcgtcagctacgatgacttggccaacaccgaggctgtctaatattttttttttttggcggtcgttaatcttaacggtggtctcggtacctccatgggttgccttggccccaagtccgtcatccaggtccctcaacgtatgtccttcttggacttgtcaatgcgccaaat

SEQ ID NO: 17473 - DNA, 413 bp, Zea mays
  unsure at all n locations
  Clone ID: LIB189-034-Q1-E1-D9
cacgcgtccaggactctgtggacaagaacgaggcggagatctcgccatcaacactatatgccattgcctgtgtcacggagggggtgccgttcatcaatgggagcccccagaacacttttgtgcctgggctgattgatcttgctatcaagaacaactgcgggatcngtggtgacgacttcaagagtgggcagaccaagatgaaatcggtcctggttgattttcttgttggtgctggaataaagcccacctcgattgtgagctacaaccacttgggaaacaacgacggcatgaacctgtctgcccctcaaacattcaggtccaattttttctttatcagcaacgtggtggatgacatggtctcaatcaatgccattctccatgggcccggcgagcatcccgatcatgttgttgtc

SEQ ID NO: 17474 - DNA, 405 bp, Zea mays
  Clone ID: LIB189-034-Q1-E1-E1
ccacgcgtacgcagacgcgtgggcggacgcttggggggaatagatacaattggtgtagccacattaagttctgcaacgtctgcagcagcctccagattgccattcggtggtggaccatccgggtgtggctcactagatgaccaagatgccaggggggggggaaatctgtatcgcctgctcctacttttatctaaggtttctcagaaggaaaatccatctccaattcctgaatataacagtgccatagagaatgaacgtggtaccaccgatgaacttgcccttgcgctgtatggaatgacctctctgctagaatttcttttttttctttctgtcaatcctgagcttccaccgggagtcccaacagcagttgcttcttctgccatcggatttaaccaatcgtatttt

SEQ ID NO: 17475 - DNA, 277 bp, Zea mays
  Clone ID: LIB189-034-Q1-E1-E10
cacgcgtccaacagatgtggctgctagtttgtttggtattcatggtacaccatctccaagctcagttttggtagatcctcgatatgaaattgtgaagatggcagaaatgcagccatgtgcagagggggcaccaaaagaagaacagatactaaagtggggggcgcagattgacaagccaattctctcttcagaacatgccatctcaaaaagattcgatctactcactgactgtttggatcatcattttgtcaacgaaaatggccattaaagtgttaca

SEQ ID NO: 17476 - DNA, 395 bp, Zea mays
  Clone ID: LIB189-034-Q1-E1-C7
gcgtccgcatgcaatccatcctatcaccgcggtacagcttgaatagacactatggtctagagatgcagaagaagatataatccccacttgcagagaacttggaattggaatcgtggcttagggtcgactatgcagaggtttcttctctagtggagggggactagttgactcactatctgagcaggacttccgcaagcatatgcctatatttcagccagagaatctcgacaagaacgctcagatattccagcgcgtgagcgccatcgcagcactgaaaggatgcacgccatcacaactcccgttggcctgagttcacttttttttttatgacgtctgccccatacctggcacaacaaaaatccataactttatccacaacgttggggcactgtctg

SEQ ID NO: 17477 - DNA, 392 bp, Zea mays
  Clone ID: LIB189-034-Q1-E1-A8
gcgtccgcaaaaaaagcccttgatatccaaggaccacgagcgaacaaactttgattctacagtctgggtcgatctctctatgattaacaaacacaataaaaaaactatatgtactaatcaggttggaatgtttgtatgtactaatcaatttagggggcttgtatatactaatcggttttataatgtagctgctatgaaaaaatcagaactgaaacaaaggacacaacaatttttgccacttcatcaacttcataccatgttttccaacaaggatacaactccaacaacaactatctcaacgtcctgtgattgttgtttttttttactacaaacaccaagtggagatgttatacggttttatcgagatcgacacatttacagatcgtgctttc

SEQ ID NO: 17478 - DNA, 364 bp, Zea mays
  Clone ID: LIB189-034-Q1-E1-A9
cacgcgtcagggagaagatcggctgatgcctgatgcctgcggaggcacaaagtcctttcgggttgctgatcaagcttagctccttctattagcatgtagagcagcactctgggtttctctatcagtgagtcagtcagccagccagtcagtgggttgggggtaatcggagttgtagtagacagtatacatttctctgggcaggcaatcactgtttgaggtgttaacagtgccgttttgccctcccaattaagcctctacagtcggtctaagtgaagcaaaaatgcttaccttgtagtagctaaatttacatgtgcggggatattttttgtaatagaatatttctgcgccccgtacgtggctgttt

SEQ ID NO: 17479 - DNA, 412 bp, Zea mays
  Clone ID: LIB189-034-Q1-E1-B1
ccacgcgtacggactgaagcgtctggtcatcagaatccacaacgtggtagaggaagcaaaggggcggcagatctcaaaccacggcaccctccagtggctctccgatctcatcgacggcgaggacgagggctgctatttgctcgactccgtcgggtgcggaggtgaagctgacagagatgacgatggtaaggcaatcccccaagtttcaaccttgtccttgtttaatccagcaaagcgcgcgtgagacttgcagcatcgtcccggcgccatgactatacgggcggtgttgatgagatctagagggtgctccagagactgtttttcatgtctggtgatctgagggagttcatcctgctcttgcaaggctgcaagcccatccgccgccctctagccactagcatcttccgggacg

SEQ ID NO: 17480 - DNA, 413 bp, Zea mays
  Clone ID: LIB189-034-Q1-E1-B2
ccacgcgtcaggacatcaccgccgcgacgacgatggcagcctcgcaccaagccgcggccaccctgatgcagccggccaagatcggcggccgggcgccctttgcctcgctgccgtcccgcccggcggggcaactcgcctgcagggcgttcggcgggggggccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagatcatttcttatatggaggtgaagggcacgggcacggcgaaccagtgcccgaccatcgacggcggcgtggagtcgttcccgttcaaggccgggaag

SEQ ID NO: 17481 - DNA, 408 bp, Zea mays
  Clone ID: LIB189-034-Q1-E1-B6
gcgtccgcaaaagtcccaccaagctgtcccccgaccactccgaagaacgctccaatggcggcgccggccagctcctcatgcttccacccacgcgcgaccgccagcccgccgtcttctctcagggtcggcaccaaggtcttcgtcgggctcaggggggagaccaagctcggttcgtcggagtcgtcatgcccgaatgtcagcgctgggttccacactgcggtcaaccggagaatctctctcaggttgtccaaaaagaaggcgaccagagcccgcatctcgatgatgcctattggtactccacgtgtgccttaccgattattttttgtttgaacctggcaatggcttgacatatggaacgctctgtaccgtgagcggattatcttcattggggacaatatacatgaagaa

SEQ ID NO: 17482 - DNA, 238 bp, Zea mays
  Clone ID: LIB189-034-Q1-E1-B7
gcgtccggattgatggtgggggcgctgctggcgttcgtggcacacggggctgatgacgcgggccaggtgtacgttgtgcgtatgcttgcgcgcgctcgcttcgctttcgcggcaagtgcggcggggcggttggtggctgcttttttatgaggggggtgggtatgcttgtggctcccgtcatacgatgggacgtccatctcgtgatgagatgtcagatgtgtgtgaaagagttctccgt

SEQ ID NO: 17483 - DNA, 420 bp, Zea mays
  Clone ID: LIB189-034-Q1-E1-B8
gcgtccgcagacacgtgggatttgcaaacaggtcatgtaaataaccatggatgagacaaaagtcttaactgttctaaatgtgtgtcatggatcgctttcaggttctgtttccatatcacaggtgagtaatttaatttcttgtttatttttcggggaggatttgaagattctgggagttgagaagattgcttctcaacaagaaataaagaaggtgtatcacaaattggctctacgtctccacccagataagaatcctagggatgaggaagccaaagagaagtttcagcagctgcagaaggttatatccattcttggttatttatttaaaagagctttatatgatgatactggcatcactgatgatgcactggtgggagaagctgcaaacaatcttcacgagtacttcagaacaatgcacaa

SEQ ID NO: 17484 - DNA, 401 bp, Zea mays
  Clone ID: LIB189-034-Q1-E1-B9
cacgcgtcagccaacacgtccgcccacgcgtccgcccacgcgtccgaacacgcgtccgatcgcccgccgctccaccagaagcctcggcaacgtcagcaacggcggaaggatccggtgcatgcaggtgtggccggcctacggcaacaagaagttcgagacgcggtcgtacctgccgccgctgtctacggacgacctgctgaagcacgtggactacctgctgcgcaacggctggataccctgcctccacttcagcaaggtcggcttcgtctaccccgagaactccacctccccgtgctactaccacggccgctactggaccatgttttttttttccatgttcggctgcaacgacaccacccacgtgtacaacgagctgcacgaggccaacaaatcctaccccg

SEQ ID NO: 17485 - DNA, 398 bp, Zea mays
  Clone ID: LIB189-034-Q1-E1-C1
ccacgcgtacggagccacaagggcatcaaacggctcacggttaggcaagagggcatctaagtttgtcaccaggacagactccaacacaagttcagcctttgggaaaaggaaagcaactgggggggggaggtcacagtgcagatctatcaccagcgaggagggtcctgattcgacctcatcactacaacagacatctctttcaacgtgaagcagcatcagctttttgcggtccaggaaacgcccacagctattctgggctggctctctcaaatgatgctggcccaaggctcacctggacacatgagttacatcacccactcgtcgctgttttcaatcatttaggtggagcactccaagctgctccaatcacagtcacgacgtccacgagaatcccaata

SEQ ID NO: 17486 - DNA, 116 bp, Zea mays
  Clone ID: LIB189-034-Q1-E1-C12
acgcgtccactaccgcgtccgcccactcttccgctcactcttaatataaacccgtcccttcctccaattctctctctgaattctagttctccaacaattacagctctatctccatc

SEQ ID NO: 17487 - DNA, 429 bp, Zea mays
  Clone ID: LIB189-034-Q1-E1-C2
ccacgcgtacggagtagtctctctatcaaagcacttccaggcattggtcatacagtttcatctaaactgaaaagcaaagaaattgaatattgtagtcaacttcgcaatgtttcaaaggatgcgcgcgacaaggatttcggaaaaaagactggtgatggtttatggaattattgtagaggaattgatcattcaattgttggatctgttcaggaaacaaaatctgtgggtgccgaaattaactggggagtcagatttaatgacaacaaagatgccgaacattttcttaacaacctttgcaaggaggtttctctacgcttgtattgttgtggagttcagggacgtactattacccttaaggtgaaaacaagaagggaaggtgctggggaaccaataaaatataagggatgtggtgactgttaaaacacgagt

SEQ ID NO: 17488 - DNA, 372 bp, Zea mays
  Clone ID: LIB189-034-Q1-E1-C5
gcgtccgcacacaagtccgcccacgcgtccgcccacgcgtccgtttctgtatactttccccgttctattgctaccgcgggtcttatgcaatcgatcggatcatatagatatcccttcaagagggggagtaggtcatcgaaaggatctcggacgagtcgggaaagcacgaaagccagttagaaaatggattcctatttgaagagtgcctaaccgcatggataagctcacattaacccgtcaattttggatccaattcgggatttttcttgggaagtttcgggaagaaattggaataatatcgattcatacagaggaaaattttttttattgatgcaaacgccgtacctacaggataaggatagaggaagaagg

SEQ ID NO: 17489 - DNA, 437 bp, Zea mays
  Clone ID: LIB189-034-Q1-E1-C6
gcgtccggacttaaattgttattttcgtcaggagctttaaagatttgcatctctggcaaatcgagttctgcagtagctagttcatcatcagataacgagtcatcttcaatcagtcaaagcggcttgtgtctcatccaagatacaagcagccattggggtactgaattcaatcattgtcatggatcctcttactgaaagttatacaatggaatcaagcagaagtggactaggccctgtgaaagccattgtcttttcccaatggactggcatgctggatttgctggagctttcactgaatatcaactgtatacagtacatttttttatatggaacaatgtctctcaatttaagagaaaaaaatgtgaaggattttaacactgacccagaggttacagttatgattatgtcactgaaagctggtaatcttgggctcaaaa

SEQ ID NO: 17490 - DNA, 397 bp, Zea mays
  Clone ID: LIB189-034-Q1-E1-A6
gcgtccgcaaagtacgagcgacccacgtccacacgacacgaaacaccaccaccaaccagcagccgcaccacgcacccagcgcaaagcgatggcgtcgctcaccatgatggcgtccttcgccgcggtggcggtggccgcgccctcgcgccgcgggggcggcgccgtggtcaggtccgccaaggtcgaccgctgccagcagcccgccacgctatcagcaaccgaggccaggcccgccgccgacggacgccgcgccgtcatgctcgcggctgctgcggcggccgtggcagccatcggcggcgccggcgccgccatggcgggtttttttttttggaccccccatgcgatgaacaagtacgcggacatctgcgtcaccatgcccaccgccaacgtctgccac

SEQ ID NO: 17491 - DNA, 425 bp, Zea mays
  Clone ID: LIB189-033-Q1-E1-G11
ccacgcatccggacactgagtgtcactagttcatactatgaaatgacagagattgcaactcgcatcctgcctaacattgttgtgctcacatttgacccaaatagtgatgtccgaacgaaggctgggcaggctaccgatcagttcttgcaaatagggggcaacaccatgaaaagcttaatacaggagacaacagtgtggctgaaagtactggtgttaagttaaagcctggaaatgcaggtttacttgggtgggccatgagttctgttacacaaaagggtaaaccttttgaccatgccccaatatctactgcaaatgctattaattctcaagcatcaacaacctcgactgccactccagacactcaggcttccacactagcgtatgcaccatccacatccacctcgcttgattaagctgcatcagca

SEQ ID NO: 17492 - DNA, 395 bp, Zea mays
  Clone ID: LIB189-033-Q1-E1-G2
ccacgcgtccaagtaaccagaactttggttccaaggatgagagatgtaaaaggaagtggaaaggcaatcaactacttaacaccaccaaggatcttgcttgctctggttactgcatgggttcgagggggtcgatggtttgacgacgagggaagagcggtgtatgcagctgaagctgatagaattcgcaactgggctgaaagtcgagcacgcttctcgttcaccgacgccatggagatgtacacggaaaacacatgggtttccgtattctcgctctcggtggtctgtgcgttcataatcctctctagctcccgtggacttcttccatgcacatgatttccagagctgtcaaactactagtagacggccatgcatatgctcactttttaccccaccaa

SEQ ID NO: 17493 - DNA, 236 bp, Zea mays
  Clone ID: LIB189-033-Q1-E1-G9
cccacgcatccgaactaattcttataacggctttgggcccaacactaattctcaccaactgctcactgccgttcctaagccatcttctgttcccattccttcacatattgaagtgcaacatctggggctggcatcagtcgtaacctatcacgtcaggggttagcctaagcttacagatctttgcaactgattaccgaactgtcatcgagcctcatgaaattacttatgtaccaact

SEQ ID NO: 17494 - DNA, 391 bp, Zea mays
  Clone ID: LIB189-033-Q1-E1-H1
acgcgtccaacggaggacatcgacctgcccctcacccgcacacgccccgtcaagaaggtggccctcgtggtcctgaccggcgagcgcggcctctgcgggagcttcaacaacaacgtgctcggggagggcggaaacccgcatcgatgagctcaggcaggtgggcctccagtacaccgtcgtcagcgtggggaagaagggcaacgcctacttccagcgccgcccctacatcccgttggagcgcgatctggaggtgagcagcgtgcccaccgtcaaggactcgcaggccatctgcgacctcgtctactcgctcttcgtctcttttgatgtggacaaggtggaagctgccctactccaagttcgtgttcctggtgcgctcccgacccatcatcca

SEQ ID NO: 17495 - DNA, 248 bp, Zea mays
  Clone ID: LIB189-033-Q1-E1-H10
cgcacaatcaccggtcgcctctcttccgctcccctgcaaacctaatccctccggccaccccgaaaccgctcgctcgctcgctcgctccccgcgcccatagacatccccggataccgtgtctgactatctcactgaccaccaaatgcgcgagttcaacgatgccttcagcctcttcgataacgacagccaccgtttcatcacacccccctagcttggaactgtcatacgttcattgcgtcacaacccat

SEQ ID NO: 17496 - DNA, 420 bp, Zea mays
  Clone ID: LIB189-033-Q1-E1-H11
cccacgcatccgcagacgcgtgggccagaaacagagatagacctgaacacagtgtatgggcacctcgccgctatgacaaatctccgcctgggggtgtttcacatgccttgtcgtcagatttttcggaaatgcagtcacattctggagataatgtcggggaactaacagatggtcatggagacagaaagacagacacaaggggtcatggaggtagccgtggtgttcctgttgaaaatggacataggcatgccaaccgtcgtggtaccccatgtgatccaaaggaaaccaaaatatctgctagcgtgcctgatggaaatatttctttgaggggctctgctagctatggtgctcatgagagacaagtatgggttcagaagtcaagttcaggctcgtgagtttgtccattgatgatactcccat

SEQ ID NO: 17497 - DNA, 328 bp, Zea mays
  Clone ID: LIB189-033-Q1-E1-H12
taagcgtccgaatttttttcccgtaaaaaaattccactagggccgagccatggtacccgtccgcgtgcacaccgtgctcatcaccacccagcacaactacaccgtgggaacgacaagatctccgccgacctcaaggagcacgtcatcaagcccgtgatccctgacaagtacctcgacgagaagaccatcttccacctcaacccgtccgggcgcttcctcatcggcggaccccacggtgacaccagcctcacctgccgcaaaatcatcatcgacacatacggccgatgcggagtccacttttgtggtcccttctccggcaaggacccca

SEQ ID NO: 17498 - DNA, 58 bp, Zea mays
  Clone ID: LIB189-033-Q1-E1-H4
acctgtggacatgttttctgctggaaatcaatatactttggtcactatgaagccaagc

SEQ ID NO: 17499 - DNA, 151 bp, Zea mays
  Clone ID: LIB189-033-Q1-E1-H5
cacccacgcatccaacagctccgctcgtcgatcagctctcgagatgaacaatcatcgccagtgggtgcctgccgaccagctctcgccgccgccaccgccgcggtatagatgggacggataggggaggggaactcgcccacatccacaagta

SEQ ID NO: 17500 - DNA, 409 bp, Zea mays
  Clone ID: LIB189-033-Q1-E1-H9
ccacgagtccgcacagaataccccggccagttgctaaaccataatcataacactggagcacagcagcagcagcctgcagcagtccagcagccgcctgatgagaagcagggagtcgatgacgaggtgaaaagggacttgaggagccgggggctgtgcggcgtcccggtgtcctgcacgtcgcacttcggaggggacaacgccgctgactactgggccccggcggcgctcggcgggatgttccgctagatagagcatacagcgccgccgtgccattgaagcatggtggtctagacgtacgtacgtacgggctgggcgagcagctgtttggtgcgagtatatgtgttcatgacgcttgctgcaggtacagagatcatcgagctgtctaagaatcatcgcgagctagctagct

SEQ ID NO: 17501 - DNA, 407 bp, Zea mays
  Clone ID: LIB189-034-Q1-E1-A10
cacgcgtccgctatgttgcaaatagataaaaaccttcccatcttgcaaaagggttgaagcttggcctctacaatgacgcggggacacaaacctgcagccaaaaaatggcagtatcacttgatcatggggaccaaatgtgaaaattttcatcttgggctgggaaatgctagtatcacttgatcacaaagagcaagatgtggaaaaaaacatcatgggtaaatctatttatgtttatttcctgacaactgtgacaagtcaacagtgacaaaagtatctgatcgtctcttgttctaagttcctggtattgttccaactcttcttcattctatttaatatctgatcatctatttattgtacgtactgattaacaatatgatgactataataatgctggtaggagtgtgaca

SEQ ID NO: 17502 - DNA, 414 bp, Zea mays
  Clone ID: LIB189-034-Q1-E1-A2
cacgcgtcagccaacgcgtccggagatttaaaggtgaatggatagttaaagaagaaaacaagaagatcaaaggacacttagacattcccgagttctcgttcggtgagatcgatgacctgggggtggaagtaaggttcagtgacgacaagggccgcgggtccgacgacaaggcacggatctgcaaggatctcaagtcctttatggccccgattcaggagaaaatgcgcgtgttcgaagaagagctcaagggtagatagcgagcattagcgagaatcggcagtgctaggtgggcgctgccgtgcccgtgctggaatgattattattacatgttgacgtcttgtggtgtctccacgttctaaagtcgtcttcggatgactgggactgtctgtgtactgatgcgatgcacttccggag

SEQ ID NO: 17503 - DNA, 146 bp, Zea mays
  Clone ID: LIB189-034-Q1-E1-A3
ccacgcgaccgaacacgcgtccgggtgcttctggtttcgcacccattcgcctgacggcaagccttactggatcatcaagaactcgtggggccagaactggggggaaaaccggtactacgggatgggcacgggttccaaccttccca

SEQ ID NO: 17504 - DNA, 423 bp, Zea mays
  Clone ID: LIB189-034-Q1-E1-A4
ccacgcgtacggacaccgccacaaggaggagcgtccgtgtagctgccgtcgtcgcgaccgaggccgcgcagatcgactacagctcaagcgtctcggtgttcccgatggaggcctgcgacctgcgtggtggcgacgcgtgcaacgggcccatgtgcggggaggccaagcccgcctcggcggcggcggcggcgagcaggagtgtggtcggggtggacagggactacctgtcctacgacgagccaaagacggtgttcccgggcgaggcgtgcgatgaccttggcggcgagttctgcgaggcgccgtaccaggacggcgtctctttttatctggcgcacgcctgaagaccctgatccatccatttctgtccaccacgctatgtacgtatgtgtagcagatggtttacatctacgtgttagagcccgg

SEQ ID NO: 17505 - DNA, 225 bp, Zea mays
  Clone ID: LIB189-034-Q1-E1-A5
cacgcgtccgcaaacgcgtccgcccacgcgtccggagaccaacaagcaacatagaaagtggaatccagtagcaacaatagagcaacaatggcgaccaagatattttccccccttaagctccttgcgccttccgcaagttttgccaaagccaaaaatttgcggtcaatgtcaaaaacttccaaaagcttcccttcttcccccataccttccatcaatgatagcttc

SEQ ID NO: 17506 - DNA, 368 bp, Zea mays
  Clone ID: LIB189-033-Q1-E1-G10
ccacgagtccgcacttgtcacttgctctccctccaacaagctaataaaggccggtcatccctcttctagctcgtttcattatccatggcggaggagaagcaccaccaccaccacctgttccaggggaagaaggacgaggagcagctcgccgccggggggtacggcgagtccgccgagtacacggaggccacggtgacggaggtggtgtccacgggcgagaacgagtacgacgagtacaagaaggaggagaaggagcacaagcacaagcagcacctcggcgaggccggcgccatcgccgccggcgccttcgcactctattataagcacgaggcgaagaatgacccggagcacgcgcaccgccacaagat

SEQ ID NO: 17507 - DNA, 360 bp, Zea mays
  Clone ID: LIB189-018-Q1-E1-B11
cttgcttgagtagcgaagcgcgagagcaatggcgtcgctgtcgtgcgcctccacgctgccctggacccccgcctcctccccgcggccctcggcggaccgccgcctcacggcctctcgccgggctccgtcgctggtcatcgtcgcccaggggaaggtgaagaaacaccctcaggtcatattgacagatgacatagaagaggtggggaagaaaggggatacaatgaaggtgcgagctggattctaccgcaactccttgcttcccaagggcaaggctgcgcttctaaccccagcagtccacaagcaaaatacaatagtggcatctgagaatgaaaatccacctttaatgccggcaatcatgac

SEQ ID NO: 17508 - DNA, 376 bp, Zea mays
  Clone ID: LIB189-018-Q1-E1-B3
gggccgagcacgcgtccacggacacgtgggcggacgcgtgggcataattctttatacagccaagcaaaggacagcagatgcagtttctacagtggagtcccttcctcgccccaccagcacaaggttcctttcatacgaagaactgaaagtggcaacaaataacttcgagccttcaagtgtgcttggagaaggtggttttggccgtgtcttcaagggggtactgggtgatggcactgctgtcgctataaagaagcttactaacggagggcaccaaggagataaggagtttttagttgaagtggaaatgctgagcaggttgcaccaccggaatcttgtgaaactgattggttattacagcagccgtgaatcatcacag

SEQ ID NO: 17509 - DNA, 350 bp, Zea mays
  Clone ID: LIB189-018-Q1-E1-C12
cccacgcgtccgcccacgcgtccggagcatggtagcccattaaggttacctggccacccagtgaatggtcagccgatggatctggagggctggtcagggattcaaacagaggcttctcagcatatgggggttctacaagcatcatcaatgggctggaatggtgctcctgtacttgctgccactcctgttgtcaagaaagtcatgaggctggatgttccagtagacaagtatcctaactacaactttgttggtcgtttattggggccgcgaggtaactccctgaaaagggttgaagcttcaacccaatgtagagtttacattcgaggacggggttctgtgaaagactctgt

SEQ ID NO: 17510 - DNA, 389 bp, Zea mays
  Clone ID: LIB189-018-Q1-E1-C3
gcgtccgctttatttttttttttggtttcaatgtgtgtctgtatgtactgaactgtacaagcttatcgagaaagatcactgcgagtctacaacaatccacacccaacacaggcggtggacacaacccatccaataatctttcatgagtacagtgtcggagtcatcggccaatttcttcaaaattatcattaatttatgatgttcatgtaactatagtcgtaggataaggcagggccggtttggtttcatcacgcggatgggagcaccttcttgacgatctcatcactgagcgaggcgatctgggcgtcgagcgccttaacagcctcctccttctgcgcctcgaggttggcgagcgcctctacgagctcggcctccaaaccgctgcgccc

SEQ ID NO: 17511 - DNA, 348 bp, Zea mays
  Clone ID: LIB189-018-Q1-E1-C6
gacccacaacgtcagcccacgcgtccgtagccatgggcagcgcatctatcatcatcacctgtcaccgtcctccgccgtcatcgtcacacgctcgaacgctcctccatccatggcgcccaagaacgctctccccgccgccagcggtatgactctggagccgaggtaccgcggcgtccggaagcgcccctggggacggtacgcggaggagatccgggatccggccaggaaggcccgcgtgtggatcggcaccttctacaccgccgaggccgcggcgcgcgcctatgacaccgccgcgctccatttccgcgggaccaaggcgacgaccaacttccccgtcgccttcgacca

SEQ ID NO: 17512 - DNA, 391 bp, Zea mays
  Clone ID: LIB189-018-Q1-E1-B10
cccacgcgtccggtaaactgaagccaactgccaacccaacgaaggccagaactgcgcgcgcggaacctgttcgacgaattggcgcactggctatggcgctgctacgcgccgcgctagcccagccgttatcgccgcgccccgcgctcccggtccgccaccctccgacctcgctgacaggctccaggtttatcctcgacttctcgcttccgccacatccaggccccggcgcgccccggcgcgagtaccccaggatcgaggcgacggcgaggcgaggcgcgcgaactgagagcgccaaggtcaggaaccgtcggctgcagaagaagttcaacggcacggcgacgaagcccagactctcggtgttctgctccaaccggcagctctacgctgtgct

SEQ ID NO: 17513 - DNA, 349 bp, Zea mays
  Clone ID: LIB189-017-Q1-E1-H4
ccgcccacgcgtccgattacagtattccaccttgcccttgacctctactccaagtataacgttacggaaatgctgtcaagtggagggatacaggtttcaaatggtaaggaatatgcactgagcgatgtcatcgataccatcaaacatgcttttgggggatcgccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacatatgatccccttgtgcttgccaattcaactgtagaga

SEQ ID NO: 17514 - DNA, 251 bp, Zea mays
  Clone ID: LIB189-017-Q1-E1-H5
gacccacgagtccacaaaatatccccaaaccctagctcccgatctcgatggcgaatcctcgcgtcttctgcgacatgaccgtcggcggcgccccggcgggccggatcattatggagctgtacgccactgatgttttactcaccgcgtaggaggtggcattgaagatcatcttctttaagttctacctatcgctgattacatcggttcagaagtaacttttcaaagctaacgctcgtccgatcaatctgaac

SEQ ID NO: 17515 - DNA, 389 bp, Zea mays
  Clone ID: LIB189-017-Q1-E1-H6
actggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaagctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagacaaaatccccgcgggtgataa

SEQ ID NO: 17516 - DNA, 451 bp, Zea mays
  Clone ID: LIB189-017-Q1-E1-H8
cccacacatccacccacgcgtccgcccacgcgtccgcccacgcgtccgattacagtatttcacccttgcccttgacctctactccaagtataacgttacggaaatgctgtcaagtggagggatacaggtttcaaatggtaaggaatatgcactgagcgatgtcatcgataccatcaaacatgcttttgggggatcgccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacatatgatccccttgtgcttgccaattcaactgtagagatcatgacacagttccaagaaatttgatttgcctgaagctctttatacagcttaaaatgcaattgttgc

SEQ ID NO: 17517 - DNA, 364 bp, Zea mays
  Clone ID: LIB189-018-Q1-E1-A11
aagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctca

SEQ ID NO: 17518 - DNA, 368 bp, Zea mays
  Clone ID: LIB189-018-Q1-E1-A2
acaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctcctaccaacaacacatcattggtggtgccctctttt

SEQ ID NO: 17519 - DNA, 129 bp, Zea mays
  Clone ID: LIB189-018-Q1-E1-A3
acctcagctgattatcctgagcagtggccaagtctccttcattgggtttcacacaatttagacttgcagaaccaaatttttggtgctttacatgtcctgagggttcttgccagaaaatatgagttcaag

SEQ ID NO: 17520 - DNA, 293 bp, Zea mays
  unsure at all n locations
  Clone ID: LIB189-018-Q1-E1-A5
ggacgcgtgggtggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcanatactac

SEQ ID NO: 17521 - DNA, 369 bp, Zea mays
  Clone ID: LIB189-018-Q1-E1-A8
gacccacacgtcaacggacgcgtgggcggacgcgtgggcggacgcgtggggcacgcagtacgccggcgagatgaagaaggggctcttcggcgtcatgcactacctcatgcccaagcgcggcatcctctcgctgcactccggctgcaatatgggcaaggacggcgacgtcgccctcttctttggcctctcaggtaccgggaagacgacgctgtcgacggatcacaacaggcttctgatcggcgacgacgagcactgctggagcgacaatggcgtgtccaacatcgagggaggctgctacgccaagtgcatcgacctggcgcaggagaaagagcctgatatttggaacgccatcaagtttggaactgtgct

SEQ ID NO: 17522 - DNA, 384 bp, Zea mays
  Clone ID: LIB189-018-Q1-E1-A9
gaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtt

SEQ ID NO: 17523 - DNA, 383 bp, Zea mays
  unsure at all n locations
  Clone ID: LIB189-017-Q1-E1-H3
acggacgcgtgggtgggaattctctgaccgagtgtgtggccaatctctcggccataaagctggagactggtaagttgctgcttgaacccctagaccgactgaagaaggtagacgcccaggtcaattttactcaaggaatccttgaagggattgtangagaggagcttggagttttacctggaatggattcgatctgtttagtcttagctcttcagaagctccttaatttcttttcatctggaaggagtaattcacaatcagaatttgatgtgatcgtgtatgattgcaacaatacagaggaaattctacggctgataagtgctgctgaccgggcaagatcttacttgaggtatgtgagggaccttgctgagaaaactgacatc

SEQ ID NO: 17524 - DNA, 424 bp, Zea mays
  Clone ID: LIB189-017-Q1-E1-G1
acggacgcgtgggttaccataggctcattcatcgaaacgcaaatcagagagacaggaaaagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaaaagaaagagtaaataataaaacaggatattctgtttcataattctgaaatagagttcttttttttagtattactcctcattaggatgtatatattaatcatcctaatttaataaaaaataaatcacccaatt

SEQ ID NO: 17525 - DNA, 366 bp, Zea mays
  Clone ID: LIB189-017-Q1-E1-G2
ccacgcgtccaacggaattcgatggggaaaagccggagccggcaaaggtttgacctgtaactctgcaccggatgatctcataataaggtaacactggcattttggtaaccatagacgaataagaatgagggaaatttcagaacatgttccggtgatactaattagctagaggaaaatttgacacggaaagttccttattctgtacaatgtgcctttgtggtgagtaaagatgtccatttcatatggcctttgtgatgagtatgtctgcattgaaaagttagtgctttcattcttgataatggacacttcgatttgattcaaaaaagataatcagtttcataattctgaaataaaattcatttttta

SEQ ID NO: 17526 - DNA, 373 bp, Zea mays
  Clone ID: LIB189-017-Q1-E1-G4
gacccacgacgtccagcctgcccgagccgccgctcaccttgctaaagtttgccctgtaactcagtaccggattatcgcatagggatgtaacactggcattttggtatccatgaacgattatgaatgagggaatatttcagagaatgttccggtgatgcaaactaactagaggaaaatttgacacggaaagttccttagtctgtacaatgtgcctttgtggtgagtatagatgtccatttcatatggcctttgtgatgagtatgtctgcattgaaaagttaatgctttcattcttgataatggacacttcgatttgattcaaagacgatattctgttgcataattctgaaataaagttcttttttttagtatta

SEQ ID NO: 17527 - DNA, 382 bp, Zea mays
  Clone ID: LIB189-017-Q1-E1-G5
acgcgtccgaaaaaaaaaaaaaaaaaaaaaaaaaaaaaaaaaaaaaaaaaaaaaaaaaaaaaaaaaaaaaaggatggacgtccgccttgagaccttgcctcaccgagtgctctcggtgagctactttgtttcgatttatcacgaaatccgtttgcttcatgttgtgcatgctcatatctgattgctggattcggtaaaccctcattggatcctgtatcggttagtccttgccatgcaaggttcttgtatgttatgttttggtggtcgagcatcgcatgttctgcttctggatccagatctggagaaatcgcgaagtcatcgtcgttcggttcggagcggatctaaagcgactatatatggaggctgcgggatctctcggtct

SEQ ID NO: 17528 - DNA, 378 bp, Zea mays
  Clone ID: LIB189-017-Q1-E1-G6
gacgtacgagtcaacccacgcgtcaggcgttccacgcgtgcacgcatcctcatctcgtcctctagatccaggatggccgtcctccttgagacctggcctcaccgagtgctctcggtgagcgactttgtttcgatttatcacgaaatccgtgtgcatcatgttgtgcaggctcatatctgattgcaggattcggtataccctcattggattctgtatcggttaatccttggcttcaacgttcttggtgttatgttttggtggtctaccatcgcatgttctgcttctggatccagatctggagaaatcgcgaattcctcatcgttcggttccgaccggatctgaagcaaccattatacgaggccgcgggatctctcggtc

SEQ ID NO: 17529 - DNA, 396 bp, Zea mays
  Clone ID: LIB189-017-Q1-E1-G7
acaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccatccctatctttggtgcagtcattggtacaaaccatcagggcacaacagctgcagcaactcgtgctacctgtgatcaaccaagtagctctggcaaacctttctccctactctcc

SEQ ID NO: 17530 - DNA, 376 bp, Zea mays
  unsure at all n locations
  Clone ID: LIB189-017-Q1-E1-G9
gaggacagcaagggctacttgatcattgttagcctgcctttctctgattttcagaaggtgaaggtttcatggaagaatactcttacgaatgggattgttaaggtatcttgcattagcgttggtaggatgccattattgaaaaggcatgatcggactttcaagttggcggatccttctcctgagcattgcccaccaggagagtttgtccgggaaatcccactgcctacccggatccctgaagatgccactctggaagcataccgcgatgaaacggggacaggcctggagattattgtcncaaagtaccgtgttggccctgaagaacatgaggtgcatgtgtccatgagaccgccctcgtcatggtgccaatgaaact

SEQ ID NO: 17531 - DNA, 381 bp, Zea mays
  Clone ID: LIB189-017-Q1-E1-H1
agagaagatggcgacggcggcggcagggttggctccggcaaaggaggtggtggagaagaaggtggaactcctgaaggagatacgggcgcacgaagtggcgatcgcggagctagacaacctgaatccctcccgggcggtgtaccagaaagctggcaacatcttcttctgtaagagcgtcaaatcggtgatcacaacggagcagaagcaacttgaccaagccaaggctcggctgagcaagctgaaccaagcttgatgggcagcacgctacaaatgttgaccttgaacacaatagagcatgcagatttgaatggtcttctcgttgctcattaattctgcagttgggcgttgtggacctaatccatgtgtaatgctactttcttt

SEQ ID NO: 17532 - DNA, 403 bp, Zea mays
  Clone ID: LIB189-017-Q1-E1-H10
ttcccgggacgcgtccgatttgtctgctacagatgcaagaaatttggggaactctattgggccctggaactgtgaactttgtgaagatcaagacatttcatcagaaccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgctcgagtctgagagggaggctaggaggctgcgttgaggcgggatactgtcttggtagttttcgtatggagttggatgtcatctaattgtgctatgtttgtcaaa

SEQ ID NO: 17533 - DNA, 371 bp, Zea mays
  Clone ID: LIB189-017-Q1-E1-F8
ggtacgcgtcggcagacacgtggtccacaagcgcaacgcagtccagtgtacctctgttgcagaaccaggtccaggatatcctgcaactgtcgatgaagcttcggctatggctcacgtcgtaagtgccgcatgaagtaccctgatctgcatgatagcaccaacggcgcacatgccagcgtagtactcgggctggcacacgaaaagcaagcagcacacgtcttactcatcgccgctgaggacttcgtgaacgcgcgcagtgccgtcactgaggtcggcatcgcaagtgcgagctctgcatctgatgatgacatccattaacgatcatcgctctaactacaaccaagcgaccttgtcctgctgcatgagcaaca

SEQ ID NO: 17534 - DNA, 403 bp, Zea mays
  unsure at all n locations
  Clone ID: LIB189-033-Q1-E1-D1
aaccaagcgtccgcgagttcgctgccaaggactacacagaccctcccccggcgccgctgatcgacgcggctgagctggggtcctggtcgctgtaccgcgccgtgatcgccgggttcatcgccacgctgctgttcctgtacatcaggggtggccaccgtgatcgggtacaagcaccagacggacgcgtccgcgtcgggcgccgacgcggcgtccggccgcgtgggggtgctgggcatcgcctgngccttcggcggcatgatcttcctcctcgtctactgcaccgccggcatctcggggggccacatcattctttttttcaccttccgcctcttcctggcgcccagaggtcccccggtgcgcccgctgctctacaacctggcgcagttcctccgcgccatctgcg

SEQ ID NO: 17535 - DNA, 363 bp, Zea mays
  Clone ID: LIB189-033-Q1-E1-D10
cccacgaatccgaacgcgagcgatgcatgttgctgttagcgcatcactactctccgagttggttaccaagaccaagcagatcactgagtccgttgatgtcctcgcgcgacttgcccgcttcagggggcctgaaaccactcagactcataagggtggggctatcgatgtactgagctgagaagcagacgatcttcggtgggacttcactaaagatgctctgtgcctctgtatttgtatcagaagccttttgctgaatggcatacaacagcaagctagtatgaagtccaatactaactgttcatacagcaagtgactgatcctttgatttgtggaatcaattatgatgctggattgtgacggtaa

SEQ ID NO: 17536 - DNA, 312 bp, Zea mays
  Clone ID: LIB189-033-Q1-E1-D11
cccacgaatccgtattttgaccctaactatagacgctatgctctcaaaaaatcacaggtacatgttgacgaatatttcacttattatctcggaatttctggtgctacgtcggctgagagtttttggcggttgtagtgaaattatgcatcttcatgggggctatccactacttgtaaggtttacatgcgaatgtcaccgccttgacaatgtggtatacccagctcgaactctatatgcacacattgccggtattttggtcctagtggataaagtcagcaaagggtatgctataactagctttcaatgggaaag

SEQ ID NO: 17537 - DNA, 405 bp, Zea mays
  Clone ID: LIB189-033-Q1-E1-D12
ccacgcatccgcagatttggtcaggaaagaagagaaggagattgcacagtatggtagagtactgacatcggataacagtgatggtgctggattataaaacgaagatatcggcgatgatggtgaggatatggaaaatgacaaacctttgtctgaggggaaaacctacgaagatgacgggaccagaactgtagtcaccaccagtgaaattactcctgaagaagatgacattgtcccgaaaactttcggccccatggcgacgaccctcaccagcatgaatcctagctcttttgccaagaacaacagcagtttacgtgttattattaagccaccgaagagaacgttcactagcatcgctacagcgaaaacgggtgacaagaacccgggtgcctgcaaatggtaaaacga

SEQ ID NO: 17538 - DNA, 339 bp, Zea mays
  Clone ID: LIB189-033-Q1-E1-D2
aaacaaacggccggctggccatgttctccatgtacgccttcttcatccaggcctacgtcaccggcgaaggccccgtggagaacctcgccaagcacctcagcgaccccttcgggagggacctgctcaccgtcatctccggcgccggggggaggacgcctatcctgtaaggacggacgccacgccgccgagcaatgccaagtcatgcgctgctgcatgccgtctttgattttaccgggataaaaagctgtatgtgagggtctgaagaatgtgcaatgcccacgcgtgtaaattatcgagagggggaatttttcttttcattctgattgtgataaaacaacc

SEQ ID NO: 17539 - DNA, 312 bp, Zea mays
  Clone ID: LIB189-033-Q1-E1-D4
aggggacccgtagcgccagttctcggcggtggcagtaaccactcgttgagaaaacgacgagagcctcccgtcgtcatttcggagataaaaccaccggcactgccaccctttgggcgaggaccctaggatggcacggatgtaggggggggcccgcgcctacctcagctggaggatgcagccaccatcccgcaacgccatgcgaacccttctttcccccgtcggcgatgcaaaaagctctgtggagaaaagattggtccacaggtcccactggggggcaatccccaagtatccttcactaaccgcctctttttt

SEQ ID NO: 17540 - DNA, 296 bp, Zea mays
  Clone ID: LIB189-033-Q1-E1-D9
tgagtcctacaaggagggcgtcggccaaaaattacgcagcatcggcaagatcgtcaaccccatcgacgtcaagttcaccggcaaggccaccttcaactaatcacacttggggtacgccgcacgccccagccgggatacagggtaaagaacttcttcttctattaattacagtgtagtgtaatttggctgctggtacggtggtgccatgatttgacatgtgcatcatgatccttgtgtaattttatcacctagtctcttcttacatttacatgtccatttgcttgcctcttgcatac

SEQ ID NO: 17541 - DNA, 430 bp, Zea mays
  Clone ID: LIB189-033-Q1-E1-E10
cccacgcatccgcacacgcttcagctatcttgttgtcatccccttaatactcaccgcttcatttaatccatcaaatcagatcacagagtctattcatgtcatctctcaaattccttccttcaggggcactccttctactcaacatattagcggtggggcaatttttgtaatgaattcatatatcatggatcttcaatatgacttcagtattcatcctctctacggttctacttcttagatacaccatttgctcagtgcattatttccactctacagtagattgtacaacacaccctgtacatttatcaagtgctttatctttttatttatagaagcagataccaacatgtatcattttaggcattatctattcggtcattcatcagaatgtatctacattgaccttttcaaccatttcaccatttcctcc

SEQ ID NO: 17542 - DNA, 434 bp, Zea mays
  Clone ID: LIB189-033-Q1-E1-E11
ccacgcatccgcacacgcgtccgtcggcttcacgaagaggcgcccaaaccaggtcaagagaacctgctatgctcaggcatcccagatccgtcagatccgccgtaagatggttgagattatgatggggcaggcttctacatgtgacctgaaagagggggtttcgaagttcattccagaagttattggtaaggagattgagaagtctacctccagcatcttcccacttcaaaacgtcttcatccgcaaggtgaagatactcaaggcccccaagttcgatcttgggaagctcatggaggttcatggcgactacaaagatgatgttggtgtgaagcttgagaggcctgtccagggagatgatgctgtgcacgaggttgctgctgccgagtagtttgtttgctacctctatatctaagctgagtccggaaatgacgttg

SEQ ID NO: 17543 - DNA, 249 bp, Zea mays
  Clone ID: LIB189-033-Q1-E1-E12
ccacgcatccgcacacgcgtccgcccaactaagcccgcacgacacaaaaccaggtccaggagctcgagagggcaccaataatggcctgcgtgaactccaccgtcgtcgggctcaaacccgccggggcaatgcctcaagccgccgcctcatcatcgggggcgaaactgttgaacttgggcgcacccgagggcggccttgccgatctgctcggactgtctgtccgtcttccccgtcatcggtcatcaccat

SEQ ID NO: 17544 - DNA, 110 bp, Zea mays
  Clone ID: LIB189-033-Q1-E1-E6
atccacactatctcacattaacttacaatatcaaaaaagtatacaccatcccaaatcacttcaacattcagctcatcaacacctcccttcaccataaccatctcctctct

SEQ ID NO: 17545 - DNA, 292 bp, Zea mays
  Clone ID: LIB189-033-Q1-E1-E8
cccacgcatccacagacgcgtgggctctctctcccctctatgtacaatgtgccctggcctcctccgccgccattgcagcgagcaagatcaatccctctgctgccattcatgagtcaaggtggggcattccctcctgtgaagaacatcagggtggggtttgtcatatgcggcccaagcattggcaagggcacccagtgctccaagattgtcacacactttggattcacccaccttatcgcatgcgacctcctgcgccaacaagttcagtcacatactgaacacggtgccatga

SEQ ID NO: 17546 - DNA, 442 bp, Zea mays
  Clone ID: LIB189-033-Q1-E1-E9
cccacgaatccgaaatctgtccagattctgtgctgatttcgaaaatgaccttgtttgtccaagttaaactgagaatcagctcttagtaattataggagaattgtagtacttgtcttaagctttcgagacaagttttggatcaccttttttggtgatggaaaagttgagttacagctgtttgaattgtgatgtccaaacctgtccaaatctggacagagaagtttgtttgtattagctgactttgatccacattgaatcaacctgaaatgtttataaaggatttgtagataattttataagctttctagaaagtctaagatcacctgttttggatgcctaaatctctagttatggagttttgaagtggataattgaattctgtccaaatctggacagcattattgttttgtactgtttgacctttctaagtgtccaatctcat

SEQ ID NO: 17547 - DNA, 256 bp, Zea mays
  Clone ID: LIB189-033-Q1-E1-F10
ccacgcatccgaacaatcacctgtcgcctcttttcctctcccctgactaacccttccctctggccaccctcaaatcgctctctcgctcgctctctcctttcccccttatacactctcgtggtagggggtccgctcatctcactgactattatatgtgcggcttctccgacgccttcaggcttttcgaggtgggctctcattgtttcatcacatcctacgatcttgtttctgtcattcatttactgtgtcatcattc

SEQ ID NO: 17548 - DNA, 263 bp, Zea mays
  Clone ID: LIB189-033-Q1-E1-F11
ccacgcatccggatgatatttttgaggagataccaataaaagtttacaactcagcgcttgtcagtgcctttatgaaggagctggaacctgagtcacctgttacccactgtgacctgcaccgacggaaattgtcaaccgccccctttatagaaaggggcttggaatttctgattgggtgcatggatgatcgttcatcacaccagaacacgttccaacattataaccgcaatctctcaagacaacagtcacagcaacaggcatgg

SEQ ID NO: 17549 - DNA, 401 bp, Zea mays
  Clone ID: LIB189-033-Q1-E1-F12
ccacgaatccggagaacaccagccgtattgtcccgactcctgacccctaccgatcctcgcctgctgcagccatggcgacctccgcggcgctctccaccgccgccaatcccacccagctctacgggtcccgcgcttcgctgggcaagccggtgagggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtctcctacggcgccttcttcgtccctgccggctccgggaacgccggcggcgggacctacgcgaaggacaagctgggcaacgacatc

SEQ ID NO: 17550 - DNA, 140 bp, Zea mays
  Clone ID: LIB189-033-Q1-E1-F5
cccactcatccaaaaccctctgcgcacaacacgtcctgcaaccaataatactgttacgaatttgcgtatcacacaacacaccgcaaaatatcctttaaaccctgatgtcaactcctcatggtaggatccacaaaccccct

SEQ ID NO: 17551 - DNA, 119 bp, Zea mays
  Clone ID: LIB189-033-Q1-E1-F6
acccacgcatccaaccacacttccgatcaataatccccgacagtaaaaaagccccgccgtgtccgctttcaggtcccacatgacgactccatgggtcagcaagtcaaataacaactcac

SEQ ID NO: 17552 - DNA, 429 bp, Zea mays
  Clone ID: LIB189-033-Q1-E1-C9
cacgcatccggactcatcgccccctgcacggtcacggattactgagtttcttattgccaccagatcgaaaaggggggaggaattaaattgtggagtcgggtggtgagatctgatttatagatggaggttgattagcccggttggtaacatcagtcggtggtggtggtggtagtggtgcaagagcaagaccctgaccgacggcctctgcctccttgcatctctgttcgggtttgtgaagcgcgggctctataaatacgactcagatctgagaggccttctcctcgtccgccccagtctaatccgattcaaaccgcccgttccccgtgtccgtgccaagcaagccgagcccaacccccaagagccagctgctcggtgctccacgcgatggctcagaaggagactaatggcagcaacggcgattacatctcc

SEQ ID NO: 17553 - DNA, 430 bp, Zea mays
  Clone ID: LIB189-033-Q1-E1-B10
cccacgaatccgcacacgcgtccgagctgaagttgttctgcgacaaagactaccctgagaagccaccatcagttcgatttcattcaagaataaacttaacatgcgttaatcatgaaactggagtgggtgacccaaagaagttcagcgttctgggtggggggcagcgtgattactcaatggaatacatcctaacccatctcaagaaagagatgacatcgccacagaaccgcaagctagttcagcctccggaagggacattcttctaaagatggcagcaactcatgtccatccatggtgactcggaaacagcttccgcacctgttttctatattttatatatttagtctgatctcccagttatctgtgaaccaccgagatcgactgcaaccagacttggttgatttacaatttgcccggtggttgctaatga

SEQ ID NO: 17554 - DNA, 411 bp, Zea mays
  Clone ID: LIB189-033-Q1-E1-B11
ccacgaatccgcagaaatgaggatggtttgttgataagttcaatatcatcatgcgcaaatctttgggcaatcattatggatgcaggaactggcttctcagctcaagtttatgagctatcttcagagtttcttcataaggagtggatcatggaagggggggataaaagtttctacatcagttctgttgctggctccaacaatggaagttctattgtagtgatgtcaaaaggcacaccatatacacagcaatcttataaagtcagtgattcctttccatttaagtggataaacaagaaatggaaagaaggttttcatgtgactgcaatggcaacatcaggcaatcgatgggctatagtcatgtcccgcagtgctggattttctgagcaggttgtggagttggacttcttgtac

SEQ ID NO: 17555 - DNA, 432 bp, Zea mays
  Clone ID: LIB189-033-Q1-E1-B12
cccacgaatccgaacgcagagagagaaagagtgggatggcaatggaaaagtcgttgtcgtgcgcggagaggggcagccagtacggcgccggggcgggggcgggggcgatgaacctccggagctagggcgcctcctacgagcgaccgatgacagcggggccgtccacggtgcaccgcgccaggagcgtgagctcgtggagcacgccgccggcgccgccgcccgtgcagcgggccgggagcaccaagagcggccccaccgccgccgccggtggccgggccgccccggggctgaacctgcgctcctacagcgcctcctactctttttcctacgggcccaccctgcccgatacctgcgggcagctgaagcgctccggcagcgtcaccaactggacttccgccaaccgccgctccgtcaacctgagggggtaccccc

SEQ ID NO: 17556 - DNA, 198 bp, Zea mays
  Clone ID: LIB189-033-Q1-E1-B4
ccgcccactcctccgcccactcatacaaagacacctgcgctctaattaacacattcactcaactgtcccttccactaaacctacaacaactccttcaccatgggcaggtgtcctcatcacatccatcatcactcgtgggggcgtccccaccgcccaattctactacatcccatcttcctccctcacctgcttcacccc

SEQ ID NO: 17557 - DNA, 349 bp, Zea mays
  Clone ID: LIB189-033-Q1-E1-B5
cgtccgccttgtcggtctggccctagccaatagcgctacccttgccagcgcgcagtcatctcaaggcacccagggcggcgtgagcctgcactacggtatcggggacggggaccagcgcctgacgctgaactacgggggggggtcgatctggacgtaccacttctgcggcaactggggcctcctcgacctgacgccggaattccgcgcttcgtactggtgggctgacggcgatcgttcgccgaccagcctctggcaactgaacgccatccccatgttccgctggtagaccggcgatcttttttttttccacacccgtatccgcgccaccgtgttctcgcgcacccgcttc

SEQ ID NO: 17558 - DNA, 399 bp, Zea mays
  Clone ID: LIB189-033-Q1-E1-B9
ccacgaatccgcaggcacaaggtcaccgctgtccccgccgacgaaaaagagatctgcggtgccactttcaaggtggtggaagggtctactgtcctgacggcgctgcactgatctatcatcatcaggcggaggcgatgcgatgatgatgcagaacttggtacatgcgttggtggatggtggtgtaacatagtggctgccaacaagtcatgctcatgcaaaccgatgaatctatctctgtatcatcgatctcggttgcttgctagtccagactccagacatggctatatatatatagctggtgctaataaataggagtataatcgtcatatcgatcggttgcgtgtggaatgccaatcatgtgtgtaatctgttggcaaataacaaacctctgttcctccc

SEQ ID NO: 17559 - DNA, 449 bp, Zea mays
  Clone ID: LIB189-033-Q1-E1-C10
cccacgcatccggacagaggttctcttccaatttgagaatagtggaggtgatgacagctatttcctgaacaacgctccaatcattgctgttgatcgggctccaaatgttattgctatcaatgtgggcccaattgaatatggacatgtgcttctcaggcctcgtgttctggaccgcctgcctcataggattgatccagagagcttcttgcttgcactgcacatggcagccgagggaggtagcccatatttcaggcttggttacaatagcttgggtgcgtttgccaccatcaatcacctccactttcaggcgtactacttgtcagtgcctttccctgttgagaatgcagctacccacaagatcccactctctgatgacacgaacaagaattgggtgaccgtgtccaagctgaaaaattaccctgtgacaagccctgtatttgatggaagga

SEQ ID NO: 17560 - DNA, 123 bp, Zea mays
  Clone ID: LIB189-033-Q1-E1-C12
accgtgggtgaattagagagactatatcaaaagatgagaggtacatgttgaggaaagttggattgaaaatgaaacattttctgctgcaaggtcgaagggaagttttgggggcaacaattaaaa

SEQ ID NO: 17561 - DNA, 301 bp, Zea mays
  Clone ID: LIB189-033-Q1-E1-C2
aataaaagagttcgaccggccccgccccgccccaacaaaccgcccccaccgcagcgcccgcaaagcctccaaacaccaccacctatccgccagaagcctcttcctccctcgcggtcgcgccatctgcgccctgccaataaccgcggtggtgaacctcaccctactgaagaagcactcaccaacacccaagccccctgttccctcgccctctccgcccgcgcaagattgacatcccggattcatacatgtgctaccattccatttgatttggcgccgagcactttcctattgccgcctccat

SEQ ID NO: 17562 - DNA, 120 bp, Zea mays
  Clone ID: LIB189-033-Q1-E1-C3
acgcgtccaatttatttttttttactggaacaaaattcaccacataaaaatcccatttacatttcacatatcaacaccacacaatccttttccatgaatcctcatcaatcctccacctta

SEQ ID NO: 17563 - DNA, 99 bp, Zea mays
  Clone ID: LIB189-033-Q1-E1-C4
ccgcccactcgtccgcccactcgaacacacaatcctccgacaattttctcgtaaccttccgggctcctcttcctctcctcacgttctcccatcaaaccc

SEQ ID NO: 17564 - DNA, 99 bp, Zea mays
  Clone ID: LIB189-033-Q1-E1-C5
tcctctcattcttttactgttactgaaaacacttctcgaacctttgtccgcttttaccagaccttccatatcgagttcgtgggagttcgccactctacc

SEQ ID NO: 17565 - DNA, 374 bp, Zea mays
  Clone ID: LIB189-033-Q1-E1-C6
ccacgcatccagtttttgaacagttcactcacagaggcaatttacatagccattctagaagcagctagctgtggactgttgacagtgagcactacagtcggtggtgtccctgaggtgggtcgggatgacatgatagtacttgcagaaggggggggtgcagatatggtaagagctgtcaagaaagccatcgacatgctacctggaatagacccccagattatgcatcttcggatgaaagaactttatagttgggacgatgttgccaaaagaactgagattgtttatgatcgtgcaatggaatctccaacaatttttttactagatcgccttcctcggtatcttacttgtggatcttgggctggaaaactgttttg

SEQ ID NO: 17566 - DNA, 377 bp, Zea mays
  Clone ID: LIB189-033-Q1-E1-B1
ggtcagccacgcgtccaaacgattcaggcgacgctgtcgagcaggacgtagcgtccagtaatgcacactgtgtcgcgttcctcatcaaagacccccaaaaggtgaaaacggtcgatgagatgagggagcggctgaggatgcgtggtctccgctgccacaggaggggctgcatgaactcgacaaggcttcaggttgtccctctgctagcatcaaggtcacaggcactcaggtatctttccgtgcgctggggcgtatctgtggggaacatgtatctgatcaccggggaacatggcgacaccgatctacaggagatgctatccgggtctttatattaccgtgatcgtccgtggcgtcaccgagaagggttcggaagcact

SEQ ID NO: 17567 - DNA, 381 bp, Zea mays
  Clone ID: LIB189-032-Q1-E1-H11
gatgcgagcagctacagcggcggcgacaggcttcttctctccatccaccgtccctccgaggcgcttctcgtccgttacaccgccggcgtcactctgcaccgcgcgctgcatccagcgtcaccgtctccgcgccttcccaagctcggaaatacctctagaggaactcaacccatccgtcgatctacttaggagaactgcggaggccgttggcgatttcaggaaaacgccaatctatattgttggtacggattgcacagccaagcgcaacatcgccaagctgcttgcgaattccataatataccgctacctcagcagtgaggaactgcttgaggatgttcttggtggcaaggacgccctcagagccttcaaggaatctgatga

SEQ ID NO: 17568 - DNA, 417 bp, Zea mays
  unsure at all n locations
  Clone ID: LIB189-032-Q1-E1-H2
cgtccgaccacacgtccgcccacgcgtccggctgcgccaaaatttcaatgttgcggctcaaaactgctggttaaacaagggaggtcctttcactggtgaactcagtgctgagatgctcgtcaaccttggtgttccctgcgtcattcttggacactctgaaacgagagctctgctgggagaatcaaatgaatttgttggagacaaggttgcgtatgccctgtctcagggactaaaggtcattgcatgtgttggtgagacccttgagcagaaggaggctgggtctnacatggatgttgttgctgcacaaacaaaagcaattgctgagaagatcaaggactggagcaacgtacttgttgcctatgaaccagtttgggctattggaactggtacagttgccacctcagctcaggctcagga

SEQ ID NO: 17569 - DNA, 441 bp, Zea mays
  unsure at all n locations
  Clone ID: LIB189-032-Q1-E1-H4
gggtccacctacgcgtccgagaacgcgtcagaccccaagcaccagcgcggctcggcggccgcggggaaccagggttgtcggaaagaacaaacgttgttcgcggggaacacagggggtcacaaaaaaaccggcaaccctttctcaaaaaaggtttggtatgaaatcaaggcaccgtcggtgttcattgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcangaatgtgctcacaaacttttggggcatgaattttaccactgataaactcagattcctagtgaagaagtggcagacattaatcgaagcccat

SEQ ID NO: 17570 - DNA, 390 bp, Zea mays
  Clone ID: LIB189-032-Q1-E1-H5
cccacgcgtccgcccacgcgtccggcttaaatctccgacaggctcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctttttggtacctctcacattcgaacagaggaactctttgatgacgctggaattgacggttacttcgaattgaaagagacaccacctttttatttcaacgagcagcccaaagctatgcagatagaatgtggcaacgtggtatcagctgattgtgcgatgtcaaacccaagggc

SEQ ID NO: 17571 - DNA, 421 bp, Zea mays
  Clone ID: LIB189-032-Q1-E1-H6
gaaaaaaataactcggaaaagaaggagacgccgaaaattcgaaaggggaggggaaagcaaagctgatggcggaggcccaggggaaagcaaagcaaatggcggaggccccgagcaagatcgaatccatgaggaagtgggtcgtcgagcacaagctccgagccgtaggttgcctctggctaggtgggatcagcagttcgatcgcctacaactggtcgcggcccaatatgaagcctagcgtcaagatcatccacgcaaggttgcatgctcaagctctaaccctggctgcattagttggttctgcatgcgtggagtactatgaccagaagtatggttcttctgggccaaaggtggacaaatacacaagccaatacctggcccattcccataaagattaaaggtcgccatgttggttcctgcatgc

SEQ ID NO: 17572 - DNA, 398 bp, Zea mays
  Clone ID: LIB189-032-Q1-E1-H7
agcaaagggcaaagcagaagttgcggttggcctcgtcctcctcttctccgtcgcggctcagatctctgcgtgcgtcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggagacagtcgggtaccactgcaggctactcctactctgcgggaaacaaaaacaaggctgtagtctgggaagaagacactttgtatgagtacctgcttaaccctaaaaagtacattcctggaaccaagatggtcttccctgggctgaagaagccgcaggagcgtgctgatctcatcgcgtacctg

SEQ ID NO: 17573 - DNA, 290 bp, Zea mays
  Clone ID: LIB189-033-Q1-E1-A1
cggacacgtggggaattgctgaaccagcttgaaagatttagcagcgatgagaggataaaggtgatacctgcaacaaatcgtgctgatattcttgatcctgctctgatgagatctgggcgtctggaccggaagattgagttcgggcaggcatcacaggaatcaagagctagaatcctgcaaattcactcgaggaaaatgaatgtgaatccacatgtcaactttgaagagttggcgcgttcaaccgatgatttcaatggcgctcagctaaaggctgtttgcgtagacgctgg

SEQ ID NO: 17574 - DNA, 449 bp, Zea mays
  Clone ID: LIB189-033-Q1-E1-A10
cccacgcatccgcacacgcgtccgctgaacttgagagaaagctggcacgtcacttctgtggtcacatggaaagcagcttgtcttcccagattcagccattcccattcgtggcatctactgctgtggcttgtagtcgctcacaattttgttcttcgggggacgtagttgtagccacaagaatcgctgctaagggccggtttgatgaccagagatcacgaggggatccataaatagcaatgggattcctctgacatggatcctctcgcgatccttggccaccaaattagtccttagatcatggggattggaagaggttgttatttaaattagttcatttctcctcaatctccccaatcttccgtgattcccttttatcactaaatcaaccctaagagctaatatctacggtaaaagctagagctagtcatctgtcatctccttgggatatg

SEQ ID NO: 17575 - DNA, 162 bp, Zea mays
  Clone ID: LIB189-033-Q1-E1-A11
atatttgtcatcgtctcgttcctgccctcagacctccccaactccagcaggcagatcagatacatccattcgcggaccggaaggaaaggaaaaggtttaaccatgagcggcgttgctgtttcctcctcgctgaaaccggggggcccgctcttcatcccgggg

SEQ ID NO: 17576 - DNA, 340 bp, Zea mays
  Clone ID: LIB189-033-Q1-E1-A2
cacgcgtccaaccaagcgtccggatctcttgaagagctaagcagggagacactagaacttcttgtggtacctcatatattcaggtatccaagctctgtgctaccgattaattgctgaaaagggagggttgggttcatgttaaatattcccaaggagggataattgggcaacggtgtgtgtatatgttcagattcagaaagtgaggacaatatagcgtttgcaacagtggtcgtcgccctgtgcagggagggcctgctgatcagagatcaagagggaaagcacaagacacgttgtgccgggaggaaacacaccatttttgtttttacttagaagcaataag

SEQ ID NO: 17577 - DNA, 109 bp, Zea mays
  Clone ID: LIB189-033-Q1-E1-A5
cccacgaatccaaccacgcgtctgcccacgcgtcagtgtaacccacactcagccgcgtctcgtcgcatcctacgatccaaagctctcactgctcgcaggtctaacccat

SEQ ID NO: 17578 - DNA, 175 bp, Zea mays
  Clone ID: LIB189-033-Q1-E1-A8
tccagcctagctctatatctcgagtattgctagctcacaacaagaaacaatgcagagcaccaacaatggccgccgcctcctcgtcctcggtcctcctgctgctcctgcccggggcgttggctggcatcagcgccaactccgggagggtgaccatcaccaacaactgcgggttcac

SEQ ID NO: 17579 - DNA, 392 bp, Zea mays
  Clone ID: LIB189-017-Q1-E1-E4
tcaacaatggcacccggtttgaaaggttggaccagaaaaggaacccaaagaagaattcaattaaaaagaaatgatgaaaaatcaaaacgccctaatgtggacaattttgcaagtcacgctgtgcgtgtggttgggtactatcataatttgatttattctatatgtttgtcgattcatataacgatattgcaagtatttgtcgaacgtgtttgaattagcaagacatatagctgtgagctttgatagcctcccatatttttttcagttcatattttacattaacgtttttgtgcggtgcttgaaaatatttcgagcgtgttgttgttttttttcagttgtcttagtcatggactcatggtagaatgctaccgcttttaaggctattgtttgtc

SEQ ID NO: 17580 - DNA, 361 bp, Zea mays
  Clone ID: LIB189-017-Q1-E1-E5
catgcagaatgggcagaagatcacattccctggtgaagctgatgaagcgcctgacactgtcactggagatatcatttttgttctccagcagaaggagcatcccaagttcaagagaaagggcgatgacctcttctacgagcacaccctgaccttgactgaatctctgtgtggcttccagtttgttgtgactcacttggataacaggcagctgctgatcaaatcaaatccgggcgaagttgtgaagcctgattctttcaaggcgatcaacgacgaaggcatgcccatgtaccagaggccgttcatgaagggcaagctgtacatccacttctcggtggagttcccagactcgctaagcccggag

SEQ ID NO: 17581 - DNA, 367 bp, Zea mays
  Clone ID: LIB189-017-Q1-E1-E6
cccacgcgtccgcccacgcgtccggagcaagcagcgagacgtcggcgacgacgctgaagtgggcaatggccgagctgatgcggaacctggcggtgatgcggaaggcgcaagatgaggtcaggggagcactcgccggccacgacgaggtggcggaggacagcctggtcaatctgcggtacctgcagctagtcataaaggagacgctgcggctgcacccgccggcgccattgctgctgccgcgggagtgccgcagcccgtgccaggtgctcggctacgacgtgcctcgtggcaccatggtgctggtgaacgcgtgggcaataggcagggactcagcgctgtgggacgcgccggaagatttcgtgccgga

SEQ ID NO: 17582 - DNA, 360 bp, Zea mays
  Clone ID: LIB189-017-Q1-E1-E7
aaataaacccttatttctgcggagtcgagtataccttgagaaggtgttgtatttgcttgaagtagttattaacaatgctgcatcccaagttgattgtccacctcactctgtacagataactaacaattcagatattgaattcgttgatgggacaccatatcaaacacaggtggaaccatctactttggaacaaggtcatatcccggataataaccaaagtagagatgttgaggtcccaccatcttgtgctaaactggatgttaatgtgcatgcaatccttacccaacttcctgatgctgaattgcataatctgtgcaatattcttgcacttgagggtcttccagataaagtgtactcact

SEQ ID NO: 17583 - DNA, 382 bp, Zea mays
  Clone ID: LIB189-017-Q1-E1-E8
cccgtgggctcattgcgtgcctcctgccgtgttcgatcgatcggatccccatacgatctactagctagctaagctacacgactcgaccgaggaggaggagcgcgctcaggccgtatagaaacttggagcatgtcgttaaccacccaagtgtttgggcctcccggctacaggcggtggtggatctattacatcgtcaacgatactgatcaattgagtaaagctctgaaccgacatgatcacctggtggtgttcatgttctcggcggagtggaacgaaccctgcaaggcgatgaagaaaccgttcagggacatggccagggctagaaagatgcaggccgtattctgcttggtggacatcgacaagcttaaagatgctgtggcgc

SEQ ID NO: 17584 - DNA, 372 bp, Zea mays
  Clone ID: LIB189-017-Q1-E1-E9
ggcggagaaagcaacggtgctggtgcctgcgccagagcggcgcgaagagttcgacggcgggcggatcgtggacatcagccactactaccgcgaggacatgccggagtgggagtcatcagagggctccggcgagttcctgcagctggcgcggtccatgcgcaacggctccgacatcgctaacttctcggagctccggctcactgcgcactccggcacccatgtcgacgcgccgggacacgtcttcgagcactactacgacaccggcttcgacgtcgacaccctcgacctcgctgtcctcaacgagttgaaacggtgtgcaggaccagcgctgttggttgacgttcctagagataagaacatcacagctgatgt

SEQ ID NO: 17585 - DNA, 379 bp, Zea mays
  Clone ID: LIB189-017-Q1-E1-F1
cccacgcgtccgaaatgaaataaataaagaataaagccaaaaaaataagtcgaagatagaagagcccagattcaaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatg

SEQ ID NO: 17586 - DNA, 388 bp, Zea mays
  Clone ID: LIB189-017-Q1-E1-F11
acatgattttggcgatggtgtctcctgtcactcattctgtgggcaactgtgttaaacgtgttgtggtcattgtaacatcagtgctgttcttcaggacacctgtttctcctatcaactctctcggtaagcatgtttcttaacctgtttctctgtctttgttctatttcatccttctgttgtatcaccattacatgctttcatctgtgtgtataggtactgcgattgcacttgccggagttttcctgtactcacagctcaagcgacttaagcccaagccgaagacggcttaaatagggattgtattttccatctctttgtgttaatggagttaaacacttctatgtttcaggtgactgcattttaaaagatttgtgcttataacaacaac

SEQ ID NO: 17587 - DNA, 363 bp, Zea mays
  Clone ID: LIB189-017-Q1-E1-F3
accttaaaggctttgcaacctaacttttcaacggtaacaaaaaaattcacttcaaaattcatggaaaacccccaccaaaatattctcacaaaacccttgcacaatcaaggaaggacacaattaaaatttcaataccatgataacagtgatttaaagactactcacgatcttaccgtgtggtcttcaagaactgagcaacagagaaacaatattgctgcccagacaaagctatgtctggagggttggacgccaactagaagtcctgaaggctacaatcagatattctcggcatttaaaccactgaaagatatacataacccacttggtccttttcctagtcaaatatctgggactcactcaaat

SEQ ID NO: 17588 - DNA, 403 bp, Zea mays
  Clone ID: LIB189-017-Q1-E1-F5
agtccctcccggagaaccagaaggctacccaccctccaaggcaggggaggggccatggacgaccccgtcgagcgcttgaaggacgggttccacaagttcaagaccgaggtctatgacaagaagccggagctgttcgagcctctcaaggccggccaggcccccaagtacatggtgttcgcctgctccgactcccgcgtgtgcccgtcggtgacactgggactgcagcccggcgaggcattcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcaaggcgctcctctccctccaag

SEQ ID NO: 17589 - DNA, 360 bp, Zea mays
  Clone ID: LIB189-017-Q1-E1-F7
acccacgcgtccgcggacgcgtggggtcttttcagttatcactagatgtaaacaccctattttacagcccctcacatacactacttggacacccacaaaaacagatcaaattttgcaacttaatattttagtaatttgtttttcttttatttatatggaccaccagatagtggatctgagggactataaaagagattctttgtatgccgtatgcaaagaattttttccgtttgatttaaaaaaaaaaaaaaaaaaaaaaaagaaaaaaaaaaaaaaaaaaaaaaaaaaaaaaaaaaaaaaaaaaaaggcaaaaagtaacagttgcacaaagacgaaagagaagtcccgaatttcaatgcg

SEQ ID NO: 17590 - DNA, 350 bp, Zea mays
  Clone ID: LIB189-017-Q1-E1-D1
cccacgcgtccgcccacgcgtccgcccacgcgtccgcccacgcgtccgcgaggcggggatgacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgcctctccgagctcggcgtccgccagtggcccaagtgggggtgcgagaagagcaagttcccgtggacctactccgccaaggagacgtgctacctgctgcaggggaaggtga

SEQ ID NO: 17591 - DNA, 381 bp, Zea mays
  Clone ID: LIB189-017-Q1-E1-D11
acccacgcgtccgcccacgcgtccggtcatgctgcatttctgtcgaagaacacatttcacatgccgacaggtttttatgatactatcccagaaccagtgttttggcctgtctttgtggtggccacacttgctgctgttgttggtagccaagctgttatttcagcaacattctccattgtgaaacaatgccatgctttgggatgtttcccgcgagtgaaggttgtccacacatcgaggtggatctatgggcagatatatattccagaaataaattggattcttatggttctttgcgtcgctgtcactattgcatttcgtgatactactcttattggcaatgcctacggtattgcatgcatgactgttatgcttgttactaca

SEQ ID NO: 17592 - DNA, 371 bp, Zea mays
  Clone ID: LIB189-017-Q1-E1-D2
gtgagcggaattcgatgtatggtaatccaagtgaccaacagcagggtttcagctttgggcaaaacacatcaagttggttgaaccagccacttccccaggttgaacagtcacgagtggtcaggccgcatgcaacggttgctccatttgatttagagaagactagagaaggcagtgggttcaaaatatttggtttccaagttgatacaaccaatccatcacctgtccaattgagctctccattgtctgctatccgagagcatgtggtacaaactcgaccatcggcaccagtgaatgaattgcaacctgtgcaaattgagtgcttgcctgaggtgtccgtaagcacagctggaactgcagctgagaacattcag

SEQ ID NO: 17593 - DNA, 422 bp, Zea mays
  Clone ID: LIB189-017-Q1-E1-D3
atgcgattgtttggtttacataattgtaatgtgacgggtaatcgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaataaaaaaaaaagaaaaaaaaattaaaaaggggggccccccaaaaaaacaaaacctttacccaacttaaacggcattcaaaaaacccccaaattggctacccaaaaataaaaccaaaggggccccttaaaaaaccccttccaagaaaaaacccaggcttaaaacaaatatgccaccgtcaaaaaaaaccccctttccacaaggggggtataaacgaaaaagc

SEQ ID NO: 17594 - DNA, 362 bp, Zea mays
  Clone ID: LIB189-017-Q1-E1-D5
ggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgc

SEQ ID NO: 17595 - DNA, 380 bp, Zea mays
  Clone ID: LIB189-017-Q1-E1-D6
cccacgcgtccggattcatcgcgattttaaggcaagcaacattcttctggagcatgattacacaccaaaagtgtcagactttggacttgccaggactgcaaggggagaggggaaccagcacatctctacgcgtgtcatgggaacattcggctatgttgcgccagagtacgccatgacgggtcatcttcttgtaaagagtgatgtgtacagttacggagttgtattgcttgagctcctcactggtaggaaacctgtggatatgtcacggcccgctgggcaagaaaacctagttgcatgggctcgaccgcttctaacaaatgttctgagtctacgccaagctgtcgatccacttcttggacctaacgttccactggacaatg

SEQ ID NO: 17596 - DNA, 366 bp, Zea mays
  Clone ID: LIB189-017-Q1-E1-D7
ctctaccgtggtttcatgccctccgttgctggtatcgttgtctaccgtggtctgtacttcggtatgtacgactcgatcaagcctgtcctcctcaccggttccctcgagggtaacttcttggcctctttcgctcttggttgggccgtcaccactggtgccggtatcgcctcttacccccttgacaccatccgtcgccgcatgatgatgacctccggtgaggccgtcaagtacaagggtaccatggacgccgcccgccagatcgtcgccgctgagggtgtcaagtctctcttcaagggtgctggtgccaacattctccgtggtgttgccggtgccggtgtcctgtccatctacgaccaggcccagctc

SEQ ID NO: 17597 - DNA, 366 bp, Zea mays
  Clone ID: LIB189-017-Q1-E1-D8
ccctcctcctgtccctggctctccagctcgccgtcgcgctcgtctcagtgtcggcgcagcacaagttcgggatcaactacgggcagatcgcgaacgacctcccggagccggcgcaggtggcgacgctcctgcagtcgatgggcgtgaacaaggtgaagctgtacgacgcggacccccgggtgctgacggcgttcgccagcacgggcgtcggcttcaccatcgccgtgggcaacgaggacctgcaggcgatggcggccagcccggacgcggcgcgccgttgggtggcggcgaacgtgcagccctacgtcccggccacgcgcatcacctgcgtcaccgtcggcaacgaggttctctcgggcaacgaca

SEQ ID NO: 17598 - DNA, 368 bp, Zea mays
  Clone ID: LIB189-017-Q1-E1-D9
acccaaacgtcaaggcacctcacccgatccctatgggggtggcagcatccacctagtgtgtgatcattgcggtaccagtgacaactacaccactgacgacgctgatgatggccaattcacgtgccgtacatgctctgccgtgcacactacacaggcaactgctgctgatcctcatgacttccccgccactggcaacatctctgtccgtcgtgttgccacccagccaacccccaagcttggtgcccgcacacccgcgccttacctgaggacccctcaggctgctcccgtgcctgctactgccgcttttgatgacttcacagagctgagtgagccgccggactttgtgtctggatctggcacgtgtgggg

SEQ ID NO: 17599 - DNA, 430 bp, Zea mays
  Clone ID: LIB189-017-Q1-E1-E1
aagttcctggacctaggatggttcctattcctccaatagtaagaggaacctttcattgtgaaaggtcatgcagcagtctcgaataccatgaagcaaattctggcatacgacatcatgtctcacacatttgtatcaatacatttcgaatcaataaagtttccctcactctttactgtgcacttttctcaaagatcacaatcttgttgtaatgtgcctcatgtaaagcaaactgcgaacaaggcatatgatagttttgatacaacaaaaaaaaaaaaaaaaaaaaaaaaaaaaaaaaaaaaaaaaaaaaaaaaaaaaaaaaaaaaaaaacaaaacaaacaacaaaaacccaaaacaacaacccccccaaacaacaaaaccccccacacacaacaacccccacccaaccccccaacaaaaaaaaggggggccc

SEQ ID NO: 17600 - DNA, 372 bp, Zea mays
  Clone ID: LIB189-017-Q1-E1-E11
cccacgcgtccgcccacgcgtccgccgagttcctcactgccatgatgaacaggcataaactggagaaggaggaggatttgttccttgcttttcaacacttcgacaaagacgatagcgggtacataacaagagacgaactggaacaagccatggcggagtatggggtgggtgatgaagcaagcattaaggaagtgctggacgaagttgataaagacaaggatgggagaatcgactacgaagagtttgtagaaatgatgaggaagggaagttatacctgaggaagctctgttctcatggtgggagaggttgtgtatatatgtttcagcaaatgtgtcaagtacaagcaacgaagcaagtttaacttagaacaag

SEQ ID NO: 17601 - DNA, 373 bp, Zea mays
  Clone ID: LIB189-017-Q1-E1-E12
acggacgcgtgggtggcgaagcacaaccgtgccgcaaagcttttcaacttacagctgcacgcactttgcacgaagctgagggcagaattcgatggagccagcatcacttacgtggacatccacacgatcaaatacagcctgatcgccaactactctcgatacgggttcgagcacgccactcaggcgtgctgtggatacggaggcccacccctgaactacgatggtaacgtaccatgtggacacacggtgtctctggatggtaagatggtcaccgcaaaagggtgcagcgacactactgaattcgtcaactgggatgggatacattacacggaagctgcgaatttccatatcgcctcgcagatcctgaccggga

SEQ ID NO: 17602 - DNA, 370 bp, Zea mays
  Clone ID: LIB189-017-Q1-E1-C9
ccgaggtgaagtctgttgagatgcaccacgaggcacttcaggaggctcttccgggtgacaatgttggcttcaacgtgaagaatgttgctgtcaaggacctcaagcgtgggtttgtggcctccaactccaaggatgaccctgccaaggaggctgccagcttcacctcccaggtcatcatcatgaaccaccctgggcagattggcaacggctatgcccctgtgctggactgccacacctcccacatcgctgtcaagtttgctgagctcattaccaagatcgacaggcgctctggcaaggagcttgagaaggagccaaagttcctgaagaacggtgatgctggtatggtgaagatgatacccaccaagcccat

SEQ ID NO: 17603 - DNA, 429 bp, Zea mays
  unsure at all n locations
  Clone ID: LIB189-017-Q1-E1-B4
ggtcctagatacccggggccgaccaacgcttcgacggacccttgggcaccggtttcccggctcgcccaattccccgctgccggcaccaatctgaaatcaaccgaacctaacctttttcaccaaaatggtgcttgtacggcatgcaaacattggtaacaaaaatgcattcaaaacactaattgccgcaaaatacaccggtgtcaaggttgagttggtgaaggactttcanatgggtgtctccaacanaactccagagttcctcaagatgaaccctattgggaagattcctgtcctggagactcctgatggtcctgtttttgagagcaatgcaattgcaagatatgttactcgcttgaaggctgataacccactttatggatcttcactgattgattatgcccatattgagcaatggattgactttgctgc

SEQ ID NO: 17604 - DNA, 374 bp, Zea mays
  unsure at all n locations
  Clone ID: LIB189-017-Q1-E1-B6
cggacgcgtgggataaaatatttcatgtaggttttgatatcgaagtccagtagtctgatttaattaggagaaccattgatgtacttgtactccagatcggagtttatagcccgcacaaggtagcttgctgtaactggcactgcctcactctttagagccttcggttccatgtcagtatgtcaccaactcacgatgacaaactggaatttggaatgacatctgcttgtgtggaaatttcaaagccgaataaactatctcttcaggcttcatttgtcanagattccaaagtatattaacatagccacccttcgttttccattggaatcttaacctgtaaaattacgcccgtgcaactgatgatggcatcaacacag

SEQ ID NO: 17605 - DNA, 368 bp, Zea mays
  Clone ID: LIB189-017-Q1-E1-B7
cggacgcgtgggcggtcgaggcgggtaggacaggatccagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgccgtcggcctcgccggcccaggcgccgcggatgtgctgccgtacgtggaggcggatctcaagcgctccgccctgcgcgtcgtcgaaaaagccaaaggcctctgcacacaggcgagcgacgctg

SEQ ID NO: 17606 - DNA, 381 bp, Zea mays
  unsure at all n locations
  Clone ID: LIB189-017-Q1-E1-B8
cccacgcgtccgcggacgcgtggggatttatcttgcaaatggtatgtggatccgttccagaggcaatgagccttgcagccagtttgcagtataaaaaacccaattatgtccactgttggttcgacgcagcgtgtgccgaggatttctactgccaagcataagtgaattgcagataaatggtctgttcgcaactggtgctctcgggcgactccatcactgagcaacccttcgccccggtggctgcggtgtcgcactggctgacacctgctcgcagttgcattacaagttttactgactatgtantttcaggtttattcaatttcagttgtaatgcttctgacagcagttgtatcagtcctcttgttcagcttccataataat

SEQ ID NO: 17607 - DNA, 385 bp, Zea mays
  Clone ID: LIB189-017-Q1-E1-B9
attccgggccgagtacgctatagaaggatacttggatactgaagccatgcatctttaaattgttaacttttctttttgtggtttagtatggatgaataaaaggggaaaaagcaaaagggaacaagcatcctctgatttttattttgatgatgcaatcttagaaaccctacctgaactgaacacctcttttggcattttaaaagtgctgcaaaggaaacaagcatcctcttgcttttgtatctttagtatgttgtcggcatatgtacgctattatgtccttttttggttaaatatctattattcatgggtttgctgttcacatgaatcgcatatagctatcacctttgctgcattcaggttgatgctatgctccaagaattagaaa

SEQ ID NO: 17608 - DNA, 364 bp, Zea mays
  Clone ID: LIB189-017-Q1-E1-C1
gaaggagcataagcacaaggagcgcctcggcgaggtgggcgccctcgcgggcggcgcctttgctctgtacgaggggcaccgtgcgaagaaggacccggcgaacgcgcagaggcacaagatcgaggccggcgtggcaacggcggcggcgctgggcgccggcggctacgcgtaccacgagcaccgcgagcagaaggaggcccactacgagagcaggcagcaggagcacagggtgccgcacgggcacgggcacgggcacggctactcctactactgcgactgaaacgactgatcatcccatcgatcgagatatgcatgcagaactcgatatatatacggcccctagcgccgtacacgtgcgtgcgtg

SEQ ID NO: 17609 - DNA, 378 bp, Zea mays
  unsure at all n locations
  Clone ID: LIB189-017-Q1-E1-C10
cggatatggacaaggcttgatcaccaagaagggttttaagggctcattcagcaatgcagggtcctctgccaagacttttgcaattctctctggcgttcagagtttggttttgtgcttgttgcgaaggctacgtggcaaggatgacattgtcaatgctggtatagctggttgttgtactggcctcgctttgggctttccaggggcgccacaggcattgctccaaagctgtgccaccttcgcagcattctcatgcatcatggaggggctcaataagcagcaggctgcaatggctcgcacgcttggagggactgncgccatggccgtgcatgagaaatgtggtgttctgcccccgttcacgcttccacctattcttgatgc

SEQ ID NO: 17610 - DNA, 376 bp, Zea mays
  Clone ID: LIB189-017-Q1-E1-C11
gagattgacaaatcagcgagcaaattcttctcttactgggatcctgacaagaaggaatacctgctgcaattgtacttcaagccaaggccgccagaaggtagtaaaccaccaccagctcctcctggaactttgcctaatgggactggggctcctggtgctccaccaaggccaccggggcaagctcccccaccacccccgccacaaattccaccgccccctcctgcacctatgggaatgccccctaggattcctccaccacctattggggctgttcaacctccgccacctccagcacgagtggcaaatggtctgcggccaatgattccaccgccacctaacttcactcccggagcaaccccaccgcgccctccaatgc

SEQ ID NO: 17611 - DNA, 350 bp, Zea mays
  Clone ID: LIB189-017-Q1-E1-C3
aagggcgcgggagctggtggctctgggtacgggtccgggcaaggatctggctacggagctggcagcggtgctgccggtggatatgggagtggcggaggtggtggaggtggaggtggcggtggccagggtggtggttccggatatggccatggaggtggtgaaggatacggctctgggtctggctttggtggtggtgctgctggcggcggcggtggacatggtggcggtggtggcggcggccaaggtgggtctggctatggctctggctctggctctggctcgggatatggatcaggtgaaggatacggacaaggtggtgctcatggaggaggctatggaagcggtggtgg

SEQ ID NO: 17612 - DNA, 429 bp, Zea mays
  Clone ID: LIB189-017-Q1-E1-C4
gggcatcatccccaccacgagacgaccaaagcaacggcgatggggaagcatcggaaagggccaaaaaagcaccacctgcggcaagccggtggcaaaagttctcaaggcaaggttccggacaggcctccaacgcacaagcttcccgaggcagtgggcaacaaggattagtagtagtagtaaatttgatcatattggctaaatgtacagtgccattgtctgtagaggcttgcagtgccttcccagctttgcacgcactcatgtgctccatttgtaaaatctaggtgagtaggtatatagtgatgttgataacctgaacctgtacgtagaagacaacaagcacccagtgctgcagaacaaaggtcaaacatgtacaatacaatagaacgaatacaagtgtatacatacatccgctgtacaatcgcggtacgt

SEQ ID NO: 17613 - DNA, 384 bp, Zea mays
  Clone ID: LIB189-017-Q1-E1-C7
cctagtgctgcctttcccacagttgatgttccacgaccttcagagaaagacagagattgcccagctgaaaatgcacagattgaatgccaagaagctcgaaaacaggtacagttcgaaggtttaagaattgctgcttcttcagagtctgatgggagtggaaaaggcgaggtgtcactccatacggagttaaagctatctcctgcccagaatgctgatgccacacctaccataggagctggcacaaatgatgcattcaggaataagaaaaagcaggatcgctcttcatgcggttctaacacaccttcaagtagtgatgtagatgcgggcaatgttcctgaggaggacaatgctaatgagaaggccaagcaagcctcctgcaacaac

SEQ ID NO: 17614 - DNA, 375 bp, Zea mays
  Clone ID: LIB189-017-Q1-E1-C8
cggacgcgtgggccaccttggtccatcagcagcgagcgaacaggcaaaaaggaaaggccgagaagcgctttatccggccgtacgtagcgataagagtggtgcacccgtagcggcacggcatggcggccacggcgtactccgtggcgctcctcggcggcgcacgcctgccggccgccttcctccctcgacgcagcagcgtgtgccaccaccagcttcgcctccaagacgcaccgaggctgatctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccg

SEQ ID NO: 17615 - DNA, 351 bp, Zea mays
  Clone ID: LIB189-017-Q1-E1-B12
gcgtccactgtaacctgggcggtagcgtgggcgcatgcgtatgcggacccatggccgaagaccaggctgagatgtacgaccacgatattattgagttctggactgcttggcaggagtacgtgattgtggcggccgtcttgctttcaattctcgcgttcctttcaaggattgctgcatcactgcatgtgtacttcttctaagtctcactctgccggttacgggtgctcctctacgtcgcggtctatgaacccatgtgcctcacgtatgacatggggaggatgcttttccctatcaggctaacctttgttggcgttgtgatgctagaccgcattggttcattcttttgacttt

SEQ ID NO: 17616 - DNA, 415 bp, Zea mays
  Clone ID: LIB189-032-Q1-E1-F7
acagcctaaaaaaaccgtatcgtctcgcctgttcagtttccttctcctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgcttcggcggcctgccgctcgacgtcctcgccttcgtcgaccgc

SEQ ID NO: 17617 - DNA, 358 bp, Zea mays
  unsure at all n locations
  Clone ID: LIB189-032-Q1-E1-F8
gcgtatgaacagggaggtatcaatgtggatgaaatgttcaggcgaagacagtggtgacgagacagacatccccttcatagctactagaggttatgacagcgtcgtgtggagtcgaatgtactcgcaagaccctgccgaaagaacacgacacgctttgatgctatcttctattgctgctgaacaaacgctagaagctgtaggagccaaagggatggttgtagggcacacaccacagacgcatggggtgacctgtaaatgtgatggcaaagtctggtgcgtggatgtgggcatgtcctgtggtgttctttgctcaaaggcanaggtcctanaaatagtcaatgacagaccaaaggttttg

SEQ ID NO: 17618 - DNA, 256 bp, Zea mays
  Clone ID: LIB189-032-Q1-E1-F9
agccaacgaggacgccatgaagactggctccttcttcaagtagaaagcaactctttgctattgctagctaggcgcgaggccggcataggatcgaggagggcgccaccaaaatgcattggagctaacgaacagcgaggggcgatcatggcagcagctgccactacatcttctaaacttgccatttttattatccctgatccatgtattactcttaatttgtacgtactacaatacgggatctggccaagcgcgatat

SEQ ID NO: 17619 - DNA, 391 bp, Zea mays
  Clone ID: LIB189-032-Q1-E1-G1
gtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgc

SEQ ID NO: 17620 - DNA, 373 bp, Zea mays
  Clone ID: LIB189-032-Q1-E1-G10
accacgcgtccgacccaatgcggcgccggcccctcctccctcttgcgcaaccatgccattgccatcggccgcccagagcgctctcgtcgcggcggccgtcgccatagccaccgccaccgtcctcctccccttcccaccagcggtggagaagatcctgcaggtagtgcagctgtgaggcggtggatctccagacagtgcagcagttgggtggcaggtggagcagccccagcaagttgtgttagccagcacgcatgtgattttttattgctttattttttgtctgcaagaacctgagttgacaatggttgcctggttgggtaccaagtgcaattttctgggtcatgatagttcagaaaaaaacgaagaactgaat

SEQ ID NO: 17621 - DNA, 373 bp, Zea mays
  Clone ID: LIB189-032-Q1-E1-G11
aatggccgaggggtacctcctcacctgcatctcctaccccaaggcagactgcgtcatccacacccacaaggaggaggacctgtactagagatcgggttgctttatgcatcagtggttgctccaagggtggtggtgcgttcgttgctgttccgtgccaccagcggaagggggatttcgttgttgagatgggctagttcttgtcatcaatttcggtcattcgatgagatcatggcatatgagttgtggcaataatgctggcaatatggttttgcaattcaaactgcaaatgtgaccagcaatgtcaaaaactgcacactgtgtctctgtgcgaacttgtgaaattggcattgagttcaattggctagttggctcg

SEQ ID NO: 17622 - DNA, 394 bp, Zea mays
  Clone ID: LIB189-032-Q1-E1-G12
acgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggcggtgttttcttagtgaacattcatttcccgccagattaccccttcaaacctccaaaggtttctttcaagacaaaggtcttccatcctaatatcaacagcaatggaagtatatgccttgacattctcaaagag

SEQ ID NO: 17623 - DNA, 448 bp, Zea mays
  Clone ID: LIB189-032-Q1-E1-G3
gggtcctagcacgcgtctgaactgacgtcctgttaggatccaaagcttggaacatgtcgtcaaatgcttgctaaagtttccaatctaattgtttacttggatgatctttatgatgtatatggaaccatagaagaacttgtactcttcacaaatgcaattgcaaggtgggatgcgataccaaatgagacacttccagagtacatgaaagcactttattctattatatatgacacatcaaatgaagttgctgaacacgctttgaagaaacatggttgtagtatgcattatcttctacaaaaatcgtggtatgacatatgcctggcatttttggtggaggcgaaatggcaccatggaaactatagaccaagcattcaaaagtatctagagaatggatgggtatcatcttcagcaacattgttgtttgttacatgcctttcgcaatgcttga

SEQ ID NO: 17624 - DNA, 409 bp, Zea mays
  Clone ID: LIB189-032-Q1-E1-G6
agagaagtaccgcggatcgtcgctggatggcgtatggaaactccccacaggcttcattcttgcgtctgaggaaatctacacgggggccagcagagaggtgaaggaggaaaccggggtcgacaccgagttcgttgacgtcgttgctttcaggcatgcccacaacgtggcgtttcacaagtccgacctcttcttcatctgcatgctgaggcctgtgtcgagtgagatcaagattgacgagacagagattcaggcagcgaagtggatggcgctggaggagttcgtgaagcagcccttcatccaggaagaccacatgttccagaagatcatggacatctgcatccagcgcctccgcaagtgctactgtgggctgacgccgcaccacgtcgtctccaagttcgacgacagaacg

SEQ ID NO: 17625 - DNA, 441 bp, Zea mays
  unsure at all n locations
  Clone ID: LIB189-032-Q1-E1-G7
aagttttgaaaactcctgtctcacttgatatgcttgggcgcatttttaatggttctggaaaacctattgacaatggccccccgatattgcccgaagcctacttggatatctctggaagttctattaaccccagtgagagaacctatccagaggagatgatccaaactgggatatccaccattgatgtcatgaattccattgctcgtggacaaaagattccactgttttctgctgctgggctccctcacaatgaaattgctgctcagatttgtcgtcaggctggtcttgtgaagacattggagaaaggaaagcatgctgagggtggtgaagatgacaactttgctattgtgtttgctgctatgggaatgaacatggaaacagctcaaatcctcanacgtgattttgaagagaatggttccatggagcgggtcaccctttttc

SEQ ID NO: 17626 - DNA, 390 bp, Zea mays
  Clone ID: LIB189-032-Q1-E1-G8
gtcgaggacggcaacgtccttcagatcagcggcgaacgcaacaaggagcaggaggagaagacggacacctggcaccgcgtggagcggagcagcgggaggttcctgcgcaggttccgactgcccgagaacgctaagacggagcagatcacggccgccatggagaacggcgtgcttacagtcactgtgccgaaggaggacgccaagaagcctgaagtgaagtccattcagatctccggctagacctcggtctgcggtcgtcgtacctgcgtggtttgaggaacggcagttcgcctcggtcgttctgtgaaataaaattgggttacaagaattatggcgtttgtcaatatggtcctaatgtcctaggatggtggaatgtggtcacaaactttg

SEQ ID NO: 17627 - DNA, 378 bp, Zea mays
  Clone ID: LIB189-032-Q1-E1-H1
ttttgacaactcgtgtcgtcacttgatatgcttgggcgcatttttaatggttctggaaaacctattgacaatggccccccgatattgcccgaagcctacttggatatctcgggaagttctattaaccccagtgagagaccctatccataggagatgatccaaactgggatatccacgattgatgtcatgaattccattgctcgtggacaaaagattccactgttttctgcagctgggttccctcacattgaaattgctgctcagatttgtcgtcagagcggtcttgtgataacattggttaacggaaactatcttgcgggtggtgaatatgacaactttcctattgtgtttgctcccaagggagtgatcatggaaaca

SEQ ID NO: 17628 - DNA, 373 bp, Zea mays
  Clone ID: LIB189-032-Q1-E1-E11
accacgcgtccgcccacgcgtccgaattgttgtctttatatagcgcttctgatggacctgagctagggagctccaggagttcggctctagcaacgagtgcacctttcatgtaaggattaagggcggatagtgtggccaggtctgtccgcatataatttcagttggacagacctcaggatggtgccctggcgtagcaccgatgagtgacgaaggaggcgcctgcaccttttcgcttctcgctagcttcatgactgctgattgtgtaagggtgcggccatgaaaggtgagattggtctgcggtcatgaaaggtgagattggtctgcggcctgatgtgtatataaaatttttgccacgaatgaggcgcctgcacct

SEQ ID NO: 17629 - DNA, 405 bp, Zea mays
  Clone ID: LIB189-032-Q1-E1-E12
accacgcgtccgcccacgcgtccggtgctgaccaaagccgggctgatcaacgcgccgcagtggtacgacgccggcaagtcggagtacttcgcgtcgtcgtccacgctgttcgtggtcgagttcatcctgttccactacgtggagatccggcggtggcaggacatcaagaaccccggcagcgtcaaccaggaccccatcttcaagagctacagcctgccgccgcacgagtgcggctacccgggcagcgtcttcaagccgctcaacttcgcgcccacgctcgaggccaaggagaaggagctcgccaacgggaggctggcgatgctggcgttcctgggcttcctgattcagcacaacgtcaccggcaaggggcccttcgacaacctgctgcagcacctgtctgaccca

SEQ ID NO: 17630 - DNA, 370 bp, Zea mays
  Clone ID: LIB189-032-Q1-E1-E4
gggtccacgcacgcgtccgcacacacgtccgcggacgcgtgggcgaaaaggccatcgcggacgggagcctccttgacctccggggcaaggtgttcacgttcgggctctccctgttgaagctggacatcgggcaggagtctgaccggaacaccgacgtgatcgacgccatcacaacgcacctcggcatcgggtcgtaccgcgagtggcccgaggacaagaggcaagagtggctgctgtcggagctgcgaggcaagcgcccgctgctgcccccggaccttccccagaccgacgagatcgccgacgtcatcggcgcgttccacgtcctcgcggagctcccgcccgacaagcttccgccctacatcatctccat

SEQ ID NO: 17631 - DNA, 371 bp, Zea mays
  Clone ID: LIB189-032-Q1-E1-E5
ggatgaacaaactgttgagcagcagccagaggatctcaagacgcaggagcaacagctcaatgagctcgtggacatccaaatcgaggagattgctggggtcgccaagaacgtcacttcacgttgcaaggataagatgacagagctggtggttcaatgaatctgggtgaggttcctacttcaaacgatgttaaaatgctgtcgtagcttatctggtgaggtctcttttatgggttggcttcttggtagaaagggaatgtttggttattgcactgtcatcgtagtgttagaaccaacacaagcataggcactgagtagattgtcacggcagattattatgtacttcaattctggaatatttgatgggaatgcta

SEQ ID NO: 17632 - DNA, 360 bp, Zea mays
  Clone ID: LIB189-032-Q1-E1-E8
ggaccaacgacctccgggaaccacaaccacgtacccgcttcaggtccaggtccaggagcagcgctcaccagggagatctccttcggggatcagacggtgtccgcccccgcggccgagaccgagaggcctgccgccgtgaggatcgacagcgagacgcttgcgcagaacagggacagcgccatgcagcggtacagggagaagaagaagaaccgcaggtacgagaagcacatccggtacgagtcgaggaagctgcgggcggacacgaggaagcgggtgaaagggcggttcgtcaagtccaccgaagcactcaacgccgccaggtacggcggatgaagcagccatatatatatgcatggcctg

SEQ ID NO: 17633 - DNA, 289 bp, Zea mays
  Clone ID: LIB189-032-Q1-E1-E9
tcgtggtgagtcagaacgtgtgtctcgccacccgacggtgcgagtactcaggatgcctgccgccgtcaggatctacatcgagatgcttgcgcacagcagggacagcgccatgcagctgtacatggacaagaagaagaaccgcaggtacgagaagcacatccggtacgagtcgaggaagctgctggcggacatgaagaatcgggtgaaagggcggttcgtcaagtccaccgaagcactcatcgccgccatgtacggcggatgacgcagccatatatatatgcatgggctg

SEQ ID NO: 17634 - DNA, 365 bp, Zea mays
  Clone ID: LIB189-032-Q1-E1-F11
agaggtgatcggccaaagctgccagaacctcagggtcctcaagcgcaacgtcttcaactggatcgacccatcggagcatgccggagtagttcctgaggactatctgagagaatgccccgaagacggcaacagggaagccattacgatatccaggttcatgccgaagctgagacacctcgagctgaggttctcgaagctgaccgccgtcgccctcggctccatccctgaaggatgcaaggacctggaggtcctggacctgttcggctgcgcgaaccttacgagccggggaatagaccaggccgctgctagtctgaagagtctggtgacgctggtgaagcccaacttctacatacctcgctcctcct

SEQ ID NO: 17635 - DNA, 442 bp, Zea mays
  Clone ID: LIB189-032-Q1-E1-F2
gggtccagcacgcgtccgagagatcccttgaaaccagctgtgacgggcgtcttagtgttcgtttccactccagatccaattggcaacaagtactatcttggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccatgaaatcacatgcccctcttgtgcacctgtccgcgctttcagaaggcaccgttgtggactcgagatagcgacctctactcggaatttactttcagctcttgcatgtttgtggttgtggccatcatgtactgattttcc

SEQ ID NO: 17636 - DNA, 289 bp, Zea mays
  Clone ID: LIB189-032-Q1-E1-F4
ttgaacctctttgtcaacgacgtattaattttcgtttccactccacatccaattggcaacacgtactaacttggaactgcacctctgcatgatatcacaacggagattgctaaaaccaatggtcctacttgctataatacggattaaatgttctcaatagataatgcattatgcagcattagtcaacaaaatgattcgattatagacctttcaacagtggtgtcgacagtgatcaacacagcactcgagacgatgatttctggtgccaattcatcgacgaaatcagatt

SEQ ID NO: 17637 - DNA, 431 bp, Zea mays
  Clone ID: LIB189-032-Q1-E1-C5
accacttgcacatgctgttggagcgggtaatctgtcactagaattagaggatctttcatttcgttacttgtttcctcattcctatgaccatgttgatcagtggttgagaagccaagaaggtgactgcaaggctataataaatttgtacaaggagcagttgcttcaagcactgcaggctgataatgagttgaggaggattgcacaggacatctcaattcaagggaggtataaaagccgtttcagtactatgaagaagctagtaaaagatggacggaagccagaagaagttaaagacattctaggtttgagggtaatcttggagcctcggtgtggtggcaattcatctgattggggccctagggcttgccacaggacacatgaaattattcaagctatgtggaaggaaatcccgggtagaacaaaagattata

SEQ ID NO: 17638 - DNA, 438 bp, Zea mays
  Clone ID: LIB189-032-Q1-E1-C7
aggacgcgtgggatggttcagaagtgcaaggatgctggtgcaaccctggttatttgccagtggggttttgatgatgaagccaatcatttattgatgcatagaaatctgccagcagtgagatgggttggtggtgttgaattggaactgattgccattgctacaggagggcggattgttccgagattccaagagttgagtcctgaaaagcttggaaaggctggattagtcagagagaaatcattcggaacaacaaaggaccggatgctttacattgagaagtgtgccaattctagagctgtaaccattttcatccgtgggggaaacaaaatgatgattgaggagaccaagcgcagtcttcatgatgctctttgcgtagcaaggaatctgatccggaataactcgattgtgtacggtggcggctcaaccgagatatcttgc

SEQ ID NO: 17639 - DNA, 232 bp, Zea mays
  Clone ID: LIB189-032-Q1-E1-C8
ggaacagagtcatgtcgccgcagcctgatccggttacacatgcacatgcatcacactgtaaatgaaggaacatacatcagctgagttgtgaaaatggtacgcatgcagtgtgaggatctccgtctctcactgtccagtgagaagaacggaacatataggtatagctgctgagtggagtgcgtcctcctgatacttggcttttgcgaataaaaggagtgcctgctgttgtcat

SEQ ID NO: 17640 - DNA, 376 bp, Zea mays
  Clone ID: LIB189-032-Q1-E1-D11
agctattctcattatacttcagcttttctttgctggcatcattgtcatctgtttggatgaacttctccagaaaggttatggtttgggatctggtatttctctgttcattgctaccaatatctgtgagaatatcatctggaaggcatttagccccacaaccatcaacagtggtcgtggtgctgaattcgaaggggctgtcattgcactgttccatctgttgattacgagaaccgataaagtccgtgctcttcgtgaggctttctaccgccagaaccttccaaatgtgaccaatttgcttgccactgtcttggtattcctcatagttatctatttccaaggcttccgtgttgtgcttccagtgagatcaaagaatgct

SEQ ID NO: 17641 - DNA, 413 bp, Zea mays
  Clone ID: LIB189-032-Q1-E1-D12
aacacgcgtccggtctctgccctcacagcgcccttctccccctccaacttctcccctgcgcgtgggctggaagccagccgagcttccccattcggtcgccgtttctcccagcaagctctctgcacctcccatggccgctgagctcccaaccagggtgtcccaagcccctgtgctcggcgtccttcttccacctccggctgacctccctgtgcatagtgcccccttcaccttcggccgcgccccctgcacagcgacctgctcgccctttcctcctcttccctagtgcggcagcaaggagcccctgctcggactgcagccacggcgtccaagtctctgtgcagcgatgccggtccaaaaactgcagccccggcacatcgcccggcttcctcgctgctaccgctgcgcgcatgcca

SEQ ID NO: 17642 - DNA, 371 bp, Zea mays
  Clone ID: LIB189-032-Q1-E1-D2
aaaatggtgtccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaagcataggattttttttctccaattgttaactgtacgcgaatggaagcgacagatcattcgtaggttgtgagggcttcaaagatcatctgctgctgtacatgttttgttgctgtcttgtgaacatacatgtcttgttgtttctcaactggaggaatggtgttaacctgctgtatcattt

SEQ ID NO: 17643 - DNA, 431 bp, Zea mays
  Clone ID: LIB189-032-Q1-E1-D4
cgggtcgagcacgcgtccgaccatagccccgatggacaccgccgcctcatgccgcctcctctcgccggcctcgtcctctccgcccccctgtccgaagcagctacccaagcggcgaccgaccttcgcggcctcgccgcagcagtcgtcgcccagctccagcgctaagttcaggctcctctgcctcctccatgacaagtccgcggcgccaacgtcgtcggtgcagatgcagagctcgcacttgcagaggctggcgacggtgttgcagtgcggagccgtctgggcagctgttgaggcgccggcggcgctggcggtgaccggcgaggaggacatcgaactgctaaggattctggccgccgctcgcggtgttcgccttcttctacttcctcgtcgctcctccggtgatcatgaactggatgaggctgaagtggtac

SEQ ID NO: 17644 - DNA, 422 bp, Zea mays
  Clone ID: LIB189-032-Q1-E1-D6
cggacgcgtgggtccgtgtttaacgggcgtagagagagaaagagaacagagcgagagagggggaggacgaagccctccgcgtcgtctcctgctgttccatcccacatctattctgcctcggcttgcaccttcgacctcgctgaaagttctgacctcaaactgaaaggggcctgtgaagcgtttccttgcggcagtgcaatggaggtatttggcaaatctgtgattgctgagcccagcaatgtgattttcttgtccgcaatccttaacacagaaggatcaaaccctagtcacaagtgtgacaagaggtgccagaacgagaacatttttgggaacatgtaccgttgcaaactgactggaaccactcacatctgtgacaaaaactgtaaccagagaatcctctatgacaaccataactcgctctg

SEQ ID NO: 17645 - DNA, 439 bp, Zea mays
  unsure at all n locations
  Clone ID: LIB189-032-Q1-E1-D7
aggacgcgtgggcggacgcgtgggcggacgcgtggggctggccaaggctgcagagaaactggccgactgccagaagacgatagcttcactgagcagccagctgaaatcgttggctgatttcgacgaattcccccctgaaactgagaccagtggcgctgactcagacgacgcctgggacagcgatctgaagcttctccaacccgcaagctatcccacgcagattggctgtttggcagtcacatgattcacgatcctcgttggcaagtggatagcgaaactgtttttgcttggcttccgccgcatgattgctgtgatgagattgccatgatgttccaccacatgtcatatagagttaagttaataggtgagcaaatgttcatatggaagctgtttatanagttgtttggtgaagcctcaaagggactcatattgaatatta

SEQ ID NO: 17646 - DNA, 423 bp, Zea mays
  Clone ID: LIB189-032-Q1-E1-D9
accacgcgtccggtaccgggttcatgccggaccaaactcgtgccgggttttgggccgcccgataagcccggctcgtctagacatctctagttcacgtgacttgaatggttttaactaaagtgatttttatacaagcggcctaaaaagctggaaacagtagtctgcataccttccggtggccaaaagctgagtgcccatacggcacgcacatgacaaaaatattaatatattatgttttatataaatctatagaatacaaatttattgttacgttggcctttcaatataattagttaggatagttatttaaattttttatataaccattacaaaactaatcaatcaaaaagattcaaaaccttattatatatttgaattatatcttaattgttaaataaaatttttaaaactataatatataat

SEQ ID NO: 17647 - DNA, 87 bp, Zea mays
  Clone ID: LIB189-016-Q1-E1-H3
aggacacgtgggcgcgtcatccccgaggacgagctgctcaacgtccagctcgccactgccgactactgattgacacgtctcctgatg

SEQ ID NO: 17648 - DNA, 359 bp, Zea mays
  Clone ID: LIB189-016-Q1-E1-H4
gcgtccgcccacgagtccgcggacgcgtgggcaagttcgaattaacagtggaatccgatcccaaaagatttgaagatatattcggacttcggaaattagagctgcgcaaataagcatggaagacttttgtgcagtttgctcaaagaggctggaatgggtggcctataggtcatgccggcatcgccaactgtgctccacaagcatcgtccgcctccgtttcgtgatgggcgacaacaagtgttgcaactgcaagaacgtctgcccatcctccttgtcaccagagccacgggtaaatccactagagtgatcacggatttctccgtgtgacccgctggggtaaatgagggcaaagctgggga

SEQ ID NO: 17649 - DNA, 408 bp, Zea mays
  Clone ID: LIB189-016-Q1-E1-H5
ggatggcaggcgaagaaggcgaacgcaatgaggttcacataaactgtgaaaccaaagaagtttccattcatataaaatctgaagattgtgatgcagcaagccattggcaaacagaccatgaaacggtgaggctggggtcttcccacaatacatccgatggcataactatgagcgaaaaccaagacagcagtaacataaaatcatccaacaaaagggtcacaattcacacatatcctcataatgcagcaggttctttagtacagaacgggaagcttatcaacctgcctggttcactggacgagatcttcgaaattggatgccagaagtttccgggtctccgccctacaaaactggtcagtggagactatgctgagatagatgacattagtgttatacgtgatggtgaac

SEQ ID NO: 17650 - DNA, 411 bp, Zea mays
  Clone ID: LIB189-016-Q1-E1-H8
cggacgcgtgggggaagtcgccggctcagatccagccgggctgcggcgctggccggatggccgagcagggcggcgcagccggggaggccgctggcagcgacccccctgcgcctgcgcctgcgactgccccggcgcgagccccagcgcttgctgcggacgcggccgggcagaggtccctgccgacgccgttcctgaccaagacgtaccagctggtggacgacccggcggtggacgacgtgatctcgtggaacgaggacggctcgacgttcgtggtgtggcggccggcggagtttgcgcgcgacctcctccccaagtatttcaagcacaataacttctccagctttgtgcggcagctcaacacctacggatttaggaagatggtgcccgaccggtgggagttcgccaacgact

SEQ ID NO: 17651 - DNA, 337 bp, Zea mays
  Clone ID: LIB189-017-Q1-E1-A1
agcatacacaacatcatcatcatcatcttctcgctagtcgagcgagcccttgtagttaattaagctagtcgatcgatccaagagaagaagaagcagcagacaggaatggcgtcgctctcgatgacgacgagcgcagcggcccgcgcgcagtggacgcctaggcagaacaagctgttcgagcaggcgctggcggtgtacgacaaggacacgcccgaccgctggcacaacatcgcctgcgccgtcggcggcgggaagtccgcggacgacgtcaggcgctactacgagctgctggaggaggacgtcggccacatcgagtccggcaaggtgcccttccccg

SEQ ID NO: 17652 - DNA, 375 bp, Zea mays
  Clone ID: LIB189-017-Q1-E1-A2
acccacgcgtccgcacccattgggcatgtttgacagcattgcatcacttgctgttgctcaaaacatgcgtgagctttatagattggttctagtcgatacaccactggccccttacttctcagagtgcattacatctgaggatttggatgacatgaatattgagattatgaggaacactctctacaaagcatatcttgaggacttctacaaattttgccagaaactaggtggtgcaacagctgagatcatgtgtgatctcctttcatttgaagctgacagaagagctgttaacattacaataaatagtattggtactgagttgacaagagatgaccgcaggaagctgtactccaactttggtttattgtatccata

SEQ ID NO: 17653 - DNA, 365 bp, Zea mays
  Clone ID: LIB189-017-Q1-E1-A3
acgtacgtatgacggtaaagacctttaccgacggaccacgaacgttgttgcaagctgtgtcggtaaaacttttaccgaccgaccgttgttttaccgacttatcttctgtcgctaaaagaaaagttttaccgacgcttcatcatttggtaataatagtattaccgactctctaagagttgcagctgccacgatgtaccgacccatcttctgtcgctaaaagagacattttatcaacgcttcatcagttggtaataatagtattaccgactctctaagagtcactaattgtgtagattaccgaccaacaattcgttgccgcagatattaccaaccaacaatccattgcattcatacaaatagataat

SEQ ID NO: 17654 - DNA, 176 bp, Zea mays
  Clone ID: LIB189-017-Q1-E1-A4
gaactccccaacaatcctgaactaactgggtctgcctcaacgttgacatcaacaattataatacaacaattgttggcaacaactgaaaaatatggaatggtcccttcgcctaacctgtgttaaacaaaactctgttaagaactgaatcctgaaactggtgcaacaactttaaccct

SEQ ID NO: 17655 - DNA, 214 bp, Zea mays
  Clone ID: LIB189-017-Q1-E1-A5
ctgggctcgattacgtttcatgctcccctttcaaggttccgattgctaagctagctgcagctcaggtgcttgtctgaggctgcctcctccttggcaaccggattgcctgctgctgatggatgtggtgatcaacagtattattacaaagccatgctatgtgaacattactagtagcagtgctcataaaagctacaatcccatctccctttttttt

SEQ ID NO: 17656 - DNA, 387 bp, Zea mays
  Clone ID: LIB189-017-Q1-E1-A6
ggttctagtcgcttctcgtcgtttcgttcgtaggtgcgccccctctcatctgcactaaacctgagtcctgattagggttctacataatcgcttctctttgcctgattgatttgataccctacatccgtggtcgccggttgttccggattagccggatctgttggtctccggttcgtgtgtgctgtaccggatttggggtatgttcgagttgcttggtagatttacgttggtacatacggttgcacagaagatctggatttactgagtagtaggctagtagctgcctacggcgtacacatgacttgtgtatgaatcgtgtatctggcgtgtcgatgcttagtacgcgtagtgctgcaccatactgaaactgaatggacattggctgtg

SEQ ID NO: 17657 - DNA, 355 bp, Zea mays
  Clone ID: LIB189-017-Q1-E1-A8
cggacgcgtgggcgacccactcgtcggactggctgctacatcttactgcagggaaatacggttgcagccatgggcaactataggggaaggggactgaacctagtgatgaaggattgtacatgattgcatgaataatgtatagcatccagtgttacatatcaacgaactactcatcatacgtgatctaccacaaaatcctgctctagcctaagaccattgggacagatttctcccgaagttcattgatgaagaatgttcagcatacaaagcctcaatctacagagaagaaatcgtacacaccctttccaacgcctcaacagcctaacgataatgatcttgatcttgataacggtga

SEQ ID NO: 17658 - DNA, 143 bp, Zea mays
  Clone ID: LIB189-017-Q1-E1-B1
gcgtccacccacaacgtccgttttttttttttttttttttttttttttttttttttttcttttttttttttttttttttttttattatttttttatctttggctgcatctcaagacgagataacgggaggccgccccaaaggg

SEQ ID NO: 17659 - DNA, 370 bp, Zea mays
  Clone ID: LIB189-016-Q1-E1-E6
accacgcgtccgcggacgcgtgggctcgtgattcgtgaacggcggcgacaagaagccgggagagatgccgctggccacaactgctccgacgccggcgccgccctgtcctccgccgagtccagcagcggcaccaatccggacgcagctccgctcctccgtcgcgaagctcgcgctcacggccgcgctcgtgtgcggctctggcggtctcgctgccatcgtcgtcgttccggccgccgctcaggccgtcccgttcgtccgtcctcctcctcctctcctgcaaggaaggcccttcgcctcctccactccttacgcgcagtctcagaatctgcagcttggcctcgacaagctcggaaagatcatgccatgcccg

SEQ ID NO: 17660 - DNA, 413 bp, Zea mays
  Clone ID: LIB189-016-Q1-E1-E7
accacgcgtccgcaactagcaacatagaaagcacaagagtgtaccaacaatggcagccaaaatattttgcctccttatgctccttggtctttctgcaagtgctgctacggcgaccattttcccacaatgctcagaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcataccttgctgcctactctcagcaacaacagtttcttccattcaaccaac

SEQ ID NO: 17661 - DNA, 415 bp, Zea mays
  Clone ID: LIB189-016-Q1-E1-E8
accacgcgtccgcaaactccttgttgtattgacaaaagcgggcaaagtgatggctctgcacactggagatggacgtgttatctggtcgaaattggtgccatctcttcgtgcctccagatgtggtggagtcccttgtgcattaaggatataccaatggcaggtcccgcatcacagtgtcatgcgtgaaaatccatctgtacttgttgttggcaaatttggagcagaaccttcaattcctggtgtattctctattcttgattcatattctggagaagaactgaactctatgaaacttgaccattctgttgtccaaattattcccttgacactgaaggattcatcagagcaacaacttcatctgtttgttgattccgattccaatgcacatttatatccgaaatctccagatgctctc

SEQ ID NO: 17662 - DNA, 256 bp, Zea mays
  Clone ID: LIB189-016-Q1-E1-F2
gcgtccgacactacaccacaccacacacacccgacgactatgacacacatgtagaagatctagttcgtccaatcgtgaccgtgacgcaggacgctatcaactatccatgacatgaataatattggcggcctctacggtggcaacgcgctctgtcacggtgacgacagctatcttcgctgcagctgtagccacagacggcaccgacgtgctgatcatcgtccccaagacggctggcgccgggcgcatcatctggttc

SEQ ID NO: 17663 - DNA, 407 bp, Zea mays
  unsure at all n locations
  Clone ID: LIB189-016-Q1-E1-F5
attgaggacaagctgcaccccggtgggcccttcgaccccctgggcctggccagcgaccccgaccaggccgccatcctcaaggtgaaggagatcaagaacggccggctggccatgttctccatgttcgccttcgtcatccaggcctacgtcaccggcgaaggccccgtggagaacctcgccaagcacctcagcgaccccttcggcaacaacctgctcaccgtcatctccggcgccgccgagaggacgcctagcctgtaaggacggacgccacgccgccgagcaatgccaagtcatgcgctgctgcatgccgtctttgattttaccgggataaaaagctgtatgtgagggtctgaagaatgtgcaatgcccacgcgtgtaaattatcgagagggggaacanaccttttc

SEQ ID NO: 17664 - DNA, 395 bp, Zea mays
  Clone ID: LIB189-016-Q1-E1-F7
ggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgttcaacgtcccggccatcaacgggaacagcctcacggggctcttcttccccagcatcggccaggagctggcccacttccccacgcccccgcccgtcacctcccagttctggctgtggccagtgacgtggcacctgggcctg

SEQ ID NO: 17665 - DNA, 348 bp, Zea mays
  Clone ID: LIB189-016-Q1-E1-G5
aaacgacttgtttcattgattcttgaagagatcgagcttcttttgcaccacaaggtcgaggatgtcttgcaactgcggatcaagctgcggctgcggctcaagctgcaagtgcgggtaatatatatgataatatataagtgcaccgtgcatgattaatttctccagccttcttcttgtctagttaatttccatttatttattttttccattgcaaaacaaacaaacaaacagacaagaacaaagttaatttggatcgagtagttcaatccatttgcgcgctgtccttttcagcaagaagtaccctgacctggaggagacgagcaccgccgcgcaggccaccgtcgtcct

SEQ ID NO: 17666 - DNA, 354 bp, Zea mays
  Clone ID: LIB189-016-Q1-E1-G6
gacttgtttcattgattcttgaagatatcgagctgcggttggcgccacaaggtctaggatgtcttgcaactgcggatcaagctgctgctgcggctcaagctgcaagtgcgggtaatatatatgataatagtgcactggaccgtgcatgaggaatttctccagccttcttcttgtctagttaatttccatttatttattttttccattgcaaaacacacacacaaacagacaataacaaacttaatttggatcgaatagttcaatccatttgcgcgctgtccttttcagcaagaagtaccctgacctgtaggagacgagcaccgccgcgcaggccaccgtcgtcctcggtgtggc

SEQ ID NO: 17667 - DNA, 404 bp, Zea mays
  Clone ID: LIB189-016-Q1-E1-G7
atcctatggaaaaagaagagcagccaagtaaaccgtgggaatgttttttttgttgttgtcttgtgttcgatggcaacacccaggtcgtgaaggcaatcgagaacgcgatccccgtgcggcacgcgctgcccgccgccgccgccgcggagatcgaccccgcgtgggaggaggagctgagggccatggaggcggagaaggcggagatcgaccgggcggccgcggcgcgggtgcggcgggagctgtggtgcgggctgacgtacctggtgatccagacggccgggttcatgcggctcaccttctgggagctgtcgtgggacgtgatggagcccatctgcttctacgtcacgtccatgtacttcatggccggctaccccttcttcctccgcaccaagaaggagccgtcg

SEQ ID NO: 17668 - DNA, 400 bp, Zea mays
  Clone ID: LIB189-016-Q1-E1-G8
accacgcgtccgcccacgcgtccgggcggctttcaatcgtttccacctggcgcctttggccccggctgcgcgcgtttcccgctggccgctgctatccgatttcttgattcggtcgctctgtctcgtcaaggcgtgcaccgccttccatgttgtttgttcaaaatttctgcttctgcaactctctttgcttgttctgtgaaaacataggttccatttcaacttccgtcggacaggacctgtattcgtcgagaaaaagtccctttttcatagacgaactttgcacgactgtttcttatatagagatttaagtcgatagatggtaaaaggccatgggagacatacagtttactgggaaaaccagtttccattcagctgtttttctctccctaattttgatttg

SEQ ID NO: 17669 - DNA, 123 bp, Zea mays
  Clone ID: LIB189-016-Q1-E1-C5
aaccacgcgtccgatgcagacacggtgcaacacccagcgatccctgcacttgtgtttgacatagcaaaagcccctactgtttagtattaattatcaataaatttgtttgggacggttgaattg

SEQ ID NO: 17670 - DNA, 402 bp, Zea mays
  Clone ID: LIB189-016-Q1-E1-C6
acccacgagtccgaaaaaaaaaaaaaaaaaaaaaaaaaaaaaaaaaaaaaaaaaaaaaaaaaaaaaaaaaaaaaaaaaaaataaaaaaaataaataaaaataaaaaaaaaaaaaaaaaaaaataaaaaaaaaaaaaaaaaaacaaaaaaggcgcggcccctcaaaagtttccaactttatttaccctttattccaatttcaaactccttcaaaattttccctaaatttcattccatggcccttctttttaaaacttcttacttggaaaacccctgcctttcccctttttaacccctttgcaaaaaatccccttttcccaatctggctttttaccaaaaagccctcccccttttccccttccaaaaatttccccaccttaaatgcaaattggaaccccccctt

SEQ ID NO: 17671 - DNA, 378 bp, Zea mays
  Clone ID: LIB189-016-Q1-E1-C7
accacgcgtccgcaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccg

SEQ ID NO: 17672 - DNA, 420 bp, Zea mays
  Clone ID: LIB189-016-Q1-E1-C8
ggtgatagacattcctggaacaactggagccagctttggtcaggagctcatgttttacgagaggccagagccgaggtccggcatacaccgcatggtgttcgtgctgttccggcagctcggcagggggacggtgtttgcaccagacatgcggcacaacttcaactgcaagagcttcgcccgtcagtaccacctggacgtcgtggctgccacgtatttcaactgccaaagggaggcaggatccgggggcagaaggttcaggccggagagctcgtaaggaatgaagcatgcacagaagaagactgcagcgctttcgtatgcatatgatctatcgtcgtcctgcggaatatatatatagtaaccgttgttatatggaataatgtgcatgaaattggtatcagatgcaccgacccgtacgtacgt

SEQ ID NO: 17673 - DNA, 396 bp, Zea mays
  Clone ID: LIB189-016-Q1-E1-D5
accacgcgtccgctaacttacacaacacagttcatgattcaggttcaattaacgatgttgatccactgaaacatgtggtttttgataacagcggatctcataagttcagtgtaagatgtgaatcacagcctcaggcttctgaaagttccagggatgtttgtaattcagatcaaagatgtgcaaatggtgggagaaatcaaactacttcctgtgctagtactcttatggtaaataaacaaaattgttactcagaaaatgatgaaggctccaggcatgatgtagagctgatgacgaactctgctagttctgatagcacctcgtcatgcatgagccagggagatagggaaagcagctccagcagtacaacctcttcgagcgctcaaaatccggaatcat

SEQ ID NO: 17674 - DNA, 314 bp, Zea mays
  Clone ID: LIB189-016-Q1-E1-D6
agaataatatataaggaaaaaaaaaaaaaaaaaaaaaaaaaaagaaaaaaaaaaaaaaataaatacaaaaaaaaaaaataatttatgataaaaaaaaaattacataagttcactctactatgtgaatcacacactgacgccttctgaaaattcccgtcatgtttgtagttcatatcagtgacatcccaatgctggcacacatcatactacttcctgtactactattcttatcgtcattgcactcaattgttactcagatacatgattaacgctccatccattatctatagctgatccacgatttctgcaaactt

SEQ ID NO: 17675 - DNA, 398 bp, Zea mays
  Clone ID: LIB189-016-Q1-E1-D7
accacgcgtccgcccacgcgtccggctcggtgtcacaaaacctgaccgatggcggcccggtgctccacagctgcctccgtgtccgtggtcagaacaggatcgcgagacctctccccctccttttccttcacagccgcggcgctcccctcggcgcgtctgaggccggtaggagcgtgggtccgcggtggagggtacacctgcaggctccgcgccgtccgcgccatgggctccgcgccgtcgtcgtcccaatccccgtcgctgcacacgccttcaggacaaacccaagggaaagcagattataaatcactgagtgaagaggagtggaagaagcgcctgactgaagagcagtattatgttactcggcagaagggcactgaaagagcactcactggggaata

SEQ ID NO: 17676 - DNA, 430 bp, Zea mays
  Clone ID: LIB189-016-Q1-E1-D8
aatgagtttgcctctatcccgcccacctcaccgtcgttgtctccgccaccgccactgctcccaccactgccatgcattaacctcaacccttccgcaaactattcactgtcactttgtcatcggcgctccatcgttcactcaaatgtggtctccgatacctggcaccctcatgaggactagttcactccctgctgtcattgaggcttctggcaatgatgactggaagaaacgaaaggaagcacagagcctgaagaggctcgaggttaagaagaagaggattgagaggaggaactctctcgcctgcaacacttcaaaagaagctgctgggcagagtccaaaagagatgaatgcaaacactgacaaattagtaagttctgatgaaactattgtcagcgctaacgaaagtcatagcagtggcaagcatctggtg

SEQ ID NO: 17677 - DNA, 386 bp, Zea mays
  Clone ID: LIB189-016-Q1-E1-E1
accacgcgtccgagcctctagtcggccagtcgggacgaagcctctcgaacgagcgaggccacgaggtgcccgccgcgcccagccggcctcgccgaccgggcccgccggcccctatataggcaggcgccacttcctccgcgcaaccaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaagcgggttaccgacatatcgattgtgccagagtttacggcaacgaaaaagagattg

SEQ ID NO: 17678 - DNA, 417 bp, Zea mays
  Clone ID: LIB189-016-Q1-E1-E2
cgacgacgatctccacgccgacagcgggcagcggtggctcgcggcgtccaagcatcgtgacgtttttagtgcagcggacacggttgcagtgtcacagcagtcgccggcaagtggtcatcgtctggttgtcattcatgacgaaacgaccatcatggctccacctgttcaggtcgtggttgtgcaggtggaggacaagtgcagtgttgttcgtcacggggagacgagcggttcttcttcttcttctatttcgtcatcggcgagcgaggaagaggacgtgtcctttttggagtcgaaccgagaaatgctggaagatgatgctgatcgtagtacgtcctctgatgggagctggagagtggagaaagtgaagagactgatcaacatggtcaccctggtgtctctgctcattcttttgtacac

SEQ ID NO: 17679 - DNA, 365 bp, Zea mays
  Clone ID: LIB189-016-Q1-E1-E3
aggacgcgtgggctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcaaggagcagtccagtgacgagaatccccaatgcggatgccttgtggacatgttgtctccaagcagtccatcatgaagctgtcgaaaagcagct

SEQ ID NO: 17680 - DNA, 391 bp, Zea mays
  Clone ID: LIB189-032-Q1-E1-B10
accacgcgtccgcccacgcgtccgagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacg

SEQ ID NO: 17681 - DNA, 388 bp, Zea mays
  Clone ID: LIB189-032-Q1-E1-B11
accacgcgtccgatcccaccaaaaatgagcaccgaatctctcgtcttcaagggcagcctcgtcggccacaaggatggcatcaccgcgatcgccacctcgtcggagaaccccgacatgatccttaccgcttcccgcgacaagaccatcattatgtggaccctcactcgtgacgattcgtcgttcggataccccaagcgtatcctccacggacacaaccacttcgtctctgacgttgttgtttcgtctgacggtcaattcgctctctcctcctcgtgggacaagaccctccgtctttgggacctcaacacgggacttaccacccgtcgcttcgttggacacacttcggacgttctctccgtctccttctctgctgacaaccgtcaaatcg

SEQ ID NO: 17682 - DNA, 369 bp, Zea mays
  Clone ID: LIB189-032-Q1-E1-B12
accacgcgtccgcccacgcgtccgcccacgcgtccgcaccagcccctctcgcctcacgaaaaggcgcaggccaaggccaaggccaagccgccccctccctcctctcctctcctctcctctcctttcctctccactctctggcagccaaaggcgaggccgagatcctgcgcgcggaggatgccttccaggtccatgagccggctgtccgtcgagtccgcctcgggcagcggcggcggcggctgccgggaggccgagccggtgctctgcgcgcctcggccgcgcagggcccagcagcagctggtccacgtccacccccgcggcgccgacctcatcctcggcccgccgcccttccttctcaacgaggtaccc

SEQ ID NO: 17683 - DNA, 364 bp, Zea mays
  Clone ID: LIB189-032-Q1-E1-B2
acagcggacacgctcggcctcccgttcgtgcgaccgtatctgagcggacggagcgcggaggacttcgcgggcggggccaacttcgccgtgggcggcgccacggcgctcagcccggacttcttccgtgcaagggggttccacaacatgggaaaccgagtggacctcgacatggagatgaagtggttccgcggcctgctcgacctactctgccccggcaacctcgccggttgctcggatatgatgaaccaatctctcttcttagttggagaaatcgggggcaatgactacaacggacctcttctttctggagttcccttcgaggaaattcgcgccatcactccgagtgttgttgcgaaaatttcct

SEQ ID NO: 17684 - DNA, 427 bp, Zea mays
  Clone ID: LIB189-032-Q1-E1-B5
actttgcagaactccatcaagcagctcgagagtgctgccaccaaaatttacaaagagaagaagttgctgcaagcagaaaactggagcctaaagacaagtaagtatacgctgaaagtcagggagataaacgaccggttgatgatggccgagcgagcgttcaccaaccgagaaggactggtcgggagaccatggtacaagcatatgatatatgcatcatcggatcaagacgactgggggaccaaagccttccctggtatagtctcggccatggacaaggctaagaagtccaacacaaccgagacgtggcgactgctgcagcacgagatttacagggttgccagggctgtgtccaaggcttctgcagtcctggatggtaaactaacatgatgtgcacgtgcactgcagattttcattccattctacatag

SEQ ID NO: 17685 - DNA, 422 bp, Zea mays
  Clone ID: LIB189-032-Q1-E1-B7
agcagccagagaacagggaggtagagaggaggaggaggaggtagaaggcgaaagaaggggaaccaaatcttggacgggaacacatagatttctttggtggaggaaggaggagggcaacaagaggaggttacaggtagcccaatagatctactgctgttgagggagttgatgcaaagctgagttgctgcgcgttggctttctttagagatggcttcagctggtgttgccccttctgggtacaagaacagcagcagcaccagcattggtgccgaaaagttgcaagatcacatgaacgagctaaagattagagatgataaggaagttgaagcaaccataattaatgggaaagggaccgaaactgggcacataattgtcaccactactggtggcaagaatggtcaaccaaaacagacagtgagcta

SEQ ID NO: 17686 - DNA, 427 bp, Zea mays
  Clone ID: LIB189-032-Q1-E1-B8
atgagaatgactgggatgtggttaaacgtggctgggatgctcaggtgctcggagaagcaccctacaaattcaaaagtgcacttgaggctgtgaaaacactgagagcacagcccaatgctaatgaccaatacttgcccccatttgtgatagttgatgacagcggcaaagctgttgggcctgtattagatggtgatgcagttgtcactatcaacttccgggctgatcgcatggttatgcttgctaaagcactagagtatgcagattttaacaattttgaccgtgtacgtgtccccaaaattcgatatgctgggatgcttcagtatgatggtgagttgaagcttccaagtcgctaccttgtttcccaccagagatagatagaacatctggggagtacttggtgaagaatggcatccgcacctttgcttgc

SEQ ID NO: 17687 - DNA, 410 bp, Zea mays
  Clone ID: LIB189-032-Q1-E1-C1
gatggacacacatgctataacattttaccgatgatcgttcactaatctctgtctgtttggcatcagtggcaatcaaaaccagtagcgtagtgcgtgctccgtagtacttcactggcaaaatcagcatggcctacgaggactttactcacttcaagagattacgttagagttcaggcgctggctggttgcctggccacgctttattaatgagttcagttctaaacccctgctgaagcccaggcagtgtccatgtctctacgagatagttgtgcccagggcaagtggacgtgcaggtgtgcagcgcacagccttgttggcttcggcacagacccagcttcgaattcgtgctggtgctgcgcataaagatggaacttgtttgtgtccagcggtcgcagtgctggtgcctgctg

SEQ ID NO: 17688 - DNA, 392 bp, Zea mays
  Clone ID: LIB189-032-Q1-E1-C12
atgagaccccacgtcgacccttcacgaactcaaatttaaattagtcgatccccacaaacttaacttattaagtttattgaaatacattatcggttatgttcgctagtgaaccgacgaggttagcttaagtttaccagcttatatggttaagttcgacgattttttttatccacgttctttcacccgtttcttgtgtgggcggcaaccaaattgtctgggtttcaaaattcgcgtcgcgttctccgtcattcctaactccggcgacccgctccggtgttggtccgaactccagttgcccaactcgatcgaggtcccggcaagcagattgaaataatccctggcccatctctcgtttccatgggttggttcaagctccgtagcctcccttgtcc

SEQ ID NO: 17689 - DNA, 434 bp, Zea mays
  unsure at all n locations
  Clone ID: LIB189-032-Q1-E1-C3
agcgtactccgtggcgctcctccgggggcccccgcttcccgccggtccgccccccggcctcctccctccgggcaaccttcggcaacctccccttcaaaaatcaaccaaggtcctcccggccccttccaaaggccccttccaaggacaaaatcggcccccgggaacaatttgttcgaggacctcaaaacgaagtgggaccccgttgaggacaacccaaccgtcctcttgtacggccgcngcgccgtcgtcgccctatggctgacgtccgtggtcgtgggcgccatcaacgccgtgccgctgctccccaagatcctggagctcgttgggctccgctacaccgggtggttcgtgtaccgctaccttctcttttaaggaaagcangaaagagtttggcgccgacattgagaactttgaagaaaaaaattaactggaac

SEQ ID NO: 17690 - DNA, 359 bp, Zea mays
  Clone ID: LIB189-031-Q1-E1-H10
ccagaccacagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctgcgcgagtacggcgcgctcggcctactcgacgccgaggacgacctggacgacgacgtcgacagcttcctccccgacgacttcttctcgcct

SEQ ID NO: 17691 - DNA, 415 bp, Zea mays
  Clone ID: LIB189-031-Q1-E1-H3
cggacgcgtgggtcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggccatctgctgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcctgtgtgtgtgcgcgcgcatcttcatttg

SEQ ID NO: 17692 - DNA, 434 bp, Zea mays
  Clone ID: LIB189-031-Q1-E1-H4
ggcacgcgtcagcagattaccaggctttacaaggagaaggactttttggaaactgaatttatagttgggcccataccagtagatgatggaaatggaaaagaagtagcaactgaaattgttacaaacatggttacaaacaaaacattctacactgattccagtggacgtgatttcatcaaaaggataagagattatcgatcggagtggaagattgaagtgcaccagcctattgctggaaactattatcctgttaatcttggcatctatgtggaggatggcagcaaagagctgtctgtactggtagacaggtcaattggaggttccagtataaaggatggacaaatagagctaatgctacacaggaggctactccatgatgatgggaaaggcgtcgccgaggcgctaaatgaaacagtctgtctcgataagcaatg

SEQ ID NO: 17693 - DNA, 417 bp, Zea mays
  Clone ID: LIB189-031-Q1-E1-H5
agcggacgcgtgggcggacgcgtgggtacgcgcacaagacgctgcgggagggccactacgaggcggagttcaaggtgccggcgtcgttcgggccggtgggcgcggtgctggtggagaacgagcaccacaaggaggtcttcatcaaggagatcaagctcgtcaccggcggcgacagcagcaccgccgtcaccttcgactgcaactcctgggtgcactccaagttcgacaacccggagaagcgcatcttcttcaccctcaagtcatacctgccgtccgacacgcccaaggggctggaggacctgaggaagaaggacctgcaggcgctgcgcggcgacgggcacggcgagcgcaaggtgttcgagcgcgtctacgactacgacgtgtacaacgacctgggcgacccggacaagaacccgg

SEQ ID NO: 17694 - DNA, 365 bp, Zea mays
  Clone ID: LIB189-031-Q1-E1-H6
agaagactgtcttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctctctaatattgttcacgtgggcccacttccaattattagtagatgaaaaattgataggaggtgaaaagtaggtatagaaaatgatattttatggttgtagtggggtataggggaaggatttagggggaaacgctgtacagagtggagatataggggggaagagaacgctgacgtggcacgtgagtgggatatagggaga

SEQ ID NO: 17695 - DNA, 380 bp, Zea mays
  unsure at all n locations
  Clone ID: LIB189-031-Q1-E1-H7
cggacgcgtgggggttgttgatatgtgcaagggagtgcagtatctcaatgaaatcaaggattctgttgtggctggtttccagtgggcatcgaaggagggtgcactggctgaagagaacatgcgcgggatttgcttcgaggtctgtgatgtcgttcttcatgctgatgctatccacaggggtggtggccaggtcattccaactgccaggagggtcatttatgcttctcagctcacagccaagccaaggctgctggaaccagtttacctggtggagatccaggccccagaaaatgcactgggtggcatatacggtgttctgaaccagaagagaggacatgtattcgangagatgcaaaggcctggtaccccgctctacaaca

SEQ ID NO: 17696 - DNA, 295 bp, Zea mays
  unsure at all n locations
  Clone ID: LIB189-031-Q1-E1-H8
gaagaagcggaggaggaaggacgggcggcgcaggctcaagctgtcatggctggcgtggccgtggtcacggagaagcgacaagggggacgcgggcggcgacggggacgacagcagcaaggangggaagaagcggaggaggaagggagggcgacgcccgctgccgcctctgctgacgacgacgacgtcgctgcagctcaagaaggcgctcgcgtcggtcgtctccggggagagcgccctactgcctgcgccggccaaggtgagcagtttcggcgacgccaagaagcaaagcaaccgc

SEQ ID NO: 17697 - DNA, 396 bp, Zea mays
  Clone ID: LIB189-032-Q1-E1-A1
aaattggtgttagcttaagaattcttagtattcatcccttcgattaaatgtgaacatttgccttttctcgtgccaattactaatgttacggcattattcaggacaaaactttactggaaggtcctgtgttcaatgcattctgggaaaggaatgttgcagagtctgtgcgccaaggagatgcaaggccatttgtggaggaagctgtgctgcaagtatctgactggggtttcagcctatctgacatccaaatgcagaagaaagaggctcgaggcttttttgaactcatcaagtctctgttcaatcatgctgaaagagagtgggtgggatttctgggcccaatacatatatggcaggggatggatgaccgagtgatctcgccgtcagtggctgaatttg

SEQ ID NO: 17698 - DNA, 421 bp, Zea mays
  Clone ID: LIB189-032-Q1-E1-A2
gggtccaggcacgcgtccgaattgaggttagcttaacaattcttagtagtcaccccttcgattaaatgtcaacatttgccttttcgcgttccaattactaatgttacggcattattcaggacagaactttactggaacgtcctgtgttcaatgcattctgggaaaggaatgttgcagagtctgtgcagccaaggagatgcaaggccatttgtggacgaagctgtgctgcaagtatctgactggggtttcagcctatctgacatccaactgcagaagaaagaggctcaaggcttttttgaactcatcacgtctctgttcaatcatgctgaaaaacagtgggtgggatttctgggcccaatacatatatcgcaggggatagatgaccgagtgatctcgccctcagtggcagaatttgtgccgc

SEQ ID NO: 17699 - DNA, 371 bp, Zea mays
  Clone ID: LIB189-032-Q1-E1-A6
atgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcagcggccgtggacgcagcggccgtgggtacggtggtggccgtggaggcggcggctaccgcggtggca

SEQ ID NO: 17700 - DNA, 382 bp, Zea mays
  Clone ID: LIB189-032-Q1-E1-A7
cgtcgccttcatctcgggcgtccccgcccgcatccgcgcccgcgacgacgtcgtccgcatggccgagatcaactttctctgggtccacaagaagctccgattcaagcgcctggcaaccgtgctcatccgggaagtcacccgccgcgtccaacaggagaacatctggcaagctgcatacaccgcggggatcgtcctcccaacccccatcaacacctgccgctactggcaccgattcctcaaccccaagaagcttatcgatgttggattctctcgccttggtccgcgcatgactatgagccgcacggtccggctatacaagctgcctgatgcgccgctcacccctgggtttcgcaggatggagctgcgggatgtccctgcggtc

SEQ ID NO: 17701 - DNA, 267 bp, Zea mays
  Clone ID: LIB189-031-Q1-E1-F4
acgcgtcaacggcagcgtgggcaaatccttttgattttgggtccaggcagggtttgcccactgctgcatctattaaggcaatggcacatcaaattccaagggatcctgcattcagccggctggccgcgcacctaccgacatgtgcttaaagcacaagagaacacggcacacctccattaatgcctcaacaatacactgaatcagtgcctcaggtcatggaattcccccactttaggaccaccgcagatcctcaggggaattctcgca

SEQ ID NO: 17702 - DNA, 383 bp, Zea mays
  Clone ID: LIB189-031-Q1-E1-F5
aggcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagctggaggcgcgcgactccggcctgcagacgggtgaccccgccgggttcaacctcgccgacacgctggcctgcggcgccgtcg

SEQ ID NO: 17703 - DNA, 415 bp, Zea mays
  unsure at all n locations
  Clone ID: LIB189-031-Q1-E1-F6
agcccacgcgtccgcccacgcgtccgcccacgcgtccgcccacgcgtccgcccacgcgtccggggctgcctgtcgcacatgctggcggactccatccacgcggacgtgaccatcaacacgacggacggggtgctgaaggcgcacaaggcggtgctggcggcgtgctcccccgtgttcaagagcatgttcgtgcacgacctgagggagaaggagtcgtcgacggtggacatcggcgacatgtgcgtggagtcgtgctcggcgctgctgggtttcgtgtacgggacgatcgagcaggggcagttctggaagcaccggctgccgctgctggcggcggcggacaagtacgggatcngcgacatcaaggactgctgcnanganagcctgctggaggacataggctcgggcaacgtgctgg

SEQ ID NO: 17704 - DNA, 414 bp, Zea mays
  Clone ID: LIB189-031-Q1-E1-F7
agcttaatttttccttttgacttaggtctgcatccactattcgaattttattcttgtagtagctgccatattttgcccatctgaaatgtaatcatagattcacatttgggcccatcctaactttctctaggttccggtctttgttatgcctactgtgaaaatgcaaaactgtctttccttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaatacaaaaaaaaaaatactgctacaaaaaaaaaaaggggggcccccccaaaaatttccaactttaactgccggtaacgagaactttaagcccctttaaaagggtccccaaaat

SEQ ID NO: 17705 - DNA, 416 bp, Zea mays
  Clone ID: LIB189-031-Q1-E1-F8
agcccacgcgtccgcggacgcgtgggcggacgcgtgggtggacggcggcggcatgtccgcgatacaggggagccgccggctcgcgcacaccgatcagttcaggttcctggacaaggcagcgtcggtggagccatcggacgacaagtcgcgtccggcgagcgcgtggcgtctgtgcacggtgacgcaggtggaggagctcaagtgcgtgctccggctgctgccggtgtgggcgagcgggatcgtgttcgcggcggcgtacacgcagatgaccaccaccttcgtcctgcagggcgacacgctggacccgtacgtgggcggcttccgcgtgcccgccgccgtgctctccgtcttcgacacgctcagcgtcatgccgtgggtgccgctctacgaccgcttggtggtcccgctggcgcggc

SEQ ID NO: 17706 - DNA, 371 bp, Zea mays
  Clone ID: LIB189-031-Q1-E1-G10
aggaagtggtgagcgagtatggagagatgatccttgagttgctcatatcgcagacaagcccacagaaagtgtgcactcagattggtctctgtgtatttgatggtgcccattctgtcagcaatccaattgaatctgttgttgagaaacagaagcgtggttctgatcttttctgtactgcttgtgagatggctgttgtctggatacagaatcagctccgtgaaaacaagacaaaagaactcattttgaattatgctaatcagctctgtgagcgtctccctagccccaatggcgagtcaactgttgattgccatcagatctcaaagatgccaaatcttgcattcaccatagcaaacaagactttcaccttaaca

SEQ ID NO: 17707 - DNA, 296 bp, Zea mays
  Clone ID: LIB189-031-Q1-E1-G12
cccacgcgtccgccgacgaatatgaaggacatggcgtagacctcctgaaatctgaagcgtcaatggagtatctatgcaacttaccaccacataggtatgaagctgttttcgcgaaagaaattccggagacgatcactggcgatgcgtttttagagaagtatggagaccacaacgatgcggtaacagaagttgacccaaagcggtcttactgtgtcaaggctcctactagacatcccatatacgagaacttccgagtggaggccttcaaagcgttgctaacagctgccaaaacagac

SEQ ID NO: 17708 - DNA, 420 bp, Zea mays
  Clone ID: LIB189-031-Q1-E1-G3
agccgcaagaaaggaaacgagagagaaaatcgagtgaaaaggaagggaaacaacataacaaatcgcaaagaggcgtcttccaagtttgtagggttaccggatcggaggagcatccccgcctaggtcaccacagccatggttcgcggatcgctaggcaagcttgcgtcgcgcgccctctccgtcgccgggagatggcagcaccagcagcttcgccgcctcaacatccacgagtaccagggtgcggagttgatggggaagtacggtatcaacgtacccaggggtgcggcggcggggtccgtacaggaggtcaatgacgccttgaagaacatgttccccagtgagaaagagatagttgttaaaagtcaaatccttgctggtggccgagggctgggaactttcaaaagtgggctgcaaggaggt

SEQ ID NO: 17709 - DNA, 428 bp, Zea mays
  Clone ID: LIB189-031-Q1-E1-G4
acgcgtccgccgcaggataggaaacgagagagaaaatcgagtgaaaaggaagggaaacaacataacaaatcgcaaagaggcgtcttccaagtttgtagggttaccggatcggaggagcatccccgcctaggtcaccacagccatggttcgcggatcgctaggcaagcttgcgtcgcgcgccctctccgtcgccgggagatggcagcaccagcagcttcgccgcctcaacatccacgagtaccagggtgcggagttgatggggaagtacggtatcaacgtacccaggggtgccgcggcggggtccgtacaggaggtcaatgacgccttgaagaacatgttccccagtgagaaagagatagttgttaaaagtcaaatccttgccgggtggcccagggctgggaactttcagaagtggggctgcaaggagg

SEQ ID NO: 17710 - DNA, 367 bp, Zea mays
  Clone ID: LIB189-031-Q1-E1-G5
agcacgccacttcttggggctttcgttgcggacagttacttgggaaggtactggaccattgttgtggtcctcccggtctacatcgtggcaatgctcgtcctgatagcttcagcatcactcccggtattgttccagagcgacgtgcaccctgcagtggtttaccttggtctctaccttgccgccattgccagcggtggcgtgaagccctgcatttctgccttcggggctgatcaatttgacagcaatgacccggcggagctggtgaagaagggctccttcttcaactgctggctccagggtgtacaggtttagggaaatgggagtaagcccccttgtgagcttacttcaagtggttgttgcagctgtc

SEQ ID NO: 17711 - DNA, 435 bp, Zea mays
  Clone ID: LIB189-031-Q1-E1-G6
ccggctcgacccaagcgtcagggatcgcgtggcaggttgagcagatactggttgaaaggcgagaaggcaggcactgtggatcttttcgctatcttgcctggcttcccagacaatgtgagaacgaatgagaagggcgagttctgggtggcaatccactgccgccgaagtctgtacgcccggcttatgagccgccatgtcaagctgaggaagtttttgctcagcctcccgatccccgccaagtaccactacctgatgcagatcggtggcaggctccacgcggtcatcatcaagtacagcccagagggccaggtgcttgacatcttggaggacaccaagggcgaggtggtgagagccgtcagcgaagtggaggagaaagacgggaacctctggatagggtctgtcctgatgccgttcatcgctgtctttgacctcgcg

SEQ ID NO: 17712 - DNA, 415 bp, Zea mays
  unsure at all n locations
  Clone ID: LIB189-031-Q1-E1-G7
aggtcgcgtttgcagctaggcagatctgagttagccggcggatccgatccgtgcgcgtgcagtgtgtgtgtgtgtgtgtcggtggagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaacctctcggcctaccgcaccgccgtgagcccgctgctgcggggcgtcnaagtcggcctcgcgcacggctacctcctcgtggggc

SEQ ID NO: 17713 - DNA, 350 bp, Zea mays
  Clone ID: LIB189-031-Q1-E1-G8
agcggacgcgtgggtaatggtagagatagggtagattcagttgaaaatagcttcaatgctcgtgattgtgattcaaattgctctcatggacaaccttttttcaactttgatgattcacattcttatattcatccattcattcagaaaaagatatctcatcattgggacattactttcaatcagaataaggaagctctgaatcactatatacaagagtcatcatatccttcccttgagaaagtaccaactgattcctccgtagaagtagaaggtacagccgatacaactgcaacaggtcaagttttgaaagcaaggtctttaaaaattcttgagcattcacctgatgatga

SEQ ID NO: 17714 - DNA, 338 bp, Zea mays
  Clone ID: LIB189-031-Q1-E1-G9
agtgcttcgacgccgcgtggacggacgccgggcagcggctcctgcgcaagcacggcctcgacgccccgcaccccggcgcctgcatgccgagggagttcgtggagtacattgtcaggacgcaggaggacagccggagtccggcgttcgctggggtagtggcgaacacgtgccgcgcgatcgagagcgagttcatcgacgtggtggccggggaccctgagaaccgaggaaagagagtcttcgcagtcgggccgatgaatccgctgcttaacgtgaccgcgccgacagcgggacagagtgcacggcacgagtgcttggactggctcgacaagcaaccgccg

SEQ ID NO: 17715 - DNA, 257 bp, Zea mays
  Clone ID: LIB189-031-Q1-E1-F2
ccaggtggcccaattgacggaacaattgattgttacaaccccccaaaagcgggctttcattgaggttccaaaggaattaaggatgttcccaaaatggaaggttccttgggttccggttgtaaaaaacaggtgcaattttgaggctgatggaaaccgtaattacccatttggccaaggtccgggacaccaggttttgaacaattttggaaaactccacctctttgatttgccaaaacggcaaaccctttcggcttccg

SEQ ID NO: 17716 - DNA, 216 bp, Zea mays
  Clone ID: LIB189-015-Q1-E1-H4
tcggggtgaaggacgttcgcttccccggttcgtcgtccgggccacggtttaacccctcgcccttggaatccttcggcggaacccctttctccattcggccttcggcgcgcccgggtttttccctttccgaaaaggcaagcttcaatcccggccggggtggctcccccggcgattgggcgggaacgccggccaaccaaaaccttcttggccggcggc

SEQ ID NO: 17717 - DNA, 355 bp, Zea mays
  Clone ID: LIB189-015-Q1-E1-H5
cccacgcgtccgcccacgcgtccgcggacgcgtgggaaaaaaaaaaaaaaataaaataaaaaaagaaaagaataaagaaattggaaaagaaaagtaaaaaaagaaaaagaaaaatgtaaaataaagtaaaaatgaaataaaaaatttttttcaaaaaaaaaaaggggtggccgcccaaaaggttcgaggttaacttaagcggataggcaatttcatactccttcaaaggggtccctaaatttaatttcaggggccttcttttaaaaacttctgaaggggaaaaaccgggtttttacccagttaaacccctttgaaaaaaatccccttttcccaacgggggttaaacccaaaaagg

SEQ ID NO: 17718 - DNA, 332 bp, Zea mays
  Clone ID: LIB189-015-Q1-E1-H8
agaggccaaaacccgcgcacaccggcgacggcaggagaacctcccgccggccgccgccatgccgccgcctctacaggcccaccgcctactcatctcccaccgccgcctacccactccagctcgccgccggttcaccgccgcctcttccgtccaatccgctcccgccacaaccttggccccgggccccgccacatcctccatcctctccatccgcgagtcgctcctctcaggcgagaggaccgcggcggacatcacctccgagtacctctcccgcctccgccgtaccgagccgaccttgcgcagcttcatccacgtcgcggacgccgccgccg

SEQ ID NO: 17719 - DNA, 198 bp, Zea mays
  Clone ID: LIB189-016-Q1-E1-A1
aagagtctcgaatctgaaatcgatcgtgttgtatatgttccacgatcgcaacgacgtaaaatggttcaaggcaaagtattatgcgtgccattgacatagccaatttaaccaatttcgaagcaacgacaatgttatttttgcagcctaatgagcggtggaaaaaacatggtcctcgtggccgcatcatggaaaacgttg

SEQ ID NO: 17720 - DNA, 303 bp, Zea mays
  Clone ID: LIB189-016-Q1-E1-A2
cacgcgtccgaccacgcgtccggtcacaactgaagaagtgtctcaggtacctgaagagcagctaccaatagaggatcttagtgttcaagatgacctgacttatgctgagtatcccataaagattcttgatacactgactcctgtcacgagaaataaggttataaagatgtgcaaagtgcaattgcgtcactatggcgaagaagaagatacttggaagagagaagaagagcttcgcatagactttccccatcttttccctagatcttcttaaatctcgaggacgagattatttttaaggggggt

SEQ ID NO: 17721 - DNA, 415 bp, Zea mays
  Clone ID: LIB189-016-Q1-E1-A3
ggacgcgtccgattaaaactggtgttaaggattataaattgacttactacaccccggagtacgaaaccaaggatactgatatcttggcagcattccgagtaactcctcagctcggggttccgcctgaagaagcaggagctgcagtagcggcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatcaacgaattccccctgcttattcaaaaac

SEQ ID NO: 17722 - DNA, 304 bp, Zea mays
  Clone ID: LIB189-016-Q1-E1-A5
ccgaatcgagcgagggagtagagcaaattgaatcaggtttcgtgtcgattcggaggctttcgcttctgcttgcggagttgcggtggagatttgaggcctgcggcgacgatggcacctgcggaatccggggagaatgcgaccagcttcgccatggcctgcagcctgctcagccgctacgtcaggcagaacggtgccgcggctgccgatctcggcctcgctatcagagctgaatccgatgcaaagaggacgtcgacggacatggaaaagggggaaaccgggaaggagaccatggatctcttccccc

SEQ ID NO: 17723 - DNA, 404 bp, Zea mays
  unsure at all n locations
  Clone ID: LIB189-016-Q1-E1-A8
acaacttcagagtggcaggtttgcagatgtcgaagaagtggtatatctgaaatggataaatgcctgcctacggtatgagctgagaaacaaggatgccccatcagggaagactgttgcacgagatcttagcaagagcctgagccccaagtctgaattgaaggccaaacagctgataatggaatatgccaatgtgggtgcggaggacagtcacttggggcatgtcgaattcggttcagagtgctcttcctcacgggcttcgtcaggtgaaccggatgatgtgtccattgaaantgcttcaatgacaaaacatactaataaaaaacccaaaaagaaaaagttcttctctaagcttcggaaactggtgctgggaaaagggaaagagaancgtgaaatttctactctgg

SEQ ID NO: 17724 - DNA, 374 bp, Zea mays
  Clone ID: LIB189-016-Q1-E1-B5
accacgcgtccgcggacgcgtgggtggatgcagaaacaacggtggtatgttgctgacaacggcatctactccaagttaatatctgtgatgggaaggaaagggcagatacggatggcaatgtggctgttctctcagatgcggaacagcgggtgcaagcctgacacttctgtatataactcccttatcggcgcacatctgcattcacgagacaagagtaaggctttggccaaagctctcggctattttgagaagatgaagtgtatagagagatgccagccgactattgtgacatacaacattctgctaagggcttttgcacaggctggtgacacaaagcaggtagacatgttgttcaaggatctggatgaaagtgt

SEQ ID NO: 17725 - DNA, 264 bp, Zea mays
  Clone ID: LIB189-016-Q1-E1-B6
ggcatccatatcctttcgcatcagtactgggagtggcacacgcaccgcacacatactactagtatgtagtggagtgcttgaaaggcataagcgaattttcttcttgtttggtctacgtccatttgcttgtccaggtaaccggctagtttactctgctttttgggttttccacgtctctctacaattgtgactgttgaccacctataattgtgactgttgaccacctatagatgcggttcagctagccctccgacccccctctcg

SEQ ID NO: 17726 - DNA, 387 bp, Zea mays
  Clone ID: LIB189-016-Q1-E1-B7
atcgtctccatgccgtgcaagccgaggttctacttcttgccagtggtaaggacaatcttctaccaagcggagaagaagcggatcgactcttcaaggcactgaaaaactgcagagttcgatacttcaaggacaatggccatacactactgctggaggatggcgtcaacctgttaactgtcataaaaggagcgaacatgtatcggcgtggaaggcaaagggattctgtaaccgattatctcacgcctactctaagtgaattcaggcaaacatttgatgtggatcacaggctgttccaccttgcactgagcccagtcatgatgtccaccctgaaggatgggaaaatcgtccgcgggcttgccggtgtccctgacaaaggcccggtcttgt

SEQ ID NO: 17727 - DNA, 376 bp, Zea mays
  unsure at all n locations
  Clone ID: LIB189-015-Q1-E1-H3
cccgggcccgaccaacccttcagccaacccgtccgacctctgcggcaaacaattccggcgggccccggcggcggcaacaacggcgttcctccgccgttgcccggcgccttccttcccggacaacaacggcacaacttcccccccttcggcttcccgttccggcccaacccggccggccgggtccccaacgggcccttccccctggtccccgcgcccgtctccggtgccggtccccccaggatccggggtcctgacttcgggggcttcccggtgccacggctgccgctgctcgctgtgtctctgtntcttggggttttgcagtgactcgctcgcggttgctgccctggtggactggatgtatatctacccgtagctg

SEQ ID NO: 17728 - DNA, 376 bp, Zea mays
  Clone ID: LIB189-015-Q1-E1-E6
aggaacctcaatccggaagcgaaaaggaccagaagaaaccagaggcgactccaggttcgtgggcgatgctgcgcgcgggagctaggcagctccttgccccggggctccggcggctcggtctgggcaccggcgccgccggtcaggtgggcccggccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgccgctccgccat

SEQ ID NO: 17729 - DNA, 360 bp, Zea mays
  Clone ID: LIB189-015-Q1-E1-E7
ataccccaccttgcgtacgcgagccgaacgctcgtgggtactgcagcctccgtccctacctagggttccggcgatggcgcacggcggctacccgcgccgcggcgctgccgtacgcaggcccaagtcctcggcctctgccgctgttgccgaccgcaagcggaagcggaccgccgccgccgccaagaccacctcccttaagaaccagatccgctccaccgagcgcttcctccgcaaggaccttccggatgagattagggttgctcaagagaagaaactggaagaactgaagaggcaacaagagcttcagaatcaacttgttgtccagcggacattacagtttagagatagaaagataaaatt

SEQ ID NO: 17730 - DNA, 373 bp, Zea mays
  Clone ID: LIB189-015-Q1-E1-E8
agcgatctgcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgc

SEQ ID NO: 17731 - DNA, 373 bp, Zea mays
  Clone ID: LIB189-015-Q1-E1-F1
accagttaccactcaccagtcaccagtctccactctggagtctggaactcccctcatcctccacatctccaccgcatcggaactaggaaggcgaagccgaaggcgcggcgcggcgcggcacggatcgagcgatggcggtggcccctcctacggcggcggcgctggagcagctaagcagcagcaagatgttcgacggcttcaatctccgcttccgccaccagagcgccacccttggctgcgccatgactttctccatctacctgcccccgtccccggcgtccaaccttcccgtgctgtactggctctcgggtctcacctgcaccgacgagaatttcatcataaagtccggcgcccagcgcgccgccgctgccca

SEQ ID NO: 17732 - DNA, 446 bp, Zea mays
  Clone ID: LIB189-015-Q1-E1-F2
acggacgcgtgggcgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggcctgcagacgggtgaccccgcccgggtcaacctcgcccaaaagcctggcctgcgggcgccttcggccacatcctcggcgtcggcatcgtgct

SEQ ID NO: 17733 - DNA, 389 bp, Zea mays
  unsure at all n locations
  Clone ID: LIB189-015-Q1-E1-F3
cggtctagatatccgggtcgaccagcgtcagccgcaacagccaacttaagtgggcatttgtgaaaacgtgaaaccttctctgtggcctcttcgcgaaagctgggctggattacttntcttgctcccctttcagggttcgattgctaggctanctgcagctcaagtgcttgtctgaggctgcctcctcattggcaaccggattgcctgctgctggtggatgtggtgatcaacagtattattacagagccatgctatgtgaacattactagtagcagtgctcataaaagctacaatcccatgtccttttttttccccagtcatgtaaaacttccaaactgctccatggttcaaaactctgttcttcaatacatcatcaattatcgattaaa

SEQ ID NO: 17734 - DNA, 380 bp, Zea mays
  Clone ID: LIB189-015-Q1-E1-F4
cccacgcgtccgcagcagctccgctcgtcgatcagctctcggctgaccactcaccgccagtgggtgcctgccgaccaggtctcgccaccgccgccgccgccgcggtagagaggggagggagagggagagggagaaaaaactggcccagatcgagaggtacagcacgaataagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgccgcccgtggaccacgctgccgccgccgccgcgaggaggcgccggaggaagatggccaacagagccgcccaac

SEQ ID NO: 17735 - DNA, 378 bp, Zea mays
  Clone ID: LIB189-015-Q1-E1-F6
agcctgacagagtgctcatcggtggccgggagacccccgagggcaggaaagccgtccaggttctcaaggatgtgtatgctcactgggttcccgaggacaggatcctcaccaccaacctgtggtccgctgagctctccaagctcgccgccaatgcgttcttggcacagaggatctcctctgtcaatgccatctccgctctctgcgaggcaaccggagccaatgtctctgaggtggcttacgccgtgggcaaggacacgagaattggccccaagttcctgaacgccagtgttgggttcggtggctcatgcttccagaaggacatcctgaacctggtgtacatctgcgagtgcaacggcctgcccgaggtggccaactact

SEQ ID NO: 17736 - DNA, 231 bp, Zea mays
  Clone ID: LIB189-015-Q1-E1-F7
gtggatggataccctgtgtatagcatggcaacgcccactattgatggagcgagtgatgttttgtcgtatctgggctctaaagacacaaccggaagaaacattgcacagaaggtggtcgtcacagatcttagagaagaaatggttgtttacatcaagggattcccaattgttttgagagaactagatcaacctgttgatactttgaagcatgttggcattattggtccaatg

SEQ ID NO: 17737 - DNA, 243 bp, Zea mays
  Clone ID: LIB189-015-Q1-E1-F8
atttgtccgttcattgaacggacaaatcgactgcttggcatgtagtgatttccttatgttctcttgatagccacttggaaattaaaatacggtctttatatagccacgctggagatcacaaccggtcattgcacgacgatgctcggcaacataacggttcatcgcaggtcgatccgctggcaattgatgattagtcgcaattccgtcagctacagcctccatcaacatcgtagtcactgctgt

SEQ ID NO: 17738 - DNA, 367 bp, Zea mays
  Clone ID: LIB189-015-Q1-E1-G1
acccacgcgtccgcccacgcgtccgatgtcaccaacatttggcacattcctttgttgctcagagatcagaaggcccatgaagctattttgaaggtgttagaccttcagtgcgcgaataaagttgctcgagaaccccaattgtctgaatggactgaaagagtcagcagatgtgacagattgaaatctccggttaggattgcaatggttggaaagtatactggcctgtcagactcctacctatctgttataaaggctcttttgcatgcgtccgttgctttggacaggaaacttgtggtggactgggttccttcccgtgatcttgaagattctacagcaaaagagactcctgacgcctatgaaaaggcat

SEQ ID NO: 17739 - DNA, 339 bp, Zea mays
  Clone ID: LIB189-015-Q1-E1-G3
acccacgcgtccgcggacgcgtgggcggacgcgtgggggtgtaccccgaatgccacggggaggagttcgtggagatcggcgcgggagaccttgtcgtcttccccaagggcatgagctgcacctgggacgtcgccgaagccgtcgacaagcactacaacttcgagtagccgccgccgccgactagccctgcggcgctcgatgtagacttgctgtgctcttgtactctgaacctatgatgctccactccagagttaacataccgtgtaataaagctcccgattacgggactacaatgctgtactatctgtttcagattccgttccgttagctgtgataaga

SEQ ID NO: 17740 - DNA, 370 bp, Zea mays
  Clone ID: LIB189-015-Q1-E1-G4
aggccacaaagcttgctaccttttacaaagttgtaccatcataatataaagggggaacacattgggtgggttcagtttccgaaaaaaaatccccaagccaagccacaagtttttgattccaagttaaaaagaagaagaaaggtacctttggatttgaccaaccaagtcaagcatataatacaaactgaacttgttctatggaactctgaataaaaatccaagtctctactaacaagatctgtaaagcttatgaattaagaaacatgaaaaggcctctagctgagttggttaggtagtttgaatagcacttcccaagtcccccatgtgagcgaattttaggttggggttaaaaaatccccttgtctgtccc

SEQ ID NO: 17741 - DNA, 222 bp, Zea mays
  Clone ID: LIB189-015-Q1-E1-G6
agatcgcctatcgacttcacgtctctccgccagaccaccactaccccgtctatctctggtctggtcccaagtcccaattagtcggagcctcctgccctcctcgaccgctcaagccaagaaccagaagccatggagacggcggcgccggcgccggcgccgtgggcggaaatggagatggactgcatggtgcaagtgttcgtgcgcctcgacctcgaggacctg

SEQ ID NO: 17742 - DNA, 376 bp, Zea mays
  Clone ID: LIB189-015-Q1-E1-G7
cggacgcgtgggcggacgcgtgggtccaactcccaagcccagccgcctgcctagggttaaggtcgcccctccgccccctcgctccgctcgtgaccggcagggttcgtcgccgccgttggatatgtcgcggacgctggtgcagccggtggggcagaagcgcctcaccaacgtggccgtggtgcggctgcgcaagcacggccagcgcttcgagatcgcctgcttcccaaaaaaaggtgctctcgtggcgctcccgcgtcgagaaagacatcgacgaggtgctccagtcccacaccgtctactccaacgtctccaaaggcatcctcgccaactccaaggaactcgccaatgccttcgggcacgacgaccttacccaaat

SEQ ID NO: 17743 - DNA, 367 bp, Zea mays
  unsure at all n locations
  Clone ID: LIB189-015-Q1-E1-H2
cacccatcagacgaattttaagaaaaagaattttacattgaggacatnttatagaaaaagggtccaaattttttaatactgtgaaggaatatataataaatatttataagaactaatttaataagtaacttttgtatcacggttaaataatttttccttaattaaaaattaatttccccaaatgaaaagatttaaaaataaaatttttaatttaagtccaaaaaatatataataaaaataaaattggtaaaagccaatcaattttcctaaaaccgggtttttaaaaaattaaattaaattaaaaataaaaatttaattaattaaatttaatactaatatttattttaattaaattacctgaaggata

SEQ ID NO: 17744 - DNA, 301 bp, Zea mays
  Clone ID: LIB189-015-Q1-E1-E5
agcggacgcgtgggcgcctccgcgccccctcaccggtgcagcgcgaggaagcggggggccagaggccagccatgggcaaggaaggggccagcgacagcggcatgtcggagtcggtgattcgcaaggtcctggtctcgtacatgtacgtggcggtgtggatcttcctctccttctccgtgatcgtctacaacaagtacatcctcgaccccaagatgtacaactggcccttccccatctccctcaccatggtgcacatggccttctgctcctccctcgccgtggcgctcgtccgcgttctccg

SEQ ID NO: 17745 - DNA, 366 bp, Zea mays
  Clone ID: LIB189-015-Q1-E1-C1
tcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaa

SEQ ID NO: 17746 - DNA, 364 bp, Zea mays
  Clone ID: LIB189-015-Q1-E1-C2
acccacgcgtccgagcgagcagtcgcgagtacgctccccaaaaacctgatcgcctgcatgtaaagccctaaaatatgtataagaaaaaatgataaaataaataaatagaatatataaaagtgttttgggatcatggaacccttagagattatctagtttttttttctctatgtgcatatttaactaaatgaaaatctagtaaaactctctacaagctctaaattggagtacccttcaataataattttcttacatttgaaagtatttaaaattttaaaaaaaaataaatcttaaaatcatcaaataaataatatgaatgtaaattatttgtttgagggagttatccatttatgaattatgcatg

SEQ ID NO: 17747 - DNA, 393 bp, Zea mays
  unsure at all n locations
  Clone ID: LIB189-015-Q1-E1-C6
cccacgcgtccggggctcgcaggaggatgctgcttcaaccaagttacttgttgatatcctccttagtgagtgggaggacaggatgactcgaggcttattccgctacgatgtcactgcctgtgagaccaaggtcattcctggcaaccttgggtttgttgcacaactcaatgaagggcgccaccttaagaagcgccctactgagtttcgtgtggaccgtgtgctccagccgtttgaccctgccaagttcaatttcacaaaagttggccaggaagaggttctcttccaatttgagaatagtggtggtgatgacagctatttcctgaacaacgctccaatcattgctgttgatcgggctccaaatgttantgctatcaatgtaagcccaattgaata

SEQ ID NO: 17748 - DNA, 381 bp, Zea mays
  Clone ID: LIB189-015-Q1-E1-C7
agcggacgcgtggggtcacagtggtttcttgtttcacaccttaagcatgtacagcaaggagtgccatccaaccataagagacgaagttagcaagcactttgcaaactgcgagctacggtcgatggtgttggttgacagaagcatgcttgggtcatattcgtcaagattcaactatgctggcaagaatccaaccgggctagatgtgcctagtgatattgcagataagaagcaggttgatgaagctcagaagaactgaggcaaccttgaaagcataccgtagatgacttggattatcaaaaagccactctgacctttgcgaagcttgcttgcttgctttgaagagggcatctactacagatagagtttacacataccattgcg

SEQ ID NO: 17749 - DNA, 173 bp, Zea mays
  Clone ID: LIB189-015-Q1-E1-C8
agcacggatcgtacttgacgaggaaggagggaggagcagtgtggcttgagctctccagtgttgtacaaagacatgtttctttctgaacccaaaagggagaaagatgtatgaagcgtgtatataagatcttagctagcagtttgttttcatttgtatgagcgatcgaaggctgt

SEQ ID NO: 17750 - DNA, 384 bp, Zea mays
  Clone ID: LIB189-015-Q1-E1-D1
cccacgcgtccgcccacgcgtccgcaataatgattgtagatagatatgttattattgcattgcagttcatctatatcgatcactccagtgcttttgtttcattgtatgcttgcagccttgcacttcaatttttgcagtccaaagttctattctttacttggatatattactctcttaaaacatcaattcattgttttgcattcctttgtttatttgtagatatgaacaagtcctttgttctttaatgggtttgattttgctggcttgaactctttaggtttttgaactaatgataacatgtgtagacctgaaaattcgtagactattgtactgaaccttctgatgtttgttcctttcttcatgttgtaggttgctgataatttt

SEQ ID NO: 17751 - DNA, 377 bp, Zea mays
  unsure at all n locations
  Clone ID: LIB189-015-Q1-E1-D4
ctctccatgggcgaagacgagaccccgcaggtccagcctccgccgccgcctacccaagggcgcttcgaaatcgttatcaacaacgacaacatccgaacgctcgacctatcgccagtcgaagcagcactcggcgacttgagctccttgacaccagctgcttcaagaaccctgctggaccagaccgtcgggttcaccatcagctacgagagggaggacgagtacgacacgcgggagctgtcggagttccccgacatacggctgtggttcgtgaggctcgacgccgcgtacccttggttcccggtcgtgctcgactggagagccggcgagcttgccagatacgccgcgatgctcgtcnctcaccagatgagcatgccgat

SEQ ID NO: 17752 - DNA, 272 bp, Zea mays
  Clone ID: LIB189-015-Q1-E1-D5
cttccagtcataatttttgagccaatgacaatgcttcagaaaatggctgagttgatggaatactgtgagttgttagacaaagcagatgaatgtgaggatccatacatgcgtatggtttatgcttctacatgggctgtttcggtatacttcgcgtatcagcgcacatggaagccttttaatccgatccttggagagacttatgagatggttaaccaccagggcattacatttcttgccgagcaggtaagccatcatcccccaatgggtgctgc

SEQ ID NO: 17753 - DNA, 360 bp, Zea mays
  Clone ID: LIB189-015-Q1-E1-D6
agcccacgcgtccgcgaagcatggcgtccgtcaccgcccgcgccccggtcgcggcccttcgcccgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgccgc

SEQ ID NO: 17754 - DNA, 368 bp, Zea mays
  Clone ID: LIB189-015-Q1-E1-D7
gcagcagaggcagcgacacgatcgcgagcgcacgcacgtaagcacgttgtcggaagctcaagttagaagaagcaccagtgactgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcg

SEQ ID NO: 17755 - DNA, 385 bp, Zea mays
  Clone ID: LIB189-015-Q1-E1-D8
cccacgcgtccgtgaaaactattatttctcgtcacctcctgtcgtagtaagtgtttcccgtcacctctctgtcgtaggaagaatttactgccctattactcatcttattaactctaacaaaaaatctcactttaagataggtacatatttcaatcttaattctagatttatgtttcgttctgtacatagtggttccattttttctccccttgctctcgtcatatgaatatttttactccattggttgttttatttactttaaaagcgtgccataaaatatgtgtgtttcactattaaaaaatatatcccttcacttatgtattagtgttagaattacaattattttttcttttcccaaaagtttagaaatgttttaagcgaacta

SEQ ID NO: 17756 - DNA, 399 bp, Zea mays
  Clone ID: LIB189-015-Q1-E1-E3
ggtccagaaatccgggccgaccacgcgtcagagagcgtgtgttcgtttcgaggacgcacacacagacgccatggaggttacacaaaaccacaccctgaccgtgaccggttgggcggccatgaacgagtccgcccgcaaggtggagcccttcgtcttcaagagaagggagaacggccctgacgacgtgacgatcaaggtgcagtactgcggcatgtgccacacggacctgcacttcatcaacaacgactggggcatcaccacgtacccgctggtcccggggcacgagatcacgggcgtggtcaccaaggccgggcgcaacgtgacgggcttccgcgtcggcgaccgcgtcggcgtgggctgcatcgccgcctcctgcctggactgcgaccgctgccgccg

SEQ ID NO: 17757 - DNA, 383 bp, Zea mays
  Clone ID: LIB189-015-Q1-E1-E4
cccacgcgtccgggtcactgtgtgacctgtacgagacccttgccatcacccagagtgtcatctttgtcaacacccgccgcaaggtggactggctcactgacaagatgaggagcagggaccacactgtttctgccactcatggtgacatggaccagaacactagagacatcatcatgagggagttccggtctggctcctcccgtgtgctcatcaccaccgacctgcttgctcgtggtattgatgttcagcaggtgtccctggtcatcaactatgatctccccacccagccagagaattacctgcatcgcattggtcgtagtggtcgtttcggtaggaagggtgttgccatcaactttgtgacccgcgacgacgagcggatgctg

SEQ ID NO: 17758 - DNA, 388 bp, Zea mays
  Clone ID: LIB189-015-Q1-E1-B8
aggagaaacccctaggttccgacggtgaagaaccgaagcctgtgtgacgattattaagtgttcggcagaaggaccgaacccaaaaccttcgctgtgttcgtagacgtcgcttcgagtttagtcatggttcgttaattgatcatgtgatgcggacgacaagagccgagttgatcccaaaatgatgctggtgaacgaacctgaagcttggatgatctggtcaagtaccaggatgagagatgctccccaagaggacgtcatctaacaacactgacttatgttatcccaggttataattttgttctgttgtggatggtgctaagtgccggtgggctcggccttcttataaaagtatatcccatctttagcttctttattgaggactgtcact

SEQ ID NO: 17759 - DNA, 414 bp, Zea mays
  Clone ID: LIB189-031-Q1-E1-D8
agcggacgcgtgggcgacgccggcatgctggcgttcgacaagatggggagctacggctacaacagcaacaacggcggcggtaataccaacaacaacagcaacggcgtggaggtgaagagctacttcaacaagtccgccgggagggcggcgaacaacaacaacaacaacagcagccacgccggcggcggcaacaagaagggcggcgccggggagtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctcaaggaggaagctgtccgggctgccgtccaggtacaggga

SEQ ID NO: 17760 - DNA, 369 bp, Zea mays
  Clone ID: LIB189-031-Q1-E1-D9
aggagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcagggcacaacagctgcagcaactcgtgctaccagtgatcagcca

SEQ ID NO: 17761 - DNA, 360 bp, Zea mays
  Clone ID: LIB189-031-Q1-E1-E11
cctctccccaacccgtcgagagtcgagaccatccttcccttcttccctcctcgccagaggagagtctcgctagctagggtttccaccaatggcggcgcccaccacctcccgccgcggccccggcggcgcgcgcaacatggacgatgaaaacctcaccttcgagacctccccgggggtcgaggtcgtcagcagcttcgaccagatgggcatcaaggacgacctcctccgcggcatctacggctacggcttcgaaaagccctccgccatccagcagcgcccccgtcctcgccatcatcaacggccgcgacgtcatcgcgcaagcccagtccggcaccggcaagacatccatgatctccctca

SEQ ID NO: 17762 - DNA, 348 bp, Zea mays
  Clone ID: LIB189-031-Q1-E1-E12
cccacgcgtccggctcaaggaggacctcgacaagatgcttgagcgcgccaggctagccaacgagcagcgctacattgacgatgatgaatagatgcccagatttatttgccagcgacctgtattttttttgcaacatgttgtcagtacacatggccaggactgatgatcccccatcgtcttagttctctcagctttccgcatttcaactgtgatcttgtaataagatgtcggatctcatggattaccaatgtaatacaccaattatgggttcttgatctgatggttggctttctctgataaaaaaaaacaataaacaagcctaatcagaaaaataaaaaaaaacccaaa

SEQ ID NO: 17763 - DNA, 353 bp, Zea mays
  Clone ID: LIB189-031-Q1-E1-E3
acgcgtcaacaggattaacgccgaggctgaggccgagggacaacccaccgtgacatgcgtcgtcggcgacagcaccatgaccttcgcgctccgcgccgcgcgagagctcggcctccgctgcgctacactctggaccgccagcgcctgcggcttcaccggctacttcactacggcaacctcgtcaaccgtggaagggtccccctcaagaacgaggagcagctcacggacgggtacctagacaccatcgtcgactggatcccgggcgcgcccaaggacctgcggctccgggacttcccgagcttcgtgcgcaccacggatccgaacgacgtcatgctcaacttcttcatccacga

SEQ ID NO: 17764 - DNA, 409 bp, Zea mays
  Clone ID: LIB189-031-Q1-E1-E5
agcccacgcgtccggaggaacacaagtgaagatgagctttgcactgttcaatgcttctgcttggaagaaggatgctcttgtggccgcagttcgttgttatctggaaagtggcttgctactgagcattctcttactacatgatgtaaattgtgaatctccatcaaggctggcttatggctgaagagtcagtatcatagtttcctttgatgggagaggacagcaaagccagctaatctcgctatccaagaaatcggctagtagttttttcccttttgaaccttgtcacgatgccttgtcttctggataaagttcacgcaggtttcaaataagaaatcacatggactatcagacttgtatggaatatggatgctgtacaaagatttctaatgtacattagtctaactttttt

SEQ ID NO: 17765 - DNA, 417 bp, Zea mays
  Clone ID: LIB189-031-Q1-E1-E6
agccaatcctccccctccagctggcggaacttgtcctgccagtcgcccttggtctggcggatcggatcggcaagggccggggtggaggcaaggagcagcgcgaccagcgcgatacgagatgcggcggacaagaagcgagcctttcgaacggacggacggatgatcgttgccggtgatacgatgcgcgtcaaccgctggccatgcgaatatcggatatattgtgacacggcggaccgatggttgcggtccgacgcggagtgcggcaagcaatatgtcggaatagaatgggtacgtacacaagctatgctgttgaaccggcggacgatgatcggcgcactcgcttccctgccgatcgcgtcgcgggcaacggcccggccccgttgcggatccgttgctcttcgcctatttcggaaccgg

SEQ ID NO: 17766 - DNA, 369 bp, Zea mays
  Clone ID: LIB189-031-Q1-E1-E9
agggaatgcctgagggaggcaaagagtaacgggattatcaatggtggcaatgtggagagcgagctctccaagcggtggagagcacagaggatggatgagcttgatgtcttgagccggaggctgaggttgctcgtcgagtatgctgcagcggctgggcattgaagcttagattttggtggttttggtgatgtgcctcccaccatttgcccctttgttgtgtatagaacctacgttattgtgctatgctttgtaatgtcttcctcagctggacccttagaaagcctactatatttgcctatgtacccctcgtgtttaatagtttgagcagcataataatctatggtgttagcactgttatttgcatgggtt

SEQ ID NO: 17767 - DNA, 359 bp, Zea mays
  Clone ID: LIB189-031-Q1-E1-F10
agcgccgacccatccctcaccaagattttctcggcttctaggatcgacattcctagcgcgtggcagatgcctcagggtggtatagatgcaggggaagaaccaagggcggctgccttcagggaattgagagaagagactggtgtcacatccgcagagatcgtggctgaggctcccgtctggttaacatatgatttcccgccagatgtcagaaccaaactgaatgccaggtggggaaccgattggaaaggccaagctcaaaaatggtttttatttaggcttactggaaatgacgatgagattaaccttaatggtgatggatctgagaagccagagtttggtgaatggacatggatgacacc

SEQ ID NO: 17768 - DNA, 344 bp, Zea mays
  Clone ID: LIB189-031-Q1-E1-F12
ggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtgg

SEQ ID NO: 17769 - DNA, 338 bp, Zea mays
  Clone ID: LIB189-031-Q1-E1-C10
cggacgcgtgggcggacgcgtgggctttaggaacattttcggggatagggactttggaggacgagatgttaaggttgcactcgaactatcatttgtggaagcagttcaaggttgcagcaaaacggtcaccttccaaacgtctgtaacatgtgaaatctgtggtggagccggtgtgcctcctggaaccacacctgaaacatgtctatcttgcaggggttcaggatttatattcatgcaaaccgggccattcaggatgcaatcaacctgcacaaaatgtggtggttctgggaaaactgtgaaggaattctgcaaggcatgcagaggaaacaaagttgtgc

SEQ ID NO: 17770 - DNA, 334 bp, Zea mays
  Clone ID: LIB189-031-Q1-E1-C11
agcccacgcgtccgtctcttctctccgtccaacgacggcgcgattcagatccaggcatacaggccatccttccgccgccgcggactgcacctaatcttccttctccagcagccgggcgttcccgtcgtcctcgatcgtcccctggactggatcgcaacggagatccagctggacctgcggtggtcccttccttttctcgatagcataatgagctcgccagtggagaggtgattcgtcaggctggtatcaagttcctagtccatggtgcctggatgagcagtagagatgctactggccgtggaaggaggagggttcttctcgtcttcagctacag

SEQ ID NO: 17771 - DNA, 356 bp, Zea mays
  Clone ID: LIB189-031-Q1-E1-C12
agcggacgcgtgggcaccaagcgaagcgcactagcaacgacctaacaccaatggctaccaagatattagccctccttgcgcttcttgcccttttagtgagcgcaacaaatgcgttcattattccacagtgctcacttgctcctagtgccattattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccaccta

SEQ ID NO: 17772 - DNA, 161 bp, Zea mays
  Clone ID: LIB189-031-Q1-E1-C5
agaaaaaaaataaaaaaaaaaaaaaaaaaaaaaaaaaaaaaaaaaaaaaaaaaaaagaaaaaaaataataaaagtcaaaggccaatcttactcttaatcttaaattctccatatgcctgcattagaccccattgttcttttactgcgtttttctattaccc

SEQ ID NO: 17773 - DNA, 253 bp, Zea mays
  Clone ID: LIB189-031-Q1-E1-C6
cccacgcgtccgcggacgcgtgggcggacgcgtggggtgcggccggcctcgacctcgatctcgaagagaggatgtgatcaacctgagttacggataagggggaacaacccatccacacgcacttctcctccgacccaacattatttgttgttaactagtttttcttttctttatctctttctttcttttgcactctgtacgtgtaatgtaatgcagtgtaatttaattagtgagagaagcatgacgccctact

SEQ ID NO: 17774 - DNA, 412 bp, Zea mays
  Clone ID: LIB189-031-Q1-E1-C7
agcggacgcgtggggtcttgcatcaccacgagcgtgggctctctcctttctcgacgacgactgggccaccgtcgctgccgcctgccgcctgccgccctgcgccaggtgccaagcagccaggtgttcttggggcccttcgccggcgacgagcaccaccagctgaaagatggcgaggataccgtctctgaagagcctcaatgcgtttccacatgcggaagagcacttgttgaagaagacttactctggcgctgttgtgacaatttttgggctacttataatgattacactgtttgtgcatgagctgcagttttatcttaccacctacacggtgcatcagatgtctgtagatctgaaacgaggagaaactctgccaatccatatcaatatgtcatttccttctttgccatgtgaa

SEQ ID NO: 17775 - DNA, 418 bp, Zea mays
  Clone ID: LIB189-031-Q1-E1-C8
aggctcgagatccccgagggggtcaaggtcaccatcaagaccaggaacgttgtcgttgagggtccccgtggcactctcgagaagtcgctcggtcacttggctgtctccttcacccaccccaagaagaacctcatcaagatcgagctccaccacggctcccgcaagagcgtcgctaccctccgcaccgtccgcaccctcatcaacaacttgatcatcggtgtcacaaagggctacctgtacaagatgcgttacgtctacgcccatttccccatcaacgtcaacgttgagaagaacggcgagaccgatcagttcgaggtcgagatcaggaacttcattggcgataagcttgtgcgcagggtggtcatgaaggccggtgtccaacttgaaggctgctatgaaccagagggatgagctccac

SEQ ID NO: 17776 - DNA, 259 bp, Zea mays
  Clone ID: LIB189-031-Q1-E1-D10
agaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaagaaaaaaaaaaaaaaaaaaaaaaaaaaaaaaaataaaaaaagggggggccgctcaaaaggttcaatctttttttccgtttcaatgcaagttaaaaacttttcaaaattgccccaaaattcaattccaggggcgttcttttaaaaacttggat

SEQ ID NO: 17777 - DNA, 331 bp, Zea mays
  Clone ID: LIB189-031-Q1-E1-D11
aggcggcggggtcgccgacgcccgacgacgaggacgaaacgggtgggaggaccgcgaggagcgctctacaattcgaaagccgcggcggagcgaattcaggggacgggaagttgaattctatcactgacccccaaagctccctagtccctacacaactccgtctggtacggaccatgccatttgactcctcccgatctgtaagggcgacacgcacctttgcctcgccttcaacttggctgattcagctggtttagggcggctgaaatttggtttactgcaccaacgtggtagggggaatctggatgattaatttattctgctatttcagctt

SEQ ID NO: 17778 - DNA, 327 bp, Zea mays
  Clone ID: LIB189-031-Q1-E1-D12
gaactattgaactgggtaaggtacaagaaccatgttcagtggactccatggagccatgcaacacagttccatctggagtttcctgggaggtgaggccagatgtagacgctagcgaggagaagaatgaaaaacaagagtcatgtagcaccacagtggacgaagcgcacgaacaagggaaaactgagggacagattgaaattcaggtagcatcatcgatggatatgataagtgatgaagcttttacagctgacaaccaggagcatggaattggagaatcaaatgttacttcagtggaacaagtgactgaagaagagaaaccagcatctg

SEQ ID NO: 17779 - DNA, 360 bp, Zea mays
  Clone ID: LIB189-031-Q1-E1-B8
agcggacgcgtgggaccgggaggtgctgatgccgatcccaaagcctacggggttcactggtgctgatccgtacaagataacatttcaaattggacatgaaaagttccatgttccttggctttatgttataaatcgcaaaacctctgaagttccactgatcgatttccatttgaagtactctggaaatgatatacttggggtgacagctaaagttgtggacatgcctcaccactacgtggaagttcatcctgacataaagaagaatttctgggatccacagaattggccaaaatacgttcttgttagatatacatgggaggagcaatcagagatagatgttactggaggattttatgtgtt

SEQ ID NO: 17780 - DNA, 399 bp, Zea mays
  unsure at all n locations
  Clone ID: LIB189-031-Q1-E1-A6
aggtggatgggctgctctatctcaaatgataccgagaggagtccaaacagaatactaccatacaaacatttcttaatgcttgtgtgtgagtatatgcacaactctgtactcttgtatcattagtaaaactgtgtttttttaaatatccatgctgaagggttctaacataatcatgttaagtttttatgaaaaaaatttgcttaaactatgactgttccaatcagttttttacctaaagaaggtattcacaagaatcttggcatttaacagacctgcacaccttgactttatgaaaagggacatgtcttcaggaacacagtactgttttaattccaggtgaacatagccgaggaagctgtcangatgctaactgggatcacctcatgctacgaccgcttt

SEQ ID NO: 17781 - DNA, 409 bp, Zea mays
  unsure at all n locations
  Clone ID: LIB189-031-Q1-E1-A7
agcccacgcgtccgcccacgcgtccgcccacgcgtccggaatgctcgtggccagcaaggctcatatccaattaagctgttctacacttcaaacatgcccatcatccttcactctgcgctgattaccaacctctattttatatcccagcttctctacaggaagtacagtggaaacttccttgttaaccttcttgggaagtggaaggagtctgaatactctggccattctattcctgttggtggtcttgcttactatgtaactgccccatcaagtttggctgatgtccttgcaaatccattccatgcactgttttatgtggtcttcatgctgtcagcctgtgctctgttctcaaagacatggattgaanttttcgggttcatcagcaaaggatgttgctaagcagctcaag

SEQ ID NO: 17782 - DNA, 412 bp, Zea mays
  Clone ID: LIB189-031-Q1-E1-A8
gcagaaacgatacggtgcagaacaatacccaatgttcttgcaaatcttgagcaggctcaggaccgacagaacagaccatcagagagccctgttacaccatctaggcagctcttggctcctaatgtacatttctatgctggagagtgggatgaactcccaacaattctctcagttgtgcagccacctgcagcaccaacaaacctcagcttctctgaggatgattttatggatggctgcagtagccatgatggaagcagtgtagttggtcatgactactgccccaggagatctaggaagctttctggtagccgtgcatgggagagagctagtgagaccgaccaggcagatagtggctatgatgtgatcttgatttctgatgtcccctaggcagctaactccctgaagaagctct

SEQ ID NO: 17783 - DNA, 363 bp, Zea mays
  Clone ID: LIB189-031-Q1-E1-A9
gggtcgactcaagcgtcagcataccagacgaaaccagaccaatggacctgctcctaccaggctcatcgtcccacgggctggcctccacgccggagctaatctccacgaggacttgccggccggccgtcttggataagggcgccgtccagaagaggagcctgctgctggcgacgggctccgacacgaggggagtcgctcaggttaggtccagcgggatcgagaggaacagggtgggtctgggatgtgaagccgtcaccgggcaagtcagtgaggtcaacacggacaccttctggcctatcgtcgatgccaccggcgactaggtcgtcgtcctccaaatgtgcaccgaatgtgtgcgggccttgc

SEQ ID NO: 17784 - DNA, 228 bp, Zea mays
  Clone ID: LIB189-031-Q1-E1-B12
agatttggagcgctgccctctgtgccagcagaacataaccacgaggatcaggctctactgatttgatcaggctatgaattagaaaaatcttggaacaacagactcccgggcaagatgttcagaaccagctttgtttgtaccgtgcttcattttgtaattggtgtcacttttctcggtagttatgccaaaggaaagcgcaccagaaaataatgtacatatttatcttcc

SEQ ID NO: 17785 - DNA, 412 bp, Zea mays
  Clone ID: LIB189-031-Q1-E1-B5
agcggacgcgtgggggaggccaggagggtgagggggagatggcggagaacccgcagctgtttgggaacgggatgccggtgccgttctacggcgagatgttcgtcctcgtccgggacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggtgagaagttcaatcagcccatatttcactgcaacaacatctctggattcgttgaaccagtcgttccagacaatcagaacagggccctgtactcaactcacaccttcaagatcttgttcaaggaaggcggctgtggtac

SEQ ID NO: 17786 - DNA, 389 bp, Zea mays
  unsure at all n locations
  Clone ID: LIB189-031-Q1-E1-B6
agccctcctcgcagctggaaaagtatggagaaggcctgtggatctgcgccgcgcagctggctgtagtatttgccagaagttcgtgacctgctcacagctcactccctccatctgggtctcctctgctcctgctccaagtgtctcccgtgtcctctggtcatgcgtggtatggtatgataacatgaactgtgtgtgtactggttggtcaggactcgggacttgtttggtactgtggatattgtggttgtttgtgctcttgtagcataggtctggtcgaacatacctactagtaacagtcgtcgtgtgcggtgtgtgattgaattgtaaatgaaaggaacgcctcgtcatgatacanataaaaaatagtacctttcctcgcggcgcccgcc

SEQ ID NO: 17787 - DNA, 397 bp, Zea mays
  Clone ID: LIB189-030-Q1-E1-H8
cacgcgtccgcggacgcgtgggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagacccatccattcgtccgtccgtccgtccgtccgtcg

SEQ ID NO: 17788 - DNA, 411 bp, Zea mays
  Clone ID: LIB189-014-Q1-E1-H5
cccacgcgtccgcagcaggccattcttctcgccttactccctcacagaacccagtaaaatattgctagtcccgccgtcgagatggccccacgccgcctgctcgtcctcgccgtcgtcgccctcgcggccaccgccgccgcggccaactccggcttcgcggactccaacccgatccgccccgtcaccgaccgcgcggcctccgcgctcgagtccacggtcttcgccgcgctcggccgcacccgcgacgcgctccgcttcgcacgctttgctgtgaggtacggcaagagctacgagagcgcggcggaggtccacaagcggtttaggatcttctccgagagtctccagctcgtccgctccaccaatcggaaaggcctctcctaccgcctcggcatcaaccgcttcgcggacatg

SEQ ID NO: 17789 - DNA, 375 bp, Zea mays
  Clone ID: LIB189-014-Q1-E1-H6
acccacgcgtccggcacacctggtggtgagcttcagtttcaaacagaggttgagatgattagcatggcagtgcacaggaaccttctccgacttcgtggtttctgcatgacacctactgaacggttgctggtctacccatacatggctaatggcagtgtggcatcacgtttacgagagcgccaggcatctgaaccacctcttaaatgggaaacaagaagacggattgcactgggatctgcaagaggtctttcttacttgcatgatcactgcgatcctaagatcatccatcgggatgtcaaagctgcaaatattcttttggatgaggagtttgaggcagtcgtaggtgatttcgggcttgccaagcttatggactac

SEQ ID NO: 17790 - DNA, 299 bp, Zea mays
  Clone ID: LIB189-014-Q1-E1-H7
acccacgcgtccgaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaataaaaaaaaaataaaaaaaaaaaaaaaagaaaaagggtaaaaaaatttaattttttaggtaggtgggtttacaaaatagtttttggttttattttggttttaattaaattttaaatcctttggattgtacttcggatttgctagtaagtggtaattatttttaaaaattttgcgtattgggaattaatcattt

SEQ ID NO: 17791 - DNA, 377 bp, Zea mays
  unsure at all n locations
  Clone ID: LIB189-014-Q1-E1-H8
cgtccacacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaccaaaggtagctagctagccgcgactcgttggctagacgattcaagcagcagcgcaagatggtggcgccggtggtgattgcgtcggccgggctgggcatgctggccggcgtggcgatggccaaccggtccctcgggaacgggctcccggcggcctccaagtgggacgcgcgcccgcgctgcgccacgtgcggcggctccggccgcgtggagtgcatctgcanacgctggt

SEQ ID NO: 17792 - DNA, 370 bp, Zea mays
  Clone ID: LIB189-014-Q1-E1-H9
gtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacggtcagcagcgcggcgtggcgctcctgagcgagaccatg

SEQ ID NO: 17793 - DNA, 402 bp, Zea mays
  Clone ID: LIB189-015-Q1-E1-B1
gacccacgcgtcagcccacgcgtccgcggacgcgtggggggctggctatggaggcgttcgcggaggcagccgggccggagtgcatcgtgcccggacagcaagcgcctctaaggcttatggggctcaaggtctggcccgtttgatatagatatgaagttcctagagccatttggacgggaactacattcaatgaaaaaattcatggacaaatcgtgcagtgttatggactcatctatggcaaacaagtaggcacatggcacatcagttccgcccaatacagctgttgttgtatccacctgcttcctgaagttacaagacctgaaaaatagaagagacatttggagagaagccacattcttttgcgtatcttgctcaccgtcacctgacgaacaaaatatgaca

SEQ ID NO: 17794 - DNA, 385 bp, Zea mays
  Clone ID: LIB189-015-Q1-E1-B2
gtcagtcagcttcagcaccacgagcacgatggccctcgcgctcgccacgaccccactcgcgcatctcgcccttgccccgccctcgatcttcggctcccaatcctcgctgctgctgctcccgcgccgcgcgtcgcccgcccccgtctccctctctcaccgccgcatcatcgcggccgtcgcgaccaaggaacccgagctcggcggccgcggatcgggggccggcgacggtgccggagggagcggcggcggcagcgacccgaggggaggagggcaggaaggagacggggaggaagagaagatggggcagggcctgtccatgtcgcagaaactcaccctcgcctacgccgcgctcgtcggagctggtggtgtaatgggatatatgaag

SEQ ID NO: 17795 - DNA, 453 bp, Zea mays
  Clone ID: LIB189-015-Q1-E1-B3
cccgggccgaaccaagccttcaggtaatttggaataaggcagataaatttggcagcaggccaaataaggggtctttgcaatttcaacaaaaccaaattcccaaaattggttccaaaaccaggaggtcctaaaccaaccctaaaaatgccatggaactaaaccttacctgggaaaaagctcaaaatttgttgccccctgctcccactgcaaaaccaactgttgtgatgattgaggactatgaatttgaagaatatgatgaaccccctgtctttgcaaagagatcaatttttaccatccgtgcaacaagggaacaagaccagtggattcaatgtgacgagtgctcaaaatggcgccggttgcctcttaatgttattgttgcaaccaaatggacatgcaacgacaactcatgggaccaaaaatcctgctcctgctctgcccctgaaaatttaaccc

SEQ ID NO: 17796 - DNA, 368 bp, Zea mays
  Clone ID: LIB189-015-Q1-E1-B5
agcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcat

SEQ ID NO: 17797 - DNA, 359 bp, Zea mays
  Clone ID: LIB189-015-Q1-E1-B6
aggaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcgcgcggcggccg

SEQ ID NO: 17798 - DNA, 385 bp, Zea mays
  Clone ID: LIB189-014-Q1-E1-H4
ccctcgaggagcttacactggattttaatcagctcaaagccctcccaaaacccattgggaatttggaaaacctgaaaatcctgactttacactacaacagaatcaaaggcctgcctacaacaattggccatcttaccaggttgagggagctggatgtcagtttcaacgaagttgagactatacctgagaacatttgctttgcagccagccttgtgaagttgaatgtcagcaggaactttgccgacttaagagccctgccaaaatcaataggggaacttgagatgctagaggagctggacatcagtagcaaccagatacgagtgcttccagactcttttgggcatctctcaaagctacgtgtgtttcatgctgatgaaactccact

SEQ ID NO: 17799 - DNA, 364 bp, Zea mays
  Clone ID: LIB189-015-Q1-E1-B7
agctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggacgtggcggcggcggacgccggcggtgacagccatggtcagctgctgctcgtcatggtggagcacgccatctggtgagtgctattcaacatgctgcagtcgg

SEQ ID NO: 17800 - DNA, 356 bp, Zea mays
  Clone ID: LIB189-014-Q1-E1-F9
accacgcgtccggatctatattcacttaaccttagcaaacttgatgagtggaagtgtatcatatcggcctcagaatctgaatggttagaaatttctgaggaagaggatgatgatgatgatgatgatgagactgatgatgatgaaaatgaagagggggatgctagccagacagatgaagatgaagaagagtctgatgaagatgctgcaaagaacgtgtccagtgctgtgtctctgctgaagggtgaaagtaagaccatgcgtataaaagagaagcgtgctcggatagaacagatcagggtcatccttggcctttctgattctcaaatgactccattgcctggagaatcactgagaga

SEQ ID NO: 17801 - DNA, 402 bp, Zea mays
  Clone ID: LIB189-014-Q1-E1-G1
caacggctttggccggtccctgggaatccagaaaaagggcccaacaaccttaaccttgaacaataattttgctgcaaggacgaaaccatccggcgagtttgtgagcaagtataagggtaactacacatttaccggtgggaaggcagttgggtacaggaatctctttggaatcccgtggcaggcgttcatggccgatgacagcctcttcttcatcgacgggatgctgcatctgagagctgagcttacgataaagcaacctacgtagatgtgctgccgtcgggttaagtgtgtccagtcatgggtgatgtggaaaatgctgtgtgctgcagatatcctttttgttttttttccttttgttcacgcaccttaatccttacattaatagacagtttggtgaatgac

SEQ ID NO: 17802 - DNA, 435 bp, Zea mays
  Clone ID: LIB189-014-Q1-E1-G10
agcggctgttccacgtcgaaagcctcgagaagaccgcccaggatgactttcagaagctcgcctctgccgtgtaccttcaagtcagcacgatcagtcaggcccttatcttcgtgacgcggtcgcgcagctggtcgtttgtggagcgtcctgggttcttgctggtctttgctttcttggtggctcagctgatcgccactctgatcgctgtatatgccaactgggcgttcgctgcgatcaagggcattggatggggctgggccggtgtcatctggctctacaacatcgtcttctacttcccgctggacatcatcaagttcctcatccgctatgcgctgagtgggagggcatggaacctcgtccttgagcagaggatcgcgttcacgagcaagaagaatttcggcacggaagaaagggagcgcaagtgggcgcatgccc

SEQ ID NO: 17803 - DNA, 392 bp, Zea mays
  Clone ID: LIB189-014-Q1-E1-G11
aacacgcgtccgaaaaaacacccgggaaatccaagcagctgttgcaaccggttccttcgaggagaacgtgagaaagaagcatgaggccccaggtgctgctcgtcgcactggccgtcttcgccgtcctcgtagctctgccactgggcaaaggtgaggcttggacctttcgtttaatttctccatcgccagaaccacttgaaacgacgggggtcggtcggttcggcggcctggtctttggttaccgcagcgcacgaggaggaggatgaggaagggcttgaactcgaagccagcaggatgcggtggccgtgctgcgaccagtgcggcatttgcaccaggtcgcagccgccgatatgcgagtgcagggacacgtcgacgaccggctgccacccggc

SEQ ID NO: 17804 - DNA, 446 bp, Zea mays
  Clone ID: LIB189-014-Q1-E1-G3
gggccaagcccgccttcgaccctaaaaccaagccggcggttaagaagaaggaaagaagaagaagaagaatggctccttcggcttagcccccagggccaaaccggtgattccttcccaaggtgtacccgcggtccttgccaatggccgtggccctgggtatctgctcgtacaagcttgtgcgcaacatcacgggcaaccccgaggtgcgggtgaccaaggagaagaaggcggccggcgtcctggacaaccacgacgagggcgagaggtacgccatgcacggcctcaggaagttcgtccgcgggaagaagcccgagatcatggcttccatcaactccttcttcgccgaccctcccaaggacgattaagctagattccgtcatggatggatgagtatgttttaccaatcattaactgccgggggcgccccttgattcgtagccatcgtc

SEQ ID NO: 17805 - DNA, 421 bp, Zea mays
  Clone ID: LIB189-014-Q1-E1-G5
acggacgcgtgggcggacgcgtgggctgttaaccgatggatttggtcgtcgaaagcgtcgttcatgggcgcttccccgtcaggccatcaaggtttcctcttctgcccggctcgttgccctccactaccgtggcactgagtgctgccttttccggatgtccatgcccacccattgttcgtcggaatgccccagcggtggtgccatttgccaagaagaagaggaatgaatatatcgaagatccgccagatgaggaggtcgcagatgatttcaccgacgagttggaggaggacttcgacgacgccaaagaagacgaaggcgatgtaatggatgatgacgaagagtatgaggacgactatgactttgaagatgattttgagagtgatgatgaacaggatctttatgctggagatggaagtgctgg

SEQ ID NO: 17806 - DNA, 395 bp, Zea mays
  Clone ID: LIB189-014-Q1-E1-G7
aaatactgttttttatttggtttccatttttcacctaagatgtggtttccattgcatattttcctgtgcacataagtgtaaatgttagttgaatctcgcatggtttttgaggcgtcgcctaagcgttgaggcataccctagatgctgcaggacgccacagggttttagttatccaggcatacccccagcgcctcaggatgccgcaacgcctaaaaaaccaaggaatcgcagcagcttgggctgaaaatttatatttgtgcttaggatgatgcatctcggataattggtgctactgacagtgactcaagaaaccgaactggtcctactcaaaaggccatgtcattgccttcttcgcctcatgaatataggggtcaagatacccaaaaaggtgatga

SEQ ID NO: 17807 - DNA, 431 bp, Zea mays
  Clone ID: LIB189-014-Q1-E1-H10
accacgcgtccgattttctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacattggatggttcggtgttttgatgatccctaccttattgaccgcaacttccgtatttattatcgccttcatcgctgctcctccagtagatattgatggtattcgtgagcctgtttctggttctttactttatggaaacaatattatctctggtgctattattcctacttctgcggcgatcggattgcatttttacccaatttgggaagctgcatctgttgatgaatggttatacaatggcggtccttatgagctaattgttctacac

SEQ ID NO: 17808 - DNA, 408 bp, Zea mays
  Clone ID: LIB189-014-Q1-E1-H11
gaagatctacaactacttcccatatccatactttgtgtccttgatccatctagtagtgggtgtcgtatactgcctcatcagctggagtgtcggtctccccaagcgagcgcctatcaatggcacgctcctcaagcttctctttccagtcgccctgtgccatggtattggtcacatcactagcaatgtgtccttcgctgctgttgcagtctcatttgctcacactatcaaagctctggagcccttcttcagcgcagcggctactcagtttatccttggacagcaagttcccttctctctgtggctttctcttgcccctgtggtcaatggtgtttcaatggcatcccttactgagctttcattcaactggactggcttcatcaatgccatgatatcaaacatctcattcac

SEQ ID NO: 17809 - DNA, 369 bp, Zea mays
  Clone ID: LIB189-014-Q1-E1-H12
accacgagtccggattatcaaagatcacatcattggggacagcacatgaccaaacttcaatgagtggctagtatgagtttagtcggttccagattataccatgccgacttctactgtacctcgtgaatcgtgatgtctattgggcacttgttgctgacagaactgtgcacaatgttgatccaatttgatggatggtggtggttctgttatttactagtcggtcaaaacactaaacggtggccatcatggctgtgtgatgtatcataactgttcagtaaatttgtgttcttctgcccggagttctgctcgatgctattgcgggcggcccgaggtgcttgctctactgtgaatgaatgaagtttgtcacgc

SEQ ID NO: 17810 - DNA, 383 bp, Zea mays
  Clone ID: LIB189-014-Q1-E1-H2
cggcccacgcgtcagcggacgcttgggcccaggattatcatggggacacttatcatttgattctcaagaactgcagtcatttcacaccagatgtctgcgagcgtttgaccgggaagccagtacctgaatgggtgaagcgactcgccagattaggttccttctgcaattgtgtattgcctgacagcatcaaggtttcaccagtcagagatgtaaatgcacatccagatttttctgatgatggcatggggtccaatgcctcgatccttgagggaagtgatgacgatgatttagaccaactcctgagaacacctaacagcgacattgtgtcttcaatggacaaggcattaactcctggcaaggatagtcgcaaactggtcaccctt

SEQ ID NO: 17811 - DNA, 394 bp, Zea mays
  Clone ID: LIB189-014-Q1-E1-H3
aacaaaaagggcccaaccttcaacggcttcacccccaagtccatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtccgttcggccgccctcct

SEQ ID NO: 17812 - DNA, 370 bp, Zea mays
  Clone ID: LIB189-014-Q1-E1-F8
gcggcgatgtctgggacaccccgtggccagaaccctttcagctcaagggagggcttcacagtcaacctccgcacctttgccatggaccacgaacagtattccaagaagagagctttcgtccacgtcctactgaagagaaagaagaccttcgtgacggtgacagactccagcgggaacaaaaagacgggtgcctccgccggctgcttggaggacaggaaaggacggtcccgtctctcccgatacgcttccgaagcggtcgcggagcaggtcggacggtccgccaggaagatggggttgagctccatcgtcatgaaggtgaaaggggcttcgttcttcaagaagaagaagaaggtgatcctgagcttcagag

SEQ ID NO: 17813 - DNA, 388 bp, Zea mays
  Clone ID: LIB189-014-Q1-E1-E3
gccaacgcgcccaagcccttcgcctcggcggcgccgcccaaagcaaccgacgacaacgggagcaactaggacaaggcggcgtcgtggctcctccccgagcccgaccacgggcagaaagaaggcgccacgacggaggtgttcttcgcggactctgacccgtacctcgacctcgacttcgcgcgttccatggacgaagtcaagaccatcggcgtccagcatagcgggtcaccagagctcgacctcgccggcaccaagctcttctactccgatcactccgtgaaccacagtgtgtcatcgtcggaggcagcggttgtgcccgacgcggcgtctggcatggcgcccatggtggcagtggtcagcaggggcctgtagcgggatgcgcggctga

SEQ ID NO: 17814 - DNA, 389 bp, Zea mays
  Clone ID: LIB189-014-Q1-E1-E5
acccacgcgtccgcctacgcctcggctgacgtgtgggaggacgagtgggtgatctttccggatacctcacgatgctcgcagtaggacgtagatgataagttgaagttgactatgaagcaaatagccatgcgtatgtgcgggatatttacaaggagatgagccttgtgaagccctctatgagaaacaacacatgttatgaactgaactgtagaggtgatactgcatattgtgttacaaactgctatcacatgtttcactgatcagttgagatgttaataatatatacatctgcgttaatcatgtacagattgacgcgatgcatatgttggtcctgcgaagtgtgatcaattatggtattgacgtacgtacctactgagtgtcaaatgagc

SEQ ID NO: 17815 - DNA, 299 bp, Zea mays
  Clone ID: LIB189-014-Q1-E1-E7
acccacacgtccacggacgcgtccgtttagcataccacggggtgcatgcacatgtatccgattccctgcatcactcacacctcactttttctgctaaattgtggcaatggtgataagtgatatgcatagactgtcgttatttattgactaggcgataccatttagaatagccattgtgcatgacatggttaatctactacagacacacatagttaagccttgctcagctgatcactgctatggaatttctgtggagtccagtttggggggtcatctcaagcagtgcttgacatttaggc

SEQ ID NO: 17816 - DNA, 422 bp, Zea mays
  Clone ID: LIB189-014-Q1-E1-E8
acggacgcgtgggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagagaaaaaagatgtgacatcctagaggaggaggcctttgccatgatgggtgcgctcgcatggcaggccaggcaataataaaaagatgattattgcgtgccgggggaggagatcgcacgggggttgatgtttttggccccgggttctcctccctcatcttgttccgtgttcctgtatgcgttgcttccgctcctgttggtccgctacgcacgccggatttttgcatcgagcac

SEQ ID NO: 17817 - DNA, 389 bp, Zea mays
  Clone ID: LIB189-014-Q1-E1-E9
gtggatcacatcttctctttctggacttgtgttccgcctttctaactcatctgagagttctttgagcctgacatgattggcttcccaagcactccttgatgcacccagtggagtttcaagttacatttgagatgtatataatgaccatatataatcctccagtagattatattttctggagcatgtaatgtagacgttagaggcttgtcctggtttgccaagatggttgttacctaatgtcctaacaagaggccgcaggcgagcccagtccaattagatgatgtgaaaaatttttggcctttttttagtctttggacatgttatcaaattaaggaggtcctgctagcacgatatccaaactaagaaatacccaatgaaaactgaaaaca

SEQ ID NO: 17818 - DNA, 421 bp, Zea mays
  Clone ID: LIB189-014-Q1-E1-F1
acacttgggcggacccttgggcaattgctttcctgaacaattacttgccggcggtaaggcccataacttgcacggtgctgcacctaatggcgcaggggctgggcctcgacgacagggacgtgttcagccggctggtgctggaccgggacagcgactccatgctgagggtgaaccactacccgccagcggcggagacgaggcggctgacggggttcggcgagcacaccgacccgcagatcatctccgtcctccgctccaacgacgcgtccggcctcgagatcacgctgcgggacggcacctgggtgtccgtgccctccgacacggaatccttcttcgtcaatgtcggcgacgcgttgcaggtactccatagtcccatctaacattacattgctactttattattacatacacacatgacctg

SEQ ID NO: 17819 - DNA, 370 bp, Zea mays
  Clone ID: LIB189-014-Q1-E1-F11
accacgcgtccgcaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcct

SEQ ID NO: 17820 - DNA, 427 bp, Zea mays
  Clone ID: LIB189-014-Q1-E1-F12
accacgcgtccgcaaagcaactgactcctttgacaggtttgttttgtaccttcctgaaatctgctctggttctctacatatacagatgggttcttagttggtacccatttcttacatccttcaacttcacgcttaccatatagtatacagaagggccattgggtcccctttcagttgtctttagcatttcagcgacatctgctccacaaaatcacggcgtgtggcgtctcaacgaacgctatattaaattaattgttttctgattgcgactcatttcagctctgcattcatgatctgctctggaacccatatggttgattacagccaacttttactttctatgccctctttgttaggttttaggttggaaacatttgcgtcatatcatttatgcctttcatttctgtatctgaaaaaagtgtgaaat

SEQ ID NO: 17821 - DNA, 206 bp, Zea mays
  Clone ID: LIB189-014-Q1-E1-F2
ccctctccctcaggtcgggttcgggtacgtgatgtctccggggttcgggttctgggtgagcggatcacatgcggcctcggatgttgactacagcagctgcatctgttgactcgcctgggccagggacgaggaatcccaccacatccccattgatcaactactagccacgtcctcgagtcgacgatgatcctcaatgggtagaccca

SEQ ID NO: 17822 - DNA, 423 bp, Zea mays
  unsure at all n locations
  Clone ID: LIB189-014-Q1-E1-F3
ccaaaaacccgaaaaaaatcggcggccctttgcccattccaccaagaaaaccccaaagcctgcacctcgggaaccccggcccgaagggatgaattgccaccccctacattgatttctcccccgctccgatccccggcgcatgaccgggtcngctggcctatgcatcgcagcaggagttgtcgtcgattgcccctgcctgccccagttaatcccgcccggtcgcaatccagcattagaggcgccgatctcctgccccgtcctgccctgtggattatcgacagcggcgccggataccacggaagagaaggaagacaaggaaggggccgaaactaacttgcttgtgccggggcaaggacgagatcgagggcagccgagccggtacccgaaactctaggcgaggttcccacaatagaagtataccca

SEQ ID NO: 17823 - DNA, 393 bp, Zea mays
  Clone ID: LIB189-014-Q1-E1-F5
cccacgcgtccgcggacgcgtgggcggattcattttcacatggtttgctgctttgcccctaatattgttcttagcgcagtcattgactaaggctatagtccaggattttttaatccttaaggggccatgtcctaattgtggtactgaaaacctttccttctttgggactatactgtcagtctccagtggcggtacaacaaacaaagtgaaatgtgcaaattgcagtaccgagctggaatatgactcaaaatctcgggtgatcacacttccagaagcatcaaatgcataaacataggaacagggagctccagagcttgtgaattctatagaataaaggtggttgtccgcacagtatagcaaactgcgaagcctgcaactactaaagtttggtct

SEQ ID NO: 17824 - DNA, 408 bp, Zea mays
  unsure at all n locations
  Clone ID: LIB189-014-Q1-E1-F7
cccacgcgtccgcccacgcgtccggttcctgctccacgccctcggcttcgccgccgacgccgaccgcgacgacgtcttccccatctacgtcggcgacgaccgcaccgacgaggacgccttcagggtgctgcgcgcgcgcgggcacggcgccgggatcctcgtgtccaggttccccaagggacacagcgcgtccttcacgctacgcgaccccgccgaggtcaaggagttcctgcgcaagctcgtcggcgccaacgacgacagctgatgatccggcccgcgattcgtttccctttcccgccgtgnacagctccgatccgcctgtgtcaagccgctaactcaacctcggctacctacctgctgcaccggcagagggcttccttgttgttgcaactgcatctccatcgagca

SEQ ID NO: 17825 - DNA, 262 bp, Zea mays
  Clone ID: LIB189-030-Q1-E1-G2
aaagtactgcaaggacaacccggactccgaggagtgccgcatctacgacaactagctagtcgtatagctatataggccatcgacatgaaggacgaaggttgtagcacactacgaaagaatgatactctcgatcggcgcgtcatacgtggaatgaacttgtttgtatcaagctatctatacctcaatgcttctctacctgccgccgccgcaccccgtatgatatgtgatacacagctgggatggtatactgatattttgggtt

SEQ ID NO: 17826 - DNA, 191 bp, Zea mays
  Clone ID: LIB189-030-Q1-E1-G3
gcgtccgcacacgagtccgcggacgcgtgggcggacgcgtgggccgactcgtgaactgaggcgtggtccgtgctgtggtgcctgctttgattataaatagccgtgatgatgcatactcttgttgagcaatgaattcgaccgaccatatttgaacttcctatgtacgtgtcacgtatctcaagtttggtgtc

SEQ ID NO: 17827 - DNA, 420 bp, Zea mays
  Clone ID: LIB189-030-Q1-E1-G4
cgtccgaccacacgtccgcccacgcgtccgacaagcaccagtttggctcgtctcggcctcggcgcgtgcccccgacccgttgctgaccccgctccccggtgatctgatgtcggcggcggcacgcgcgccaccgccgccgcgcgcactctacgcgccgtcgagaagagtccctttcggtgccgtgatcctatccgcgccgcgacccggggctagggttcgcgcggcgcggcctcgcgaggggaatgttcataaccattgcctgttgacatcgtctagtctgaattcaaattctttgctatgtcctccatgcaattgtgctcaaatggctttggccgacacaagaattgcttaccagcctgaagttgacaagcatgctggagttctggtatggaagctttgatactatttttgcatgggatg

SEQ ID NO: 17828 - DNA, 409 bp, Zea mays
  Clone ID: LIB189-030-Q1-E1-G7
cccacgcgtccgcagctcgcagaagaagggccccgcggggggcgtgctgatccccaagggcgggtgggagctggacgagtccatggacgaggcggcccggcgcgaggccgcggaggaggccggcgtgctcggcgagacgggccccgcgctgggccgctggtgctaccgcagccgcagctacgacgccacgtacgagggcttcgtgctcccgctgcgcgtcaccgcggagctggaccggtggcccgagatggccgcgcgccgcacggagtgggtctccgcagccgaggccatcgcgcgctggccccaaccctggaatccccaaggccttcaaccggtccccgaaaacgttcccggtcccggcggaaacaatgcacttcgcctcggccctctacctctaggcccggccggc

SEQ ID NO: 17829 - DNA, 423 bp, Zea mays
  Clone ID: LIB189-030-Q1-E1-H1
caaacgaacaaaggcacagcgcacctcacttattacgaaccccctctgtgccactgcccactgccacctcaaatccccgcgaacctatctttcccttcccccgatccaggcggttctcttcccagaagccagcccagaatggtgggatccgacgcgctgcagtccatcgtttacagccgtgggtcactccgcctcctcgatcagaggaagctgccgctcgagatggagtacatcgacgtcaagagttccgccgatggctggaatgcaataagagacatggttgtccgtggtgctccagcaatagccatagcagcggcactagcattagccgttgaagtttctgatttagattttattggtacgcctgaagaaacagcttcttttgtttcaaagaaattggaataccttgtatccagccgacca

SEQ ID NO: 17830 - DNA, 348 bp, Zea mays
  unsure at all n locations
  Clone ID: LIB189-030-Q1-E1-H10
ggtccacgacgcgtccgaaggacagagaaagataagaaaggcggtggtcaacttgtgtcctgaggtgcccgtanaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcangacaagaagatacaatagactgcgtccgttgagct

SEQ ID NO: 17831 - DNA, 368 bp, Zea mays
  Clone ID: LIB189-030-Q1-E1-H12
acgttgccgaatattgaagagcttactggtgtaaatacaacttgggtatccaccttgatggctcaacatttactagctgctgcagaccgttatgcattggagagattgaagttgctctgtgaacttaagctgtgtgaagatgttgcaataaatacagtggcaaatactttggcactggctgaacagcaccactgttatcagctaaaaactgtttgcttgaaatttgtagctttgcctgaaaatttgaaagctgtcaggcaaaccgatgggtttgattatttgcaacaaagctgcccatccctcctgaccgagcttctcgagtatgtggccaacgcaggagagcactccgtgagcccctgcttgtattc

SEQ ID NO: 17832 - DNA, 309 bp, Zea mays
  Clone ID: LIB189-030-Q1-E1-H2
cgtccgaggacacgtgggggacatcattcaggaagcagaggatgctgttctcccagggtccagtgaaaacatgttcttagaaactgtatctgaaatcatggaccgtcacctcgacaaggagtgagtttagaaattcagaataactgatctagttgttccagctgtatccggtttgttgtttctattgttgacaagcactgatcaacagactaataatttgatttgtttgtacctctcaaatgtttctttcggttgtaatgctcgagtactttgcttagcacactttgtgaataatatatttgttcagtt

SEQ ID NO: 17833 - DNA, 427 bp, Zea mays
  Clone ID: LIB189-030-Q1-E1-H3
cagatccaagaaacgcataacggttcgcttctccggctgtcctcgcatggcgctcggcagacccgttgcttctcgtgtgcgcgtaggctgattccgtgtgcctgctccttgtctggatttcttaaggcgtggagccagttgggccagggaagatttaaccagtcgggcccggaaggagcctaagggttggatctgatgctaccaggtcgctgagcatcgctactgaagggggcagcttctgattccggcagatggctcctgaaatgatggaggaggggcaatcagcttcctataccgtggatgacgctctcttgtcatcaggttttgggaggttccagatattgattctttcatatgctgggattggcttaattgccgaagcgatggaaatgatgctgctatcaatttgtggtccatcagtacagct

SEQ ID NO: 17834 - DNA, 425 bp, Zea mays
  Clone ID: LIB189-030-Q1-E1-H4
tccgcccacgcgtccggttttacagctcaaggtcttgaagaatagcaagtgttccaggaacccgtcatcattgttggtgtgcaccgaggtgtttgagctcggtccatcattatatgtcgtagagcttaggaaatcccacggagactctacgttgtatagacagctgtgcgaaaggctctccgatgagctaggtgcctgcaagacagaccagatcgcgaggactgaatcatcgagtgacgacctctcgagcgtcgatggcgaagcgttccctctatctgggttctgatcatattgctttccctgtgttgttttgggaacaggggatgaggaacatgctcgttcctgatgcaattctagattaggatcatgaatatagtgtacaaagccagcggcggcggcggtgcaaattagccaccgggttgaat

SEQ ID NO: 17835 - DNA, 434 bp, Zea mays
  Clone ID: LIB189-030-Q1-E1-H5
agacactaggacctcccctgcccccacgagatttgtatctgtacctgactacgatgaggagtacaatgactgtgatgatgatgactatgatggaaccgaatatggcatcaaccatcctgttaatatggggaaaggaagaagggcgagcccatcaagctcgtcttcaccggcaagaagaagggaatcactcccgtcgcctccttcagcgccctcgacaaggagggcgaggaccccaccccgtctgccgcagccgagccgaagcccagcaacgatccacccgaggacgacataagcactttataaaaaataattctcacaggtggaaccttgttgcattctacagatttaggcaaaatccttacgggttgccttttgatttaactaccattcaaattaccaactcttgaccagatttattagttccaattgcggtc

SEQ ID NO: 17836 - DNA, 213 bp, Zea mays
  Clone ID: LIB189-030-Q1-E1-H6
tctcctgcccccacgggatttgtttctgtaccttcctatgatgacgtgttctttgactgtgtttctgatgtctatgaccgtcccctctatggcgtctggcttcctgttttcatctggactggtctaatggtgagcccattatgctcgttcgtcgtgtccattattgaggaacactgctcatcacctccttcatctccctcgtttgtgacgccc

SEQ ID NO: 17837 - DNA, 342 bp, Zea mays
  Clone ID: LIB189-030-Q1-E1-H7
accacgcgtccgcaatcccattgaatcctctgccaataaagaaacatgagtgcaatcggttgcctatccacatttgctctgaagaagacttcttgaaagatgtcatgcagtttctacttcagaggggccacatccgacttgtacctcagggaggactggcagaatttcctgacgcagtgttaaattcaaagcgtcttgatttatataacttatacaaagaggtggtataccgaggtggcttttatgtaggcaatggcataaattggaaaggtcaaatcttttcaaagatgcacaaccatacagttacaaacaaaatgacgggttttgggaaacacctaaaaa

SEQ ID NO: 17838 - DNA, 437 bp, Zea mays
  unsure at all n locations
  Clone ID: LIB189-030-Q1-E1-E9
gggtccacgcacgcgtccgcaccacgagtccgcggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagccccgggcagcgactagaccgcgccncgcggccggccccccgccggctagctatagctcctgcg

SEQ ID NO: 17839 - DNA, 425 bp, Zea mays
  Clone ID: LIB189-030-Q1-E1-F1
aagcaggaaaaaatctacatgttgatggcgtggatcagaaaaatggtaagttttgcttcatagatgtattaatatttggaatctcaataaacccctcttgttttccgtctgctaacatattcgtatggaacccagcacaaagctcaacgagaataatgatgcaatgatacatacatgtccacagtccatacgttttttttgaagaaataacacttttctagatgagataattagcacatgtgcaattagccaattactgtcttgtgttatgtgagccattggatttgatttttatatcctacaaattgattcatgttacacttgaccttgagattcatggaaccaattggttgagctgcacattcaaatttgatttgttttaatctaatgaatagcaatttgttatcagtggaaggacaagattt

SEQ ID NO: 17840 - DNA, 294 bp, Zea mays
  Clone ID: LIB189-030-Q1-E1-F11
ggtccacgacgcgtccggaacgcaagggagccaaagggaaagttacaagcattgtggctaagaaggacgtagctttagctacacggattgaagaggccatgaagaaaaatgagagcttggaagctctcacgactaacaatgtcagaaggccaaccagctcgcagagtgtgaacacgaaagggaggccctcaaggttggttaagacttcaaatgctcttaaagttgtcagtcagaagggtagaaggggagtatcgctatctaacaagtcaaccccgggctccaaaggatacaact

SEQ ID NO: 17841 - DNA, 244 bp, Zea mays
  Clone ID: LIB189-030-Q1-E1-F12
ccaagcgtaagcttacgcctattctggctcctagggccataactttacctaggcggattgttcaggccatgaaaaagtatgggaacttggtacctctcacgagtagcactgtcaaaacgccagccagctcttagagtgtgagcactacagggaggccctcaaggttggttatgacttcaaatgctcttaaagttgtcaatcattacggtataatgggagtatcgcgatctagcaggtcatcccg

SEQ ID NO: 17842 - DNA, 366 bp, Zea mays
  Clone ID: LIB189-030-Q1-E1-F2
accacacgtccgcccacgcgtccgcctacgcgtcggcggactcgtgtgcggacgcgtgggggcatgggactgggccccccggccgcgacgaatatactcactcctgtcttcatacgtagccatatccggcaggcggcagtacctgtatatggttttagctatacgcgacctcagttcgggcgcaagctacaaccccgaccaggcgagaagaagcatcgctagtgtgacgagcttaaccagcaccagcaacgtgatccaaatccatggacaaccagccactgccctactccacaggccagccccctgcccccggatgagccccggtggccggcattcctagcgctgccggcctcccacccgtgccgc

SEQ ID NO: 17843 - DNA, 395 bp, Zea mays
  Clone ID: LIB189-030-Q1-E1-F4
cttcggccaagccttcggggtggtaaccaaaattcgttaagaacctgtaaacccaccggtttccccgtctccggcccttgctcagctatgcacccttgctttcataaaagtgccaagtccttgaggatgactttggtcaggaagcagcagagtatctaagtgaatgtttgctcagtagctcaaagcaataccgggcaatgatcgaagaacatgatacttctggggggaaatcaaaaggacaaggaaccggaaatgttctcattgttactcttgttgatgcggagacagaaagtagcataaacgctaccatgcttgaggaagggcttgcccggctcgaaagaagcaagagatgggacactagggagaggaagacggctctccagaacctggaacag

SEQ ID NO: 17844 - DNA, 376 bp, Zea mays
  unsure at all n locations
  Clone ID: LIB189-030-Q1-E1-F5
atgctgacaaggagaatatagcagcaaggttcgcacaaatgtggaatgaaattgtcaccagctttcgagatgaagatcttatagacaatagggagaaggagctgctacttgttccttatgtgtctgatcggacccttggtgtcgtgcagtggcctccatttttgcttgccagcaagatcccgatagcagttgacatggctaaagatagcaatggcaaagaccgagatccgagaaagaggcttgacaatgattattaatttaagtgtgcaattgaggaatgttatgcatcatttaagaatatcatcaatggccttgttcaggggtaaccanagaaaagggtcataaataagatatttgtagaagttgaaaaatgcat

SEQ ID NO: 17845 - DNA, 426 bp, Zea mays
  Clone ID: LIB189-030-Q1-E1-F6
catctgcgtacacggtctccctcttcctgtcagtagtagagtgagagtgaggcagcgagtaggagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcagggagatgcgcatcgcgcacttcgtggtgaaggagccgatggtgatcgggcacgagtgcgcgggcgtggtcgaggaggtgggcgccggcgtgatgcacctgtccgtgggcgaccgcgtggcgctggagccgggcgtcagctgctggcgctgccgccactgc

SEQ ID NO: 17846 - DNA, 430 bp, Zea mays
  Clone ID: LIB189-030-Q1-E1-F7
ccgggccgacccacgagtccgcttgtttcttaccaaagctggcacattgaaaccgattgctattgaacttagccttcctccgagcaaggcaggcgagccccggccaagcaaggtccttactcctcccgctgatgctacctccaattggctatggatgcttgccaatgctcatgtcagctccaacgacgccggtgttcaccagctcgttaatcactggctgaggacacatgctgtaatggagccgttcatattggcatcgcatcggcgtatgagcgcaatgcacccagtcttcaagctcctgcacccccacatgcggtacaccctggagattaatgcgctagcactgcagagcctgatcagcgcggacggtgtcatcgagtcttgcttcacccctggtcccgtctccttcgagatcagcgctgcatactac

SEQ ID NO: 17847 - DNA, 437 bp, Zea mays
  Clone ID: LIB189-030-Q1-E1-F8
actggattcagtttccagatcgtaaatacaaatcttgatgaagttagccctcgtgctcgacgaagaagtgctttacttacatggcaacatatagcatcgctgccacccaatttgcctgttatctattgtggaggcttcaatacacagaaggaatctatgactgggcggtttttgcttggcagatccagagaacatggtgttgttggtgatatgagagatgcttggccaaatgctcgagtgcgaaaaaatgtttcactaatacacacatatcatggatttaaaggggagaaacaaggtgccctggaatttcttaaattgatatttagagctctttgcctctgctgggatcgacagacacaggacttgcatatcgactggatcttgtttagaggacgcccattggttcctgcactttgtgaggtcattaatgacaatat

SEQ ID NO: 17848 - DNA, 460 bp, Zea mays
  unsure at all n locations
  Clone ID: LIB189-030-Q1-E1-F9
ggtccacgcacgcgtccgcacacgagtccgcggacgcgtgggcgacgcgcagtcgcccattcggcatctcgccctcccgtcctgtcccgtccgtccgttctccgattggccgccgcccgcctcgccctcgtcaacaaaagcccaccgcaagcgagcgagcgagccaccctccccgccgccgccaccgcccccgtcccgcccccaccccgactcctcctgaccgccggcgtggggtgcccgggctccacctccggcgacgacaccctccccgccgcgcgcgcccccaccgcctgctccggtttgcgggggtagccggggctccggcctcggcggctttcaaagccccctccctcacaacaggatccaaaatcccgtcctagacttcttctacctcnccttccagaacttcctcttttggcatcccggacggtcgatctcgacccccttcgatttcgattca

SEQ ID NO: 17849 - DNA, 371 bp, Zea mays
  Clone ID: LIB189-030-Q1-E1-G1
caagcaaggaagcacacgatggctcatcgcgttcgcctctacctctctcccgcgtaaggcacggcagttgcggccaccgtcggacctgaggactcgctgatccggaacgtgattctgcggtggagatgataacaatctggagctgaacgcggagtcccacttcctgaactacgtgcatcggtacggcaagtcgtacaatgacgccgacgagcactcgataaggctgtccgttttcaatgccaacctactccacgcactccggcaccacctgcaggaccagtcggcggagcaccgcgtcactaagttctcagaactcaagcaggcagatttccgccggacgtatctcggactccgcaagtaccggtgcgctc

SEQ ID NO: 17850 - DNA, 460 bp, Zea mays
  Clone ID: LIB189-030-Q1-E1-G11
ggccggtcgaaattccgggtcgagcacgcgtccgagtcaacacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccgcctcgacgacgccgtcctctacgtcgacgtcgtccacgccaacgccgcccagggcgtcaagccgctcgtcggctccgcgcgcctcccgctccgcgacgtcctcgacgacgccggggtcgggggcaaggcctcgcgcagcctccgcctcaggcgcccctcgggccgccc

SEQ ID NO: 17851 - DNA, 437 bp, Zea mays
  Clone ID: LIB189-030-Q1-E1-E8
accacgcgtccggacacctggaaatcttatatcgatgcaggcatcaaatgtagtggctttgccatatcaagtcccaggtcaagtttctggacctcctgtcttaactaatgcaccaaattttcacccggtatgtactgtgcagttgaggccgcccacaaatggtggactagctgtccagacaatgggtagtgcctctcaagttgcttttggttacccagcagtccagctaccaacacttgaaacgggctcttcatgggcatttggtgctccacctcaggctctgtcttcttttactgcaaaagacaaagctgatcaaacaggaaccaagcaagttgacgatggcaagaagccccaggaggcaggtgcttcctcgtctgctcatgctgaagatgagaaaaaggctgatagaggactctctcttatgggttctgccataa

SEQ ID NO: 17852 - DNA, 448 bp, Zea mays
  Clone ID: LIB189-030-Q1-E1-D4
gggtccaccacgcgtccgagcagatcttcaaccgtaacccgacaacaatcaaaaactatggcatctggctgccctacaaaaccaaaaccggctacaacaacatttacaaggattaccgcaacacaaccctgaacggcgctgtagagcagatgtacaatgagatggcttctcgccaccgcgtgaggtccccctgcatccagatcatcaagaccgccacagtacacttcaagctgtgcaagagggacaacaccaagcagtttcacaacagtgagatcaagttcccactcgtgtaccgcaaggtcaggccgccgaccaggaagctgaagaccacgttcaaggcttcgaggcccaacctgttcatgtgatttagctgtggtcagtgtatgtgatcgtaagaatctgtgttttaagttttgacgctaagacttgggtggtttgaagattcaac

SEQ ID NO: 17853 - DNA, 383 bp, Zea mays
  Clone ID: LIB189-030-Q1-E1-D5
accacgcatccgaccacgcgtcagcggacgcgtgggcggacgagtgagacgactcgtgagtggcggccgggatggtggacgcgatggtagtctcgacaattctggcaggtagtcttctaaaggggtgcctcaactcgggagacgggtcacctccttcgccgtcctctgctccataaagaggatcaataccgagatgccctacgggattggaggtgggattaccgttgacgtgaacgtcaacgggaaaaacggcaagggaaagggcatggtaaaattcgtctacaagtacggcgcgaacttcgacgggtacatcccaatctataacgaagatcactggtctgataacggggatgtcaacgtcgatgtaaacagtgggcttaaga

SEQ ID NO: 17854 - DNA, 433 bp, Zea mays
  Clone ID: LIB189-030-Q1-E1-D7
accacgcgtccgcggacgcgtgggcggacgcgtgggcggacgcgtggggctgccgacgacggaggcctccatggttccagtcccagggatccaccatcagcaccagtggcagtggcagtgacagtggcggaggtggaccttgagatggctctgcctcctgcatatgcacctgcccatgcgtagagagagcactccccttcactatcatccagccgacgagttcactctagctccagctatacatccagtctgtgtgtgtatattatatacagatccactgtttgttttctaagacctcgatgtatactgaaagaaaagtaaagacagcagaacagacgcataaaggaatagattagattatatagccgatttcgttccactatttgttttttgagaatgctgtagtatttaagatattgtgggttttttcagt

SEQ ID NO: 17855 - DNA, 432 bp, Zea mays
  Clone ID: LIB189-030-Q1-E1-D8
aggacgcgtgggcttgcgattcgctcgctcgatcctagcttcccttccaagaagcgcagcgcccatggccatgtccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggggcccacctcttgaagctggcgcg

SEQ ID NO: 17856 - DNA, 367 bp, Zea mays
  unsure at all n locations
  Clone ID: LIB189-030-Q1-E1-E12
aggcccgccgccgccagaaccggcgggttcaacctcttgctccccccggcgcaaaggctgcctccaattcttcctaccatcattatccgaaaaggtgtaaggatacaagcggcggcggcagcaggcggtggcggcgcgctgctggggcgtcccatggaggacgtgtacaaggtgcgcgtggagcgaggcgaggtggctcgggcacggattgaggcgctgcgggtcatggagacgtggtcgtcgtggcgcaccgggtggccggtgccggatgccgtgggactggcaggtcgaccagctcgtgtacatcgtgtccggnggaggtgaaggtcatccccgccggcgctgtccacggcgacgactacatgca

SEQ ID NO: 17857 - DNA, 93 bp, Zea mays
  Clone ID: LIB189-030-Q1-E1-E2
cgcgtccgaccacacgtccgaaaaaataaaaaaaacaaaagtagctcaacagagaagctaaactaaaacaaaaacatggcgtcagtcacagaa

SEQ ID NO: 17858 - DNA, 458 bp, Zea mays
  Clone ID: LIB189-030-Q1-E1-E4
gggtccagcacgcgtccgagaggacccggcggcgggggcgagcggcagcaagtggcggctggcgacgctgacggacgtggaggaggtgaagacggtggcgcggatgctgccgatctgggcgaccacgatcatgttctggacggtgtacgcgcagatgaccaccttctcggtgtcgcaggccaccaccatggaccgccgcgtcgggggctcgttccagatccccgcgggctccctcaccgtcttcttcgtcggctccatcctgctcaccgtgcccgtctacgaccgcctcgtggtgcccgtcgcgcgccgcgtcagcggcaacccgcacggcctcaccccgctgcagcggatcgccgtcggcctcgcgctctccgtcgtcgccatggcgggcgccgcgctcacggaggtccgccgcctccgcgtcgcgcgcgagtcctccgagtccgcctccggaggcg

SEQ ID NO: 17859 - DNA, 430 bp, Zea mays
  Clone ID: LIB189-030-Q1-E1-E5
aagccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatcaagaatactgagattgcaaagcacttgtcccttccaccagtaaagctccattgcagcatgcttgcggaggatgccattaaagctgctgtgaaagactacgaagccaagaacgcgaagatggggcaaaagagtgaagacag

SEQ ID NO: 17860 - DNA, 430 bp, Zea mays
  unsure at all n locations
  Clone ID: LIB189-030-Q1-E1-E6
aataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagaganacaga

SEQ ID NO: 17861 - DNA, 429 bp, Zea mays
  unsure at all n locations
  Clone ID: LIB189-030-Q1-E1-E7
agcaggaaaaaatctacatgttgatggcgtggatcagaaaaatggtaagttttgcttcatagatgtattaatatttggaatctcaataaacccctcttgttttccgtctgctaacatattcgtatggaacccagcacaaagctcaacgagaataatgatgcaatgatacatacatgtccacagtccatacgttttttttgaagaaataacacttttctagatgagataattagcacatgtgcaattagccaattactgtcttgtgttatgtgagccattggatttgatttttatatcctagaaattgattcatgttacacttgacctgagattcatggaaccaattggttgagctgcacattcaaatttgatttgttttaatctaatgaataacaatttgttancagtggaaggacaagatttacgatg

SEQ ID NO: 17862 - DNA, 336 bp, Zea mays
  Clone ID: LIB189-030-Q1-E1-D2
agcacgcgtccgagaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaggtataaaaaatttaattgaggtaaaaggaaaataaaaaatttttttaaaaaataaaagggggttttatttaaaggtttttatttttaatttgtgttgattgggaatttaaatgtttttaaaaaatttaattaatttttatttaaagggctttttttttaaaaggtttttagggaaaaagccttggtttttttaattttacatttttttaaaaaaatttattttt

SEQ ID NO: 17863 - DNA, 411 bp, Zea mays
  unsure at all n locations
  Clone ID: LIB189-014-Q1-E1-C6
acccacgcgtccgcaatactatgtgtacatatagtccaactcaaaaggttttagaacctaattttctagttggtgccccgtcatctgctaggttacctgaagctggtagtcagttaaattgtgttgttttaccagatggtcaggctaagagtagtactattggaaagggatttgtaaagattttggactcaatctccgctccccccgcttttgctggagaattcccagcaatccaccgcaaatctttggctcatatttctggggggcgccccaacacactccatgtttctgctgaagtgatccgcgtaggaagtttagctgttccttctggtgcagataagtgggcgctgcaaaaggatcaaggcatggagctggtcttttctgcagattttgagcctgatnaccgtcttc

SEQ ID NO: 17864 - DNA, 399 bp, Zea mays
  Clone ID: LIB189-014-Q1-E1-C9
cccacgcgtccggaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttac

SEQ ID NO: 17865 - DNA, 389 bp, Zea mays
  Clone ID: LIB189-014-Q1-E1-D10
gtcacctgacagagcatctgtttttggaagttctgcagaagatggtttcttaaacgtgtgggatcatgagaaggtggggaagaagaaaaattctaatgtcccagccgggcttttctttcagcacgctggtcatagggataagattgtagacttccactggaattcgtcagatccttggacaattgtcagtgtctctgatgatggcgagagcactggtggaggtggaacactgcagatttggcgcatgagtgatttgatctaccgcccagaggatgaagttcttgcagagctggagaatttcaaggctcatttggccagctgtgcaccgaagaattgagtcatgtgggttacctgcggaatgcaatcctgtggaaactgagtaggtgatg

SEQ ID NO: 17866 - DNA, 355 bp, Zea mays
  Clone ID: LIB189-014-Q1-E1-D12
cccacgagtccgaacacgcgtccgcccatgcgtccggcagagcacacgtatttgttccttggtgctggggaggctggaactggtagtgcagaacttattgctcttgacatttcgaaacagacgagtgctccaattgaagagtgccgcaaaaaggtttggctggtggactcaaagggtttgattgttgactctcgtaaaggctcccttcaatcattcaagaaaccttgggcgcatgagcacaagcccttgaaaaccttgtatgatgctgttcagtccatcacacgtacagttctgatcgggacatctggagttggaagaacattcacaaaagaaatcattgagggcatgtcttcct

SEQ ID NO: 17867 - DNA, 348 bp, Zea mays
  Clone ID: LIB189-014-Q1-E1-D8
aaaaaaaaaaaaaaaaaaaaaaaaaaaaaaaaaaaaaaaaaaaaaaaaaaaaaaaaaaaaaaaaaaaaaaataaataaattaaataaaaaaaaaaaaataaataataataataaataaattttaaatatttttttaattgaatgtgtttctttttagttttttattttttgggaatattttcttttttttagccttattttttttgtttttgttttgtgtttctttggctgtctttatattttgtagttctggtataattgtctctttatattattttgtcatattttttgttttatgggatgtgttttttttctgtatgttttgcttgttggatttgtttttttatt

SEQ ID NO: 17868 - DNA, 397 bp, Zea mays
  unsure at all n locations
  Clone ID: LIB189-014-Q1-E1-D9
atctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggangagtacctcaacgcgccaggcgagacctactccgttcacctcaccgtgccgggaacct

SEQ ID NO: 17869 - DNA, 384 bp, Zea mays
  Clone ID: LIB189-014-Q1-E1-E1
cgtccgaagatagagaggtacagcacgaaaaaaagaggcaagagagataggggaccggagggcggcgggccggggcccaagaccgaggggctcgtgcgcaggaagctgatgaggctcctgtcgctcgtccccttcggctgccgtgctggacccatcgacgacgcgccgccgcccgtggaccacgccgccgccgcgaggaggcgccggaggaggagggccaacagggccgcccagctgctgggggctgctgcgggtgcgccgcagcagtggcgcccctcgctcggcgacatctgcgaggagtacagcagcagcaccgacgccgtcaaggtcaggaaggcggcgtcctgggacctcgcccgggcgctgccccgcgcgcacggcggc

SEQ ID NO: 17870 - DNA, 390 bp, Zea mays
  Clone ID: LIB189-014-Q1-E1-E10
caacactatctgccagagaaagaacttgtcatcccagatcctcttctgcacttcatccagtcccatggtgctgctcttactattgatcaaagtggtcgggtcctcttagctggcaatggtgatgagatgagagacttgctctcaattttcctggcgttcaacatgtcgagacgagaaacaggtggctgcaaggctgcatttcttgttccatactttgagaggaaaagacgttctagggctaacagccaagtatccaatttaaaattagcaggcacaactgctgatgtttcaaaaagtactgattttaattcaaaatctttgtcaaagaagaaacataaagtgaaaaacatcaaagaacgtgactcgtatcagagaaactacatacatgct

SEQ ID NO: 17871 - DNA, 401 bp, Zea mays
  Clone ID: LIB189-014-Q1-E1-E11
cggacgcgtgggcggacgcgtgggttcaggagctgaaggtggtgactttgaatctggtgatagtgcagagcttgaggtaggaatgttggatcatcccatttctgttgctgctgcttcagaagaagtgacagcagatgaggataacactgctttagctacttcaaaccaaaataatccagaggtaccacaagttgaagaagtgcggaaagcagacaaggataacactgcttcagctacttcaaaccaaaacaatcaagaggtgccacaagtagaacaacatgttggcatcagcaactcttattcagagccgttggaccttgcaaagtacagttcatctgcagaattggaggtgcttggtctggagaagctaaaaatagagctgcaatctcgccgattaaaat

SEQ ID NO: 17872 - DNA, 406 bp, Zea mays
  Clone ID: LIB189-014-Q1-E1-E12
cccacgcgtccgccccaggtggcggcagcggcggcggggtagcatttgtgctacgagggcttttgcaatggcggcttcggggttcggcggcggcgaggcgttccggctctcggccgcgccgggggccggcttactgaagctgcacaagggcgacatcaccctctggtccgtcgactgcgccaccgacgccatcgttaatgctgctaatgagcgaatgttaggtggcggaggtgttgatggagctatacatcaagctgctggaccagagctagtgcaagcatgccggaaagttccagaggtcaaaccaggagtccgttgtcctactggagaagctaggattactcctgcttttgagcttcctgcctctcgggtgattcacactgttggccctatatatgatttggac

SEQ ID NO: 17873 - DNA, 421 bp, Zea mays
  Clone ID: LIB189-014-Q1-E1-C5
gcgcacatgcgcagcctgatcatgagggagtgggtggagctcaacagggagtgcttctgcaggaggaccttcccctcggacatcgcgcaggtctgcttgaacaccgtgaggatggtcagcgtcatgtactcgtacaacaaggagcagaggcttcccgtcctcgaggactacgcgacgatgatgttggtggtttgatttgaagcatgcatgcatgcaatgctctctccgatccgcggatatgaaagtaaagtccttgtcatgcagataatgatttgttttgagaccagagtagtctagagtagagattaggctctgtaaaattagatagctaggattagaataactgggcaaacgaatatatggtatatgtccatatgtaaagatgcaatatatagcaacatatatggtaccgtcgttaaaa

SEQ ID NO: 17874 - DNA, 378 bp, Zea mays
  Clone ID: LIB189-014-Q1-E1-B1
gtcgagggacgcgtccggctaaatgccggtgggctcgaccttctatataagtatatcccgtctttatcttctggatgaggattatcactcaagctagcatgtatttcaaacttaggaaaattttacatcattcaaaatgtaatccttctaattcacttttgtaaccactccgatcatgtacaatgtaaacttgttgtaaactgataaaattttgtaataaaaaaattccgctgtaaattatggtgtgtgttttgtgtttacttaatcctgcgatcttggcggtaagtggtttatccggggtccttgggacactcggacatatcctgttaagttgtttggtgcacatgcatagccgtttgaggtccttgggacaaagat

SEQ ID NO: 17875 - DNA, 389 bp, Zea mays
  Clone ID: LIB189-014-Q1-E1-B10
accacgcgtccgcccacgcgtccgcccacgcgtccgggaaattcaagtcctctatcaccagcatcatatgcccaaaatggtcttggaaactatagtaatgaagcttttggtctgccaaacagtccatatagatctcattcagctatactcgcagatgatattgtttcaccttcagctggacgtgaacatatatccctcgatgttcctagaggaaggtataagacaactagtttgcctgttcctggtcttggttcaagcagaggttctcaggtgttgggtggcccatataatggaaaccatgatatgatctcaaccaataccctacaaaacatggctggaattcagacaggagcagcttggcttgaaactgatgctgcggcaaacacata

SEQ ID NO: 17876 - DNA, 385 bp, Zea mays
  Clone ID: LIB189-014-Q1-E1-B11
cacaagcacttcgacgtcgcacgggcgctgcacacagacacaccaagcgtcggcaccaatggcttactaccaggaggtggactactgctcggaggaggtgaggtcggtggccccggccggcttcggccgccacggaagcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctg

SEQ ID NO: 17877 - DNA, 369 bp, Zea mays
  Clone ID: LIB189-014-Q1-E1-B3
cgtatccagatcgagagctgccttgtctgcacatgcagaagcgccaagagcgagcgcctcatgtctttatattgctctcacaccctccgtttctcgctcccacccactgccactgtacttgtgttgtgttgtgttgtgtgctgcaagaagaataggaggaggaatagcatgtgctgaaaagcctgccagcgcgctttacgacaagcatatatgggggagatcaccaagcctttgccaagcagaagcttccgaagatggcctacgactactacgcgtccggcgcccacgatgagtggacgctgcaggagaacatggaggccttctccaggatcttgagcacccgttgatgagataagattgccaagaaac

SEQ ID NO: 17878 - DNA, 269 bp, Zea mays
  Clone ID: LIB189-014-Q1-E1-B5
cctgcacctcttcatgacactccacaaatgacgaaacttgcacctgaacatatgggcaataaggtgaaccgaaaagcgatgccattatttaagcttggggataaatgtgacgtaacattggacgtactctatctagcttccgatccaggatcatatgtaagtggggctataattagtgttaacagtagtctttggttgagtcgctcgctccatattccccacgatgatctcaaggcagtctttaaagttgtctctaaaattgttaaggc

SEQ ID NO: 17879 - DNA, 397 bp, Zea mays
  Clone ID: LIB189-014-Q1-E1-B6
aggccaaaacccgcgcacaccggcgacggcaggagaacctcccgccggccgccgccatgccgccgcctctacaggcccaccgcctactcatctcccaccgccgcctacccactccagctcgccgccggttcaccgccgcctcttccgtccaatccgctcccgccacaaccttggccccgggccccgccacatcctccatcctctccatccgcgagtcgctcctctcaggcgagaggaccgcggcggacatcacctccgagtacctctcccgcctccgccgtaccgagccgaccttgcgcagcttcatccacgtcgcggacgccgccgccgagcgggaggcggaggaactcgaccggaggattgcctccggggagaatgatgctgtgggtccgctcgc

SEQ ID NO: 17880 - DNA, 331 bp, Zea mays
  Clone ID: LIB189-014-Q1-E1-B7
cccacgcgtccgggatgaaggacgccaaacccgcaaagactccgatgggaaccgacggacacaccgacctcaacaaaggaggtaagtccgttgatcaaaaagcataccggtcaatgatagggtcattactttacttatgtgctagtataccggatattatgcttagcgtatgcatgtgtgctagatttcaatccgatcctaaggagtgtcacttagtggcagtgaaacgaatccttagatatttggttgctacgccttgcttcggactctggtatccaaaggggtctacctttgacctgattggatattcagactccgattatgctggatg

SEQ ID NO: 17881 - DNA, 421 bp, Zea mays
  Clone ID: LIB189-014-Q1-E1-B8
acccacgcgtccgcggacgcgtgggaagctccccaacgaagtgcgagcgacccacgtcgacacgacacgaaccaccaccaccaaccatcagccgcaccacgcacccagcgcaaagcgatggcgtcgctcaccatgatggcgtccttcgccgccgtggcggtggccgcgccctcgcgccgcggcaccttcgccgtggtctggtccgccatggtcgaccgctgccatgagcccgccacgctagcagcatgccgaggccaggcccgccgccgacggacgccgcgccgtcatgctcgcggctgctgcggcggccgtggcagccatcggcggcgccggagccgccatggcgggccccaataacgggaccacctacgcgatcaagaggtacgccgccatctgcgttcacatgcccaccgccaaggtc

SEQ ID NO: 17882 - DNA, 383 bp, Zea mays
  Clone ID: LIB189-014-Q1-E1-B9
atgccgtgcagttcttgttaaggatgatttgaggagggaacttgaattggatcctgagcttcctgcagtactgctcatgggaggtggagagggcatgggtcctgtcaaaaagactgccagagccctaggagaatcattgtttgacaaagagcttggaaaaccaattgggcagcttattgtcatttgtggccggaacaaaacgctaagctcctcactgcaggcagttgaatggaaaataccagtaaaggttaggggatttgaaacccaaatggagaagtggatgggagcttgtgattgcattataacaaaggctggaccaggtaccattgctgaagccttgataaggggtcttcctataatccttaatgacttcatacctggac

SEQ ID NO: 17883 - DNA, 68 bp, Zea mays
  Clone ID: LIB189-014-Q1-E1-C1
gcatctctgcctcgccatctgcaaccgcccaacaccgctcggcgccgccatgacgcagcgccgcaaca

SEQ ID NO: 17884 - DNA, 372 bp, Zea mays
  Clone ID: LIB189-014-Q1-E1-C10
aggacgcgtgggctacgctctaatctgtggcaactgccatatgcataacggtcttgcgaggaaagaggactttgccttcgtcacatactactgccctcactgtaatgccctcaatggatcccggcaacatgatgaccatgaattggtacctgattctggcaaggagagtcctgattctcaatctggcggaatcattggccaagctggtgcaagccttgcaacctcaggtgctgcgagtcctgttgcaagcagcctaccaacccttgaagaactctctgcagaggaagattctggggagaaggcgagcagtgaccaacctgccaattgaactcatcatttcctgtatattgtgttccttgtggagtaatggtt

SEQ ID NO: 17885 - DNA, 419 bp, Zea mays
  Clone ID: LIB189-014-Q1-E1-C12
gacgtcccaaggcagactcccaagcaattcctgtattctggtaacccgcagcacctctgccatccgtaccagtcagctccggatgcccatgtcgtgccgcagcgccgttacaccgtgaggtctcagtctcactcgccaaataatgctggttctcaagaccatgagactcacaagcagtacacgctggagtcctcggcggcttccggttgttcaaggcatggttctccctccagccaaagcgtccatgccgggagtggcagccctgtgtctcacgacgacagccactccggctccacgaacggccatggatcacctgtgagcgcgtcgtgtgtcaccggcgaggaccctactgatctcaagcagaaactgaaggatcttgaggctgtaatgctggggacgtctgagactgaccccgagat

SEQ ID NO: 17886 - DNA, 414 bp, Zea mays
  unsure at all n locations
  Clone ID: LIB189-014-Q1-E1-A7
agcacgaggccgccgagtgctccggatccgacgcgctcccggacttctcgtggcagggcgtgtcggcggcgtacgacgaggcccccgcgccgcgcccggccttcgacttcgaggcgcggccggagagcgccgcggacgaggcgtcgccccgggcctccgactccgagtcggacgcgctgttcgactcgctcctcttcggcgaccagttcgccttcttcgacgccggcgcgtacgagtcgctggacagcctgttcagcgccgacgccgtgcagagcaacgccgccgccgcggcggaccaggacatgccgctgtggagcttcgacgacggctgcctcgtcgaggacaacctctcgttttaagcctcggcgactgttgttgtgtcntgagttttgtaaattacgacctgtntttttt

SEQ ID NO: 17887 - DNA, 417 bp, Zea mays
  Clone ID: LIB189-013-Q1-E1-H12
gggtccagtcagactccgatttagcagttttctgctccagctggcttccttgaccatcctcacaggggatttgagaacgttacctatatgctcgaggctgctttcagggcggcatcagttaccacgacttttcaggccacaagggaaccatcaacccaggagacgttcagtggctgacggcggggcgcggcgtcgtgcacgcggagatgcccgccgccggccagggagtacagaggggcatcaacatctggatcaacctctctgccgccgacaagatggtggagccgacgtaccacgacctgccgagccacgacatccccgccgccgcggcggacgccgcttgcagcgtctccgtcaaggtcatcgcgggcgagtgcctcggcacgcgctccccgctccggccccgcaccccgggct

SEQ ID NO: 17888 - DNA, 386 bp, Zea mays
  Clone ID: LIB189-013-Q1-E1-H2
ccacacgtccggcctcagaggagctggcaaacgactgtgataataaaaggctaaatccaggaaatgacaattatccactttcaacagcaggtgcaaataatttgtttttgggtattgagcaaggagctggaagcagcaatggccaggctgctttttcgaaatttgactatgggagctcaatgtcattaccatctgggcagggaatgtctggtcttatcgtaaaaggggcaaaatggcgcgacggggactggttgtgcaacaactgcaacaaccacaactacgcatctcgtgcgttttgcaacaggtgcaaaactcagaaagaatctgcagttcaccctggtgtgctatagcttgcttttgctggttcatattgttggactcctttg

SEQ ID NO: 17889 - DNA, 205 bp, Zea mays
  Clone ID: LIB189-013-Q1-E1-H5
cggacgcgtgggcagttatcggagttatcggtctacatggtcctgaccagtcgtatgtctcggctgcctggtgcagctatgaaaacgttttgcaatagcttttttcggcagtcctcacatcatcacggttgtgtttccgcttccatatctgaatggaatacatatacgtatgaaataaaactgtgtaatggctgttgctcggatc

SEQ ID NO: 17890 - DNA, 389 bp, Zea mays
  Clone ID: LIB189-013-Q1-E1-H6
gacccacgcgtcaaagactacatatgggcctcggagggtctgcatactgttaaagtcttggacacatttcccatagagattttgaaaaaaacaactgggttcccgaccaagaaatggggaagcgatcacattgcccttgcctgtgaattggcttttacaaaatgacgccttttatcaggcggagagagcgcctgcatagttgctagtgaccaaacacacctcaagagaaagaatactgtctacaggacgattaactgaaccaaacctcgctcttttagagctcgttaatttatttcatttttttttcgacacacctttttgaattgtgcgtgagtatggagaaccggagtacatcacttgggtccaattttagagcattgttcctgttt

SEQ ID NO: 17891 - DNA, 300 bp, Zea mays
  Clone ID: LIB189-013-Q1-E1-H7
ctcacatggaaaaagtgaaaaactagggctacggcaattctaccggcccgccgactcctgcatcatcataaatatatatactatactatactactacgtacctaccgatatgcacccgagcaatgtgaatgcgtcgagtactatatatctgttttctgcatctacatatatataccggatcaatcgcccaatgtgaatgtaataagcaatatcattttctaccacttttcattcctaacgctgagctttttatgtactatatcttatatgatgaataataatatgaccgccttgtgatct

SEQ ID NO: 17892 - DNA, 367 bp, Zea mays
  Clone ID: LIB189-013-Q1-E1-H8
agttttggagcactgcggtggtacctcacaaagccagtgcatagtagatgagatattgcagtcggcgtgcgtccttgcgcaagatcagtatggcaactatgttacacagcatgttctagaaagaggaaatgctcatgagaggagccaaattattattaaattggctgggcaggttgttaccatgagccaaaataaatttgcatcaaatgtgatagagaagtgttttcaacatggtgatatggcggagcgggatctcttgatcaggcagattgtggagcagacagagggcaatgacaatttgctggcaatgatgaaggaccagtatgcgaattacgtggtccagaagatactcgaaacatgcaatgag

SEQ ID NO: 17893 - DNA, 286 bp, Zea mays
  unsure at all n locations
  Clone ID: LIB189-014-Q1-E1-A1
cggacgcgtgnggtccctcnaccgcaacggggattgagaaactgctgcgcctggaagaaacggcgccgagccgtggctcgtggtgctgtacgcgccctggtgcccgttctgccaggccatggaggcctcctacgtggagctggccgagaagctggcggggtccggggtgaaggtggccaagttccgcgcggacggcgagcagaagccgttcgcgcaggccgagctgcaactgcagagctttcccaccgtgcgcctgttcccgggccgcaccgccaggcccatcaag

SEQ ID NO: 17894 - DNA, 351 bp, Zea mays
  Clone ID: LIB189-014-Q1-E1-A10
actacgcttcctctttaattcagtgtgtattgcaatgttctcaacaaggtgggcaccacagtgggccctattgctacgatgatttccgggatgactaacctggataacgatgcagttaatgcactatcaattctgcttacagctgtgcttaccacttatatctgcatttacatcatttagataactcgttggttaaatcctaatttgcatcctacttttcattgcgcactgtattgccaccttaccctgcactgttcctgccaatggcatatcctgctacttctctgtgtagtggtagagtttgtattagggcatacaactgcagattcatctccagcgtgcaacgaatgg

SEQ ID NO: 17895 - DNA, 398 bp, Zea mays
  Clone ID: LIB189-014-Q1-E1-A12
accacgcgtccgcacacaccattcctgggcctgggcgacaaggccacacacgatcgccggcagtttccgaaacgagaaaaggaagaaacaggaggcgagagatcgagatcgatgagcagcggtcagtcgtcgccatgcccacatggcggcgcccggccgggagcgagcccctccaagaagctgtggcgcggggtgcaagccgtctacctcgtcctcgtcaagaagcaccagccgaagctcgccgcgttcggcgtccacatgcaccgcctcctctccagcagcaagcgccgccgccgccgccacctcgccgcgcgggggcgggagcagaacccggcgctgacgtacatgtcgtgccggtccatggaccccgctgccgcggtgggtgcaccgtaaccgca

SEQ ID NO: 17896 - DNA, 421 bp, Zea mays
  unsure at all n locations
  Clone ID: LIB189-014-Q1-E1-A2
caaaggaaattccttgaagaacaaccaaggcttcaaccgttgccccccccggcaacaaaatcctggggaacccccttgccgaacccggcccaaaaaaacgggcccaccttggcccggtccgggtccggtttgggcggcaaggcaaaccctgctccaaaaaaggtggcgaaaacatcgacctcctctgaccggcccctgtggttccccggcgccgtggcgcccgactacctggacggctcgctggtcggcgactacnggttcgacccgttcggtctcgggaagcccgtggagtacctgcagttcgagttggactcgctggaccagaacctggccaagaatgaagccggcggcatcatcggcacccggttcgagtcctccgaagtcaagtccaccccgttgcagccctacagcgaggtgttcg

SEQ ID NO: 17897 - DNA, 399 bp, Zea mays
  Clone ID: LIB189-014-Q1-E1-A4
gtcgacgcacgcgtccacggacacgtgggagctcggacaccatcgacaatgtgaaggcgaaaatccagaacaaggagggcatccccccggacaagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctccatatggaggttgtcgaagtatctgctgttcgtgtcagtgttggtttaataatggaccggttgtgttgtgtgtgcgtactacccagaactatgacaaatcatgaataagtttgttgtttgaaattaaagcctgtgctca

SEQ ID NO: 17898 - DNA, 399 bp, Zea mays
  Clone ID: LIB189-014-Q1-E1-A6
agatggcacaagccatggcgtccatgaccggcctctcgcagggcgttctgcccagcaggcgcgccgccaacagggccaggacggccgccgtcgtcagggcgtccgccgaggcgcaggcgcaggcgggccgccgcgccgtgctcgggctggtggccactggcatcgtcggcggcgccttgtcccaggcggtgcacgccgagaccgtcaagaccatcaagatcggagccccgccggcgccctccggtggactccccgggactctgaactctgaccaggccagggacttcgacctccccttgaaggagcggttctacctgcagccgctgccgccggcggaggcagttgccacggtgaagacgtctgcgcatgacatcatcaacctcaagccactcatcgaca

SEQ ID NO: 17899 - DNA, 338 bp, Zea mays
  Clone ID: LIB189-030-Q1-E1-B4
agcgggagggccccggccgctacgactgggaggcctacgccgagctcgtgcgcatggtggagcgagccggcctccgactccaggccgtcatgtccttccaccagtgcggtggcaacgtcggcgacacctgcaacatcccgttgccgccatgggtgctggaggagatgagcagcaacccggacatcgtgtacacggacaggtccggccgccggaacccctagtacatctccctcggctgcgacacgctgccggtgcttaagggccggacccccatccaggtctacaccgactacatgcgcagcttccgcgagagattccgtgactacctcggcaatgtc

SEQ ID NO: 17900 - DNA, 60 bp, Zea mays
  Clone ID: LIB189-030-Q1-E1-B5
aaaaaacataaaaaaaaaaaaaaaaaaaaaaaaaaagaaagaaaaaggaagaagatcaaa

SEQ ID NO: 17901 - DNA, 370 bp, Zea mays
  Clone ID: LIB189-030-Q1-E1-B7
accacgcgtccgctggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaag

SEQ ID NO: 17902 - DNA, 429 bp, Zea mays
  Clone ID: LIB189-030-Q1-E1-B8
tgccaacgtcgctgaccttctgtgatcattttgaagaaaaacagaactaaaagaaaggtggtgggggtgatctggtaaggcttggttttgccgaaatattgtggggggaggagtggaggagtgataaggtcggtggggtttctatgttaaagtcgtggtctcgggcaatatgcgatttttctttatgccatgttttgggaaattttgtagctgcctaggcctcgtactgttgtggtggttcattagtacgaagacgaaggctctgctggcgatgggagtcctttttctttttgttagtattttgtttaaaactatgtatgaccgaattatttgtcatccttgactcaattctgctgcaaccagttgtatcgtgccatgtgtctctgcagcaccggtcgttgctgttctgagtaaaatctgtttactctg

SEQ ID NO: 17903 - DNA, 373 bp, Zea mays
  Clone ID: LIB189-030-Q1-E1-C2
aggacacgtgggcgacgccggcatgctggcgttcgacaagatggggagctacagctacaacagcaacaacggcggcggtaataccaacaacaacagcaacggcgtggaggtgaagagctacttcaacaagtccgccgggagggcggcgaacaacaacaacaacaacagcagccacgccggcggcggcaacaagaagggcggcgccggggagtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctc

SEQ ID NO: 17904 - DNA, 424 bp, Zea mays
  unsure at all n locations
  Clone ID: LIB189-030-Q1-E1-C5
catttacgtatatgcccttgtcccggttcctttccccatccccaactccattatttgcttgatccttgagaagagagaggaagacgagagctagaagcgaaggagaaaagcagttcttcagctaggcaggagggcacaggaaggaggaaatggcgtcaaagaggattcagaaggacctcaaggttctgcagaaggaccctcccacctcgtgcattgcaggtcctgttggtgaagacatgttccactggcaggcaacaataatgggtccatctgataccccatattctggtggagttttccaagttacaatccatttccctcctgattaccctttcanaccaccaaaggtggcatttcgcactaaggtgttccatccanacatcaacagcaacgggagcatttgcctcgacatcttgaaggacca

SEQ ID NO: 17905 - DNA, 416 bp, Zea mays
  Clone ID: LIB189-030-Q1-E1-C6
gtccatcctccatcgccatccaatggccgccaccgccctgagcatgagcatcctccgcgcgccgccgccctgcttctcgtccccactcaggctcagggtcgcggttgccaagccgctggcggcccccatgcggcgccagctgctgcgcgcgcaggccacctacaacgtgaagctgatcacgccggagggggaggtggagctgcaggtgcccgacgacgtctacatcctggacttcgccgaggaggaaggcatcgacctgcccttctcctgccgtgcggggtcctgctcctcctgcgccggcaaggtcgtctctggctccgtcgaccagtccgaccagagcttcctcaacgacaaccaggtcgccgacggttgggtgctcacctgcgctgcgtaccccacctccgacgtcgtcatcg

SEQ ID NO: 17906 - DNA, 431 bp, Zea mays
  unsure at all n locations
  Clone ID: LIB189-030-Q1-E1-C7
accacgcgtccgcggacgcgtgggggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcanacctttctccctactctcagcancaacaatttcttccattcaaccaactgtcta

SEQ ID NO: 17907 - DNA, 411 bp, Zea mays
  Clone ID: LIB189-030-Q1-E1-C8
aggacgcgtgggcggacgcgtgggcggtgcgttgcgttggtggccgccggcgacgatgtcgtcgtccgcgggcgacaagaggaagaagacggcgtgcgtgaccggagggaacgggtacatcggctccgcgctcatcaagatgctgctggaggacggatacgccgtcaagacgacggtcaggaaccccgacgacatggacaagaactcccacctcaagggcctgcagcagctcgggccgctgacggttctccgcgccgacatggacgaggagggcagcttcgacgacgccgtcgccggctgcgactacgccttcctcgtcgccgccccggtgaacctctcggcacaggatccagagaatgagcagatcgagccgtccgtccgaggcacgctgaacgcgatgcggtcgtgcgc

SEQ ID NO: 17908 - DNA, 377 bp, Zea mays
  Clone ID: LIB189-030-Q1-E1-C9
ggtccacgcacgcgtccgcaccacgagtccggtgcatggcatccggctagggtctcctatacggttgcccgtgctggtcagaatgggtaccaccaccgcactgagatgaacaagaaggtgtacaagatcggcaaggctggacaagagacccacgatgcctccacagagtttgacaggactgagaaggacatcactcccatgggtggcttcccccattatggtatcgtgaagggtgactacctgatgatcaagggctgctgtgtgggaccaaagaagagggtggtgaccctccgccagtccctcctgaagcagacttcccggctggcgctggaggagatcaagctcaagttcatcgacacatcgtccaaatttgggca

SEQ ID NO: 17909 - DNA, 394 bp, Zea mays
  Clone ID: LIB189-030-Q1-E1-D11
gggtccacgcacgcgtccgcacacgagtccgcccacgcgtccgcccacgcgtcccgggcaatgcttatgtgatttggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtacctctgaaattatccctgagatggagatctgtgattttgacttcgaaccctgcggctactccatgaatgcaatccatggctctgcgttctccacgatccatgtgacgcctgaggatgggttcagctacgccagtt

SEQ ID NO: 17910 - DNA, 404 bp, Zea mays
  unsure at all n locations
  Clone ID: LIB189-030-Q1-E1-B3
gcgtccgcacacgagtccgagcttgcgcangcangtctcacggaataagacatattcatagggaaagtgatcggcaagtggatgaggttcatgaaaggccagattcagcgtgccaggctcttcgttgatgaggcggacaatggcgtcacccatctcgactctgctagcagatggccggtgctcgcgtcactgtggctgtacaagcagatccttgatgccattgatgcaaacgactacaacaacttcaccaagcgtgcgtacgtcggcaatgccaagaagctgctgtcgttaccgcttgcatatgcaatggctaccgttgcaccatgaaccatccgtagatcacatctttttttttcgtttcgtttcaaacccaccttgttttgccccaagcttccttatttttt

SEQ ID NO: 17911 - DNA, 359 bp, Zea mays
  Clone ID: LIB189-029-Q1-E1-H9
acccacgcgtccgggcagaagtgcataaattgaaggtgccgatgcttaagcaaagcagctcagtgtttatacctcggaacttagctctgtagataagaaatgcacaacattgcccatgtattccgccttttttgagaggaaagctcgtggaatctatttgattttttttctctgtactaccaattacaaagggttgtaggtggagctgtggaggccagagcgggcaaccgtgtggcttaacattctaccacgcctagcactctagcaggtttcatgaagtctactacggtggtgaatcagatcgcacaactgttgtgttgtaggagcgagtatgtgctcgttttgtcgcacaaagatgt

SEQ ID NO: 17912 - DNA, 115 bp, Zea mays
  Clone ID: LIB189-030-Q1-E1-A1
tccgcctactgcgaggccggatgggagcctttcgtggccgccggtatccggtcctccacgcatgacacgcacccgccgtaactcccacagcctgggccacaagtcccgccgtgac

SEQ ID NO: 17913 - DNA, 386 bp, Zea mays
  Clone ID: LIB189-030-Q1-E1-A10
cagacgcgtgggcggacgcgtgggtctggcttctatgggctaccgggttaggcagaacttctgacttttccaaatgaatcctggtgtatgcgagaagatttcaaaggccaagatccgcgaaaagttccctgatgaagttaccaagcacgaagcagacccttaccaccatcggtatccgcgcgcacagtcgtatcacgaccttgccgtacgcatggaacccattcattctaaaacttgaccgtgaatagaatgaccttctcatcatcgctcatgagtctgtccttcgtgtactttacgggtaactgatggcatgtaatgcggccgacatatccaagctcgagtttcctcgcgatgagatcattgagattataccctcatcctacaac

SEQ ID NO: 17914 - DNA, 259 bp, Zea mays
  Clone ID: LIB189-030-Q1-E1-A12
acgctgcagtacggtcgaaattccgggtcgaccacgccttcggaggacccttgggcggacccttgggtgtccttcccggtccggtccccaagccttagcccaatccttgggaacaacgggttattgcccgccgcggcaacaagcaacaacaagcccttaaccgggaacaacccccaccaaaagccacaattgctccggccataaaatggccagtaccatccggccaccaatttcctttgccacaaaaagataaaacccg

SEQ ID NO: 17915 - DNA, 360 bp, Zea mays
  Clone ID: LIB189-030-Q1-E1-A2
agattaggttggatttcggtcggattgtggcggtaaaggttaacctaaaatcgcagaggttatcaaaattggccttaaaattgttacccccttgatatctttggatcttctgaagtacccaaaacttaaccttgataattttgtgcgtagatcgcacttgttggaactgtacacggaaaatgttgctcacgtaaatagtgatgcttttaaatgattattggaagtcttgacttcgggctccgtaatcaggatagcgatgttgttgagaggtgcctggcacgaataaatgcacctgcttcatacaatttcaaagacggattatgacggataggaagactgaactctcagctcatggaatct

SEQ ID NO: 17916 - DNA, 387 bp, Zea mays
  Clone ID: LIB189-030-Q1-E1-A3
aaatgacatgcctctttttcaagccatagggatcttgcttgacaggaatccgcatatgaacctgcagggcctgcaatatgaagtactgcactggtgcatatgtaggctggaggcatggttcgctactgacatggacaatatatctctgaaaacttgggatcaggaacatgtgcttaccggcggacatggtcttatggtgaatggctacgaccctgtcatcagagctctcgctcaaggtctagatattcacctcaaccacagggtcacaaagatcatacaacgctataacaaggttattgtctgtgtggaagatggggcgagttttgtcgcagacgctgctatagtaaccgtccctctcggggtactcaatgcaaacatcatcaagtt

SEQ ID NO: 17917 - DNA, 203 bp, Zea mays
  Clone ID: LIB189-030-Q1-E1-A6
cccacgcatccgaggacgcgtgggcggacgcgtgggtgctgcatagagtacttctggcgaggattacgagcactcttctgaactactggataattgggatgcaatggagaacacatcatcacgtgcctagtatggagctggagcattcctcgctgtctggcttcccttggttgtagtgcgatatcacgaggccgtcgagttgc

SEQ ID NO: 17918 - DNA, 360 bp, Zea mays
  Clone ID: LIB189-030-Q1-E1-A7
acagctagttctctagtgaacagcaacctcgcttgctcatcaaggatatcatcctgttcagacttcacatatagccactcctggcgtcccatacatgctatgaaactccatcagatgcgtgctgtgagctcaatacgtataagttgtgctgccactaaacctgcaaagactcctgctgaagaagaatggaaagttaagcggcaactgctatcagaaaagcgggtacgaagtgtcgatgtgaaggaagcactgcgccttcaaaaggaaaacaactttgtcattcttgatgtcaggccagaagcagagtttaaagaggctcatccacctggcgccatcaatgttcaaatatacagattaatc

SEQ ID NO: 17919 - DNA, 328 bp, Zea mays
  unsure at all n locations
  Clone ID: LIB189-030-Q1-E1-A8
agccgtccttcgacaaggacgagctgtagactgtagtcggcgtgcgttggtctcgtcttcgggatctcttttgaagtctagctgtagctcccgtttagttgagatatcggggaactccactcactgccagctttgtgtttaggaacgtgatacgggatcgtctttctttttttttggttgcctgtctttgttactttgtacaaacttcagttcagtgactcggtctaattaccggctccgattagtgaactgtttctgtctgattagtaagctcaccgacanccatagggtggccggtggcgctccctcccttctaatttaacttgta

SEQ ID NO: 17920 - DNA, 384 bp, Zea mays
  unsure at all n locations
  Clone ID: LIB189-030-Q1-E1-A9
agcaacggtgagaggggcaagctcaagaggaaggaatcaagcaagaaggaaacaaggaaggaagcatgcacgcaatcggagcgatggagcacgggtacccctgcaacggctgcggcaaggagaagcggccgccgctcaatatgggccagctcaagctgcagatcgccaggaccctgctcagcagcctcgcggcgccggtcgccaagaaccgggaccgcggcttcgggagatagataggccgtgccgttgtancagtactacagtagtagttagctgaagacatgcgtcggccgactggtggactgtgccgtctgtgcctttgttcatcctcgtcatcctttaagaaagaacgtgttgccgtcaaaaaaaaaaaccaatccaaaa

SEQ ID NO: 17921 - DNA, 413 bp, Zea mays
  Clone ID: LIB189-030-Q1-E1-B1
cgggtcgacgcccgcgtccgaagcaaacactgcccgagacatagacagcgggacgtcgagatggccgacggggaggacgccgccgccgcgcgccgccgggccgccatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactct

SEQ ID NO: 17922 - DNA, 401 bp, Zea mays
  Clone ID: LIB189-030-Q1-E1-B10
cacacgcgtccgcggacgcgtgggctccgctcttgcctcacctcccggtccatcctcgctgctcacgcgtgcctcacctcgacagcagccttccctcgcgacagggataaggacttaaggaggcgtcgctcggtgcaaagaatccatggcatggggaggtctgttcttgtgcatgggccgccccacgcaggagcaacagaagtcctgccttgcagccgctggtggcttcaactacgacacagctctccaaggcgccacacgcccaaagtcagtgtctaccttgacctctgaacaaagctggtggcgaaaataggtgacaaggattcttacgagcgtggattctttgtgaaccgattccgtgttctggtcggctcaagttctgacgcctttgtccatgccaa

SEQ ID NO: 17923 - DNA, 419 bp, Zea mays
  Clone ID: LIB189-030-Q1-E1-B2
acctgatgcacggacttacttgaatactcttcaacagctcagaataaagagtggtcttatagatcatcttggaattgagcctttgatgatggaagctcttgagaagattgagaaggacattaagaaaccacttttgaggagcgacaagaagaacatggccaccctcttggcagagtttgacaagattaacaaaaagcttggctttcggaaggaggatcttcccaagatcgaggaagagcttgaattggaaattgccaaaagtgagctgactgaacttaagaaagaatgcgttgaaacaatggagactcaactcaagagggaggagtttcaagatgaggagatgcctgatgtcaggaaattggacatcagaaacttcctgtaggcctgatcgacgataatctttgagggccaacgcaact

SEQ ID NO: 17924 - DNA, 353 bp, Zea mays
  unsure at all n locations
  Clone ID: LIB189-029-Q1-E1-H8
ttatgttagcactaactaaccaattttgaggaatgaagtggtgatagatcaactcagtccattacactaaccatacaaatagtgggaaattagaaatggagaaaatgagggactagcctagttctcaaaccaagcaccctgttagagaaacatctcatttggggcaaacaaatagtgttactcaagcgcacacagagtagcttaaactaaacagtttcacgcaggtcttgcatccacagcttaaagactccaaagtccaaaccttcgttctcaaatgggcctaaatgggcttgaacagtntcattgcacttgataactttgtcagttagtgttcctttttttttccaatttta

SEQ ID NO: 17925 - DNA, 429 bp, Zea mays
  Clone ID: LIB189-029-Q1-E1-G10
gacgcagtcgtcttgccgccgccgtcccaaacgtccgcgcggtcgtcctcgatcttcccgtaccatcccgacgcgatggccgccggcgcgaagcccgataccgccgcgcccccgcaagcgccttcggcggcgaagggggtcttcatgcgccgcatcttccccttcctcctcgcgacgaacgtcttcatcggagtttatgtatttgccaagacctacaaaagagaccaggaaaagaaaaatgctcagactactgccgctgcagcattgtcatccccagcaagtacatctgccaaggctccagatcctgctcctgcacctgcgcccgaatcggttctcccacctctatccgaagatgagcagtggaatctgtacaaatggattctggaagaggagcggaagattaaaccacgcaacgccactgagaagaag

SEQ ID NO: 17926 - DNA, 351 bp, Zea mays
  Clone ID: LIB189-029-Q1-E1-G11
agcaaagtaaaacctgtgcatattgttgatgttcctggtcatgctaggctcaagcccaagcttgatgaagtcctgcctaaagctgctggggttgtctttattgttgatgctcaggatttcttgtctagcatgcaagctgctgcagagtacctttatgacattctgacaaaagcatctgtagttaagaaaaggatccctgtgcttatattctgcaacaagacggataaagttaccgcccactcgaaggaattcatcaagaaacagttggagaaagaattgaacaagcttcgggaatcgaggaacgccatatcttcagctgacatctccgatgaagtccagctcggggtccct

SEQ ID NO: 17927 - DNA, 407 bp, Zea mays
  Clone ID: LIB189-029-Q1-E1-G12
acccacgcgtccgcccacgcgtccgcccacgcgtccgcccacgcgtccgcccacgcgtccgctacttgcaacagcagctgcttgcatccaacccacttgctctggcgaacgtagctgcataccagcaacaacaacagctgcaacagtttatgccagtgctcagtcaactagccatggtgaaccctgccgtctacctacaactactttcatctagcccgctcgcggtgggcaatgcacctacgtacctacaacaacagttgctgcaacaaattgtaccagctctgactcagctagctgtggcaaaccctgctgcctacttacaacagttgcttccattcaaccaactggctgtgtcaaactctgctgcgtacctacaacagcgacaacagttacttaatccattggca

SEQ ID NO: 17928 - DNA, 131 bp, Zea mays
  Clone ID: LIB189-029-Q1-E1-G4
cggccaacgcttcggcggacccttggccggccccttggggaaccaaaaagtttaattaggccaatccgcaatccaaacccggatccaaggataacaattgcagaaatttgggaagatgaatggttcaaaaa

SEQ ID NO: 17929 - DNA, 437 bp, Zea mays
  unsure at all n locations
  Clone ID: LIB189-029-Q1-E1-G5
acggacgcgtgggattcgattctcactacttgtccatgctgcttaaaagaatccctctggtcctgattaattagaagctgtagttgtccttgacttgcaaccatgtatccacagatggtatatcatgcagatgttcgggcgagggagaaggagttggcggcggcggagacggagacggagaccatgggctgctgctcctgcgctcccttgggcaggatgatatccagatgtatcatcaaacgcaacgtaggaagagaacggcgcatgaggtacgacgagaggacgggaatggactatgccatggcgtacgctcccccgcagacatgctacgtgcgcccaacagacgcgcgcaccgtcaccttggccaccaccaacgcccacgccgnacatccggattcacacccacagcgagcgcacgcagcgacgaacatgccgct

SEQ ID NO: 17930 - DNA, 427 bp, Zea mays
  Clone ID: LIB189-029-Q1-E1-G8
actgaacctgttaaggtggaggaagaggtgaagccagagccacccccacagccacagggtgacttggtggatctcagagaagatactgttagtgcagatgagcaaggtaataggcttgctctagcactcttccaggggccacccgctgctggtggaaacaatggttcatgggaggctttcccttcaaatggtggcaacgaggtgacttcggcatggcagaatcctgcagctgaacctgggaaggctgattgggagcttgccctcgtagagacagcaagcaacttgtccatgcagaagccagcaatgtcaggtggtatggacccgctgctgctgaatggtatgtatgaccagggtgttgtgcgtcagcacgttagtgcacaggtgaccaccgggagtgccagcagcgtcgccctgcctgctcctggac

SEQ ID NO: 17931 - DNA, 172 bp, Zea mays
  Clone ID: LIB189-029-Q1-E1-G9
cccacgcgtccgccgcttatgctctggaaacccgttgcacctgtgtacccgcgccttgtcacgaaggtcccaggtggcttaactccagatgaggccacaaaaatgcgcacgagaggacatcagttaccaccaatttgtaaacttgggaaaaatggtgtttatgccaaccttg

SEQ ID NO: 17932 - DNA, 393 bp, Zea mays
  Clone ID: LIB189-029-Q1-E1-H2
ggccaaaattttagccacaaaggccccgactgacgccaaggttaccaaggtcaacaggcgttctggcaaggagcttgagaaagagcccaagttcttgaagaacggcgatgctggtatggtgaagatgattcccaccaagcccatggtggtggagacattctcgcagtatcctccccttggtaggtttgctgtccgcgacatgaggcagacagttgctgttggagtcatcaagagtgtggagaagaaggacccgaccggcgccaaggttaccaaggcagctgccaaaaagaaatgatgcaacctgtcgttaatcctgtatctgcttttgcaatacctgacttgtcactccatcccgaagttttgtatgcggttgttactgttattgtgtactgt

SEQ ID NO: 17933 - DNA, 380 bp, Zea mays
  Clone ID: LIB189-029-Q1-E1-H4
agcactacctaaccagattggaagggcattcgggaaaggactgggaaaaggacccaaatttcccaaaaacggggaagccgggaaggggaaaaagggtcccaataaacccaaggggggggggaacctttcccaataacccccccctgggccaattgccggccgtgacatgagggcaaacggggctgtcggagtcatcaagagtgtggagaagagggaccaactggagcaaggtgacgaaggctgctgccaagaagaaatgatctatctggctggtgacgaaggctgctgccaagaagaaatgatctatctggctggtgctgtgcttgcttgttggttacctcgtggaagcttaaaatatctcgtcctgttgacatccttgc

SEQ ID NO: 17934 - DNA, 427 bp, Zea mays
  Clone ID: LIB189-029-Q1-E1-H5
actgttaatgagaatagtaattcgcttttcttaacaataggacctggggatttcttggttcatcatgctattgctctaggtttgcatacaactacattgattttagtaaagggtgctttagatgcacgcggttccaaattaatgccggataaaaaggatttcgggtatagttttccttgcgacggcccagggcgcggcggtacttgtgatatttctgcttgggacgcgttttatttggcagttttctggatgttaaataccattggatgggttactttttattggcattggaaacacattacattatggcagggcaacgtttcacaatttaatgaatcctccacttatttgatgggatggttaagagattacctatggttaaactcttcacaacttattaatggatataatccttttgggatgaata

SEQ ID NO: 17935 - DNA, 428 bp, Zea mays
  Clone ID: LIB189-029-Q1-E1-H6
acccacgcgtccggaactctctccgcgcggtgcaagaacggtatatgaactctgataaagatgttcccccagttagaattatagttgctgatggagaagaggacgttactatcaaggttagcgatgaaggtggcgggataccaagaagcggcctcccgagaattttcacgtatctgtacagcactgcaaagaatcctcctgagctagatagacctaatactgaaggggtaactatggctgggtatggtttcgggctcccgatcagccgactctacgctcggtattttggcggcgacctgcaaatcatctcgatggaaggatacggtaccgatgcttacctccacttgtcgcggctgggagattcggaggagcccttgccttgacggcatatttttgtggacctccagtaccactcttctcctgtaact

SEQ ID NO: 17936 - DNA, 248 bp, Zea mays
  Clone ID: LIB189-029-Q1-E1-H7
acaaggatctatgtataaatatatgtgtgcgtccatatcatcatcggaccggaataaagctagcaatctctcttcttcacgatcgagagatagcgcgcgtgcgtgtaattaagtattatagatgcatgtatgatgcatgcgtgtgtgtatctatatatcatgtgatggtttgtatatgagctagctatagctagagtcgtgtaatagtatactacaaactaagctaatacaatatccaagtttgctat

SEQ ID NO: 17937 - DNA, 367 bp, Zea mays
  Clone ID: LIB189-013-Q1-E1-F4
tgttccatggatccttgaaaaaatcaagcttcttttgcaccacaaggtcaaggatgtcttgcaactgcggatcaagctgcggctgcggctcaagctgcaagtgcgggtaatatatatgataatatataagtgcaccgtgcatgattaatttctccagccttcttcttgtctagttaatttccatttatttattttttccattgcaaaacaaacaaacaaacagacaagaacaaagttaatttggatcgagtagttcaatccatttgcgcgctgtccttttcagcaagaagtaccctgacctggaggagacgagcaccgccgcgcaggccaccgtcgtcctcggcgtggccccggagaagaaggcgcg

SEQ ID NO: 17938 - DNA, 371 bp, Zea mays
  Clone ID: LIB189-013-Q1-E1-F5
aggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgaaggggtgctggacaacctgggtcgtctgagccagcagcacgggctgtcaagcaagggcgccaac

SEQ ID NO: 17939 - DNA, 367 bp, Zea mays
  Clone ID: LIB189-013-Q1-E1-F7
cccacgcgtccgcctcggaagactatagacaaatattttagtccatattttaatctcgtcatttgacaatttaggaactaaacgagactaaaataaaaagaataatatttagtccctcaaaaccaaactggccttaggaggtcctaggggtagtgcacagtcattagattcagattgagagtagaatcatataaagccagcaacccacaaccatgcttattttattctactatgttctggaggcaagggaatagaccacgcgcttgcactggttttattccatgggtttgtttgtgtctggcctgtgagtgacctgagaatgacagcatttggttggtttgtttgtcctagattcaaatcagctgtt

SEQ ID NO: 17940 - DNA, 373 bp, Zea mays
  Clone ID: LIB189-013-Q1-E1-F8
acggacgcgtgggtattattaagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgct

SEQ ID NO: 17941 - DNA, 404 bp, Zea mays
  Clone ID: LIB189-013-Q1-E1-G1
cccacgcgtccgcccacgcgtccgcggacgcgtgggggctgtgtccgtggctccattcctaaaccccgttgtggacgatggccggtgatgatggccatcgctaagatcatcttatgtcaagcactcaagccacagattgttttcttggagatccacctttaaaggccccattatttaggttgaatgtggatgacagatttatgttgttgactggatgagatgtcctagggtttcctcacgttgtagaatacaactctcacaagtataagaatctaggaacatattccttcgatgtaacatacctcttttgtttaatctgttttgtaagagaaaccagaagaacaccttgtatttcggttgatattttgaaacccacagccaattgaatgccgggttttttaggc

SEQ ID NO: 17942 - DNA, 413 bp, Zea mays
  Clone ID: LIB189-013-Q1-E1-G11
ggtccacgacgcgtccgcaccacgagtccgattccagataagcacgatccgatgatggccccaccgatatccgccgatgccttggtggaggctgcctcggccgtcgccgcgtacccagccatcgcgccgaacagaatgctttgcaaggacgcgccggcgccggccatctctgtcgtctcgaagcagacggtccggcccgccggcgcgtcggcggcggtcggcagtggagacctcaggctctcggtgtcggacatgccgatgctatcgtgccactacatccagaaggggctgttcttcccgccgcctcctcacggcgtgctggcggcctcgctggtgtcgtcgctcgtggcggcgctctcccgcgcgctcggcgtcttctccgcgctcgccggccgcctcgtcacgctccacga

SEQ ID NO: 17943 - DNA, 361 bp, Zea mays
  Clone ID: LIB189-013-Q1-E1-G4
cttcgggccaatttgcccccgtgaatataaagggaaagacttttgtgcctgggaattcaatcatggccaaaatttcccctgaactcggcctcggtcttgtaatccctggacccgtcggtgtccacaaggacatgcttctcgcggcctcaaaagcgctagctgatcaggccacacaggacaacttcaacaagggctccatcttcacacccttcaccatcatcagaaagatctctgcgcacatcgctgcagccgtggatgcaaaagcctacgagctcggtctggcgacccgtctgcatctccccagcgacctggtgaaatatgcatagaactgcatgtacactcccgtctaccgcaactaccg

SEQ ID NO: 17944 - DNA, 353 bp, Zea mays
  Clone ID: LIB189-013-Q1-E1-G5
aaaaaaaaaaaaaaaaaaaaaaaaaaaaaataaaaaaaaaaaaaaaaaaaaaaaaaaaaaaaaaaaaaaaattaaaaacaataaaaataaataatctatcaaaaaaatattactaaaaaaaaaaaatttaaaaaaatacaaaaggggggcccccccaatggtttcatcctttatttcttctttcatggaattttaaactttttttaatttttcactatttttcattacagggtctttttttttaaaacttcttgcagggaaactttttgatttttctaactttaatccctttgaataaattcccttttttcattggtgccttttttcaagacagaccaccagctttacctttt

SEQ ID NO: 17945 - DNA, 421 bp, Zea mays
  Clone ID: LIB189-013-Q1-E1-G6
agctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatccgtggacagtcggtgtcgccgggcggcggcgcgtggctgggc

SEQ ID NO: 17946 - DNA, 392 bp, Zea mays
  Clone ID: LIB189-013-Q1-E1-G7
tggtggtctataagtcaggttatggctgtttgaaatgtgatgtttgaagctgtcaaaatctggacagcaatgcttgtttgtattaactgacttcgatacacattgaatcaccttgagatgattataaatgaactgtagacaattctattagctttctaaaaagtccaggattacctgatttggatttccaaaaacccagttatgaattaatgaagttagtagtcgaattctaaccaaatctggacagaaattgcgtttagtattgtttgacatttctaaatgtcgaatctcatggtgatgataataccaaaattttagaggactttataagctttccaaaaagtcttagtttactatttttggatgaatactgtgtaagttatgaattaaac

SEQ ID NO: 17947 - DNA, 439 bp, Zea mays
  Clone ID: LIB189-013-Q1-E1-H10
ggtcgaccgacccgtccgcccacgcatccgagcttctccttctctctctctccttcctggaccattctctctatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtgtgcggcgttgttggagccttctctgtcgctcagcggcccggcgaccaaggatgatggcccgaccgcaccggtgaggaggttcgctgccgtgaagagggagctgcagacgatggaggggaacgacgacgaggccaccggcagggtacttgtctact

SEQ ID NO: 17948 - DNA, 375 bp, Zea mays
  Clone ID: LIB189-013-Q1-E1-F2
cggccaacgcttcggcccacgcttccggaaagtgcatcgtgtgagtgttgtggttcatgttcacgtcggtgtttactctccccggccatcagtgtctcattgggaacgccgcggtgccgccggtgaacgccgctgggaatgatctcgccgtggcagaccttgtttggggccggttgcgtgcgtgatctagggttggtctgctctatgagctcccaaaataaagagtgaagatttaagataaagtggttgctgaagaggagtctactccagtgcttgttcatcaagtggatggagccatctaactgatcatcgtgttagaagtatctagaacctcttctctgcaacaaaggagaagttttattcctttatcttttg

SEQ ID NO: 17949 - DNA, 415 bp, Zea mays
  Clone ID: LIB189-013-Q1-E1-D9
cggacgcatgggcggacgcgtgggcggacgcgtgggcattgctactggactctcgaattatatttcttggaatgcctattgttccagcagtaactgagcttattgctgctcaatttctatggctagactatgacgaccgcacaaaacccatttatctgtatataaactccactggaactatggacgaaaataacgagcttgttgcatctgaaactgatgcttatgcaattgctgattttatcaatcgaagtaaatccaaggtttacacaatcaatcttagcatggcatatggtcaggctgcgatgcttctttcccttggtgtcaagggcaaaagaggagtgctgccgaattcaatcactaaattgcacctgcctaaggtgcacaaatctggtggagctgccattgatatgtggat

SEQ ID NO: 17950 - DNA, 72 bp, Zea mays
  Clone ID: LIB189-013-Q1-E1-E10
gtccgcagaccagtgcgactctgctcggcctggcggctgtcttccccgtgacggctaccaccgggtatgcta

SEQ ID NO: 17951 - DNA, 388 bp, Zea mays
  Clone ID: LIB189-013-Q1-E1-E11
ggtccacgacgcgtccggaatttatacaaaagaaaatacttatgaatggtgaatccgtcaaaggccttgatgggttcaacatcaaaaaaaattacctctgcaaggtaccaaactttgatttttaaatgataaagctgagaccgggtggttgacttgcacgagaagggagtctcggtgtagtgtctccgtttgagtcgaattaaggacatgtcgatgtaggcttgatgattgaggaccttttaactggtcacatgcctcatcatggataagctttgcctcgggcagactaataccagaaaggccaacacacaatgggagtggagagatggcgagagtagcgtgtaccctccatggtaagaagctggacggtggtgtatctgtgctctcg

SEQ ID NO: 17952 - DNA, 428 bp, Zea mays
  Clone ID: LIB189-013-Q1-E1-E2
gtcgagggacgcgtcacgagttgatgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcatcatccaacatgaccccttcgaggtcctggaccagaggggagtgggcgagctggtgaagtttgctacagagaggggccgcaaagctaggcctaacttgaaagtgggcatttgtggagaacacggtggagagccttcgtctgtggccttcttcgcgaatgctgggctggattacgtttcctgctcccctttcagggttc

SEQ ID NO: 17953 - DNA, 432 bp, Zea mays
  Clone ID: LIB189-013-Q1-E1-E4
gacccaggcgtcgggaagaagacaagtgtcaagtgaacctgaaacttgcggtgtcactggctggtataccctgattgtgagtgagtgatcaagctagctgagctccgatcctcgctagctagctaggataccgccataccacaagtcttcttcacaagtttaggagtgacagcaacatgagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtcatcgggctggagaacacggag

SEQ ID NO: 17954 - DNA, 375 bp, Zea mays
  Clone ID: LIB189-013-Q1-E1-E5
gggcgcgcaggcgctggacgtcgtggaggccgtggtgcgcgagctggagacggaccccttcttcaactcggggcgcgggtccgcgctcacccgcgccggcaccgtggagatggaggccagcatcatggacggccgcggccgccgctgcggcgccgtgtccggcgtctccaccgtcaagaaccccgtgtccctggcgcgccgcgtcatggacaactcgccccactcgtacctcgccttcgacggcgccgaggagttcgcccgtgcgcagggcctggagaccgtggacaacagctacttcatcacggaggacaacgtcggcatgctcaagctcgccaaggaggccggcagcatcctgttcgactaccggatcccgct

SEQ ID NO: 17955 - DNA, 371 bp, Zea mays
  Clone ID: LIB189-013-Q1-E1-E6
actgcacgtggtctggaacatcggcggtacgctgacaatgctcggttgcgtcagtagcatcgattggctctgcacggtgcgcgtctacgaagataggaagacgtatgggctgctgatcgctgctgccctcctgcaaggcgcttcggtcggatgcctcgtcaagctcgccgtggaatttgatccaagcatcctggtgacggcattcgtggcgactgccatcgcgttcgcgtgcttcaccggcgcggccaatttggccagccgcagggattacctctacctgggtgggctgctctcgtcggggctctccatcctgctctggctgcagatagccggctccatcttcggccactccgcatccagcttcatgttcg

SEQ ID NO: 17956 - DNA, 378 bp, Zea mays
  Clone ID: LIB189-013-Q1-E1-E7
cacacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctg

SEQ ID NO: 17957 - DNA, 420 bp, Zea mays
  Clone ID: LIB189-013-Q1-E1-E8
cccacgcgtccggatcttgcttggatttgatctgacatcatcatctgatccgcgtgtcccattcttctccctcccaacggctgcagggtggtgatcagttcgctggacctctgaagcccaaggccaactgcatgcgcgcccaagccaagacgagaactgcacaaggaaaccctccaccaccatcaacacagctagcgaactgagctgcagaggggccataaaatgtaatgtaaccaacctctttcagagcttctgctgacgtgtccagttactatatacatacatacatacgttaacggtgtactgtgtgtcttgttgtaaatgtcccccctgcgaggtgttgccgattttgtaagctacgtacgtaactactacgctcggcatcagctcgtgcatgtcaccttgtgcaagtgcaacaca

SEQ ID NO: 17958 - DNA, 377 bp, Zea mays
  Clone ID: LIB189-013-Q1-E1-F1
acccacgcgtccgcccacgcgtccgggcgaggttggaggaggtcgcgggcaacatcgacaggcggaacgcggaccctgcgctgaagaaccggacggggcaggtggaggtgccctatacgctgctcaagccgacggcacagcccggactggtgctccgtggcatacccaacagcatcaccgtttgagcagcagagcgccgtcggcagctgtcagctgtgtacagtacagaataataaggtggtcgtgtttggcgctatctccaccacataaacgtgaaaatgtttttttttgaattatatggacatgcagggccgcagcccgtaagcctggccccagtttcggttttctgttttttttttttttgcctcgatctggtg

SEQ ID NO: 17959 - DNA, 373 bp, Zea mays
  Clone ID: LIB189-013-Q1-E1-F11
aaattcccaaccggcaaaggctaagcccggaagattaacttccgccaaggtgaccacggccaacaccccaaacttgggttcaacttacggaatccgcaccatcccaaccttgctcatcttcaaggccggcaaaaagaaggaaaccttcatcggcgccttcccaaattcaaggctcacaaccctcatcaacaattacatcggtagttcatgaccatgccatgccatgccatgcatacatgcatcgacgactaaccacatatgtgtatctctagtaccctttgcatacgggatatgatcaattcaagcagccagccgtctgctactgctgtgttatatataccatacctccatgtcgaatccagagtacattaat

SEQ ID NO: 17960 - DNA, 169 bp, Zea mays
  Clone ID: LIB189-013-Q1-E1-F12
gcatccgctcacgcgtcggcccagatctcagttaaaaaaaattataactattggaaataggagaccaggaaattagttaagctcgcacgcaagccatcggaaaaggcaagatgcggagcccatggggtggaggcggcctggagcacttggatctgattcccggcatccc

SEQ ID NO: 17961 - DNA, 419 bp, Zea mays
  Clone ID: LIB189-013-Q1-E1-D7
agcagcttctgcttgctctggggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgaaggggtgctggacaacctgggtcgtctgagccagcagcacgggctgtcaagcaagggcgccaacgaggtgctcctcgtcatcgagg

SEQ ID NO: 17962 - DNA, 365 bp, Zea mays
  unsure at all n locations
  Clone ID: LIB189-013-Q1-E1-C3
acccacgcgtccgatcaagcacggccgcgacaacgacaaagcgaagctgctctgtggcggtccagaaacaccttcctgggtctcttcgcacagcgacaaggcctaccacaacggctactgggtccaacccaccgtcttcacaaactgcaccgacgacatgaaaattgtgcgcgaagagatcttcggccccgtcatgtctatactcacgtataagactgttgaggaagtcgtcgagcgtgcaaacgccaccgacgtgggtctcgcggcaggtgtcttcaccaaggatcttaatctcgcgcataaagtcattgctcagcttgaagctggcatcacctgngttaacacgtggggtgagagtccggctg

SEQ ID NO: 17963 - DNA, 267 bp, Zea mays
  Clone ID: LIB189-013-Q1-E1-C5
gacccacacgtcaagtgctgctctagggcgatagcagctcagtgaggcacggtgatagaggctgcatatcatgattggagcaagatcatcaacgtgccatcggaagatcctgtcaacgcaatgcttgtttaatttcaagatcgataggatcactaggtatctacctagataaacgagattgaacaaatatcatccttgagcccggatttacatcatacaacatcatatcagtgctgtgtactcgatccacaattaatgtcgctacat

SEQ ID NO: 17964 - DNA, 122 bp, Zea mays
  Clone ID: LIB189-013-Q1-E1-C6
aaaaaaaaaaaaaaggaaaaaaaaaaaaaaaaaaaaaaaagaaaaaaaaaagaaataaaaaggttaaaaaagggatgatcatcgttgcatcggaaaggtcgtttcaacggtatgctggtttg

SEQ ID NO: 17965 - DNA, 378 bp, Zea mays
  Clone ID: LIB189-013-Q1-E1-C7
cacagatattttggtttggagcctaatcaagtgacatttttccaacagggtactattccatgtgtatctcatgatggaagatttattatggagacaccatataaggtagcaaaggctcccgatggcaatggcggagtatatgctgctctaaaatctaaaaggttgctcgatgatatggctgcaaaaggtgttaagtatgtagattgctatggagttgataatgtattggtccgtgttgcagatccaacattcctaggatacttcattgacagaggtgtatctgctgctgctaaggttgtcaggaaggcatatccacaagagaaagttggagtatttgttcagcgtggaaagggtggacccctctctgtagttgaatac

SEQ ID NO: 17966 - DNA, 387 bp, Zea mays
  Clone ID: LIB189-013-Q1-E1-C8
acccacgcgtccgcacctccaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggt

SEQ ID NO: 17967 - DNA, 373 bp, Zea mays
  Clone ID: LIB189-013-Q1-E1-C9
cacacgcatccgcggacgcgtgggcggacgcgtggggcaggatggggcaaggaagggcggtggctccgtggttgacagtggcctgcgcgtcgtgaggtatatgagcgataagtcgatggttatcgccacgatctgcattacgttgtgcttgcatgtgttgaatgggactaggctcttggtaacagcttgagagtgtacttgtttggttttcctattttttgcacattgtttgtgtaaaactgtaggactcatactgaaactgtaaatccaaaaggaatggaaatcatagacataagatcaattgtgctgtacaattctgttttatgcctatatacttgaggtctgaacgactttagtgagagagttgttgatc

SEQ ID NO: 17968 - DNA, 243 bp, Zea mays
  Clone ID: LIB189-013-Q1-E1-D11
gacgcgtccgcactccagcgcctctaccctcctcgctgcctcactccctctgaaggtcccagatccttccggttacacaaacccgccggcaccaatggcttctggtcagctcgcttgcacctacgccgccctcatcctcagcgactacggcatcgccatcaccgccgagacgatcgccaccatcgtgaatgcggctaatatcaaggtcgagtcctactggccggcgctcttcgctaagctcct

SEQ ID NO: 17969 - DNA, 411 bp, Zea mays
  Clone ID: LIB189-013-Q1-E1-D12
acctgcagcactctgttaaatttcttttgagcatggtggtctttgaagcatgacaatggctgctcttaggtttgggattgccaccatcttctgggacaaagagggagtggaggatgattgatctgtcggcagtctgatggggatgaattatacgaggtcttcaacgctgacacaaagggttaatgaaacaaactcgaatccagtgattataggcgctccgcacggaccatatgattcatctctcgttggacatgtagctacaagaatggtgtcagtgggcggttgctgccgcaactaaaagtccattcagtgtggatgtcagttgggctacgctatctaagaataaaaagtttgaggaacaacgagcatgttgccaagtagtttcttaagtataagttactgcgtctagtt

SEQ ID NO: 17970 - DNA, 378 bp, Zea mays
  Clone ID: LIB189-013-Q1-E1-D3
acggacgcgtgggtggatttctaatatatgggacaagtgattttgtaactgtacgtaaagaggtccacgttaggactcggagagtgcgattgcttggattagagggggcaggcaaaacatccctgcttaaagcaatgttaggacaagttaaagaaagaaatagcactgttcttgaatgcatacatgtcgatttgcatggcaagggaatatcaaatggattgtgctacatagattcgacaacggtaaacttgcaggagctacctttggaggttgggcggttcaaagaagaactgttgttaggactccatgatatcagcaggaagactgaccttgttattgcggtgcataacctagcacaccgaattccacagtatcaac

SEQ ID NO: 17971 - DNA, 408 bp, Zea mays
  Clone ID: LIB189-013-Q1-E1-D4
cggccaaggcgtcggcccacgcgtccgcccacgcgtccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcagcgtcgtcgagggacagctcaacccgcgccgcccgccatcgaccccaa

SEQ ID NO: 17972 - DNA, 372 bp, Zea mays
  Clone ID: LIB189-013-Q1-E1-D5
cggacgcgtgggggaagaacttttcaagaagcggacaaagacgaacaaacagttactaccatcaatcgatcacaatcacatgatggaagtaaaccctcaaacaaagatggcaacagggctgatgaaagatctggaaattacaattcagaagataggaatggtccaggtggaagctccaggaacaatcccattcaggttgatgtaaatttaacgaaaccagtaaatgtagatggcaacactggtggtgataatgcagaggctggcatgtctagaactggtgaaggaaggcaccttccaagcaatgaatctgtgtccaccaatggtaaagatttaggtgtgggttctgcagacaatgggcaacctcaacgaatc

SEQ ID NO: 17973 - DNA, 382 bp, Zea mays
  Clone ID: LIB189-013-Q1-E1-D6
cggacgcgtgggcggacgcgtgggctcgtgcgcctcgtggattcgtgggtcgcgactcgcgaccagacgacaaacgtcgagaggggccgatcgtgatcgagcagcgatgtcgacgtcgcggaggcggacactgctcaaggtcatcgtccttggcgacagcggggtcgggaagacgtcgctgatgaaccaatatgtccacaaaaagttcagtcagcagtacaaagctacaatcggtgcagatttcgtcacaaaggaggttctgatcgaagacaggctagtcacgttgcagatatgggacaccgcggggcaggagagattccagagtcttggggttgcattctacagaggggccgattgctgtgtgctcgtctatgatgttaac

SEQ ID NO: 17974 - DNA, 420 bp, Zea mays
  Clone ID: LIB189-013-Q1-E1-C11
ggtccaccacccttccggagaatgtcccggttgttaaccccaccttcaaaaccaaaaagggggcccccaataaggatatcaaaaaacctataaaggctgcttccaagggtcaactcaagggtataatgggttatgtggaggaggatctggtttctaccgacttccttggtgacagcaggtcgagcatcttcgacgccaaggccgggatcgctctgaacgaccacttcgtcaagcttgtctcgtggtacgacaacgagtggggctacagcaaccgcgtcgtcgacctgatccgccacatgttcaagacccagtacagggttttccccctgcttctcatggatggttgctgcttgtgtatgccgacaataaatgtggatgtcgccaggttcatgctgagtctggacatgttttgcacttttg

SEQ ID NO: 17975 - DNA, 353 bp, Zea mays
  unsure at all n locations
  Clone ID: LIB189-013-Q1-E1-A3
ggaaggcccccaagaaaaaggacgcccccccggctaatttcaacccccccttcaaggcgcccccggttaatggcaacttccccggttccaatccaacctcctggtggaaccccaaaaacaacaacaaggaaacaggcacccaaccggtcgatgtggtcgcgtcgtgcgactcgccggcgttggtgcccgcgtgctgatcgttgtccgcgtggggtgtggacggtgtccggtggtcacctgcttcatctgctgtgttttgttaggactggtgtacatatgaggacggatganggcggcggagggagcaccagggtaaatcaactgtcaccgccgtctacggaaccggcgaaaaa

SEQ ID NO: 17976 - DNA, 137 bp, Zea mays
  Clone ID: LIB189-013-Q1-E1-A4
gaaaaaaaaaaaaaaaaaaaaaaaaaaaaaaaaaaaaaaaaaaaaaaaaaaaaaaaaaaaaaaaaaataaaaaataaaaaaaaaaaaaaaaaaaaataaaaaaaaggggggcccccccaaaagtttcaaactttttt

SEQ ID NO: 17977 - DNA, 384 bp, Zea mays
  Clone ID: LIB189-013-Q1-E1-A5
acccaagcgtcaagaggcggggatgacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgcctctccgagctcggcgtccgccagtggcccaagtgggggtgcgagaagagcaagttcccgtggacctactccgccaaggagacgtgctacctgctgcaggggaaggtgaaggtgtaccccgaaggccacggggaggagttcgtggagatcggcgcgggagaccttgtcgtcttccccaa

SEQ ID NO: 17978 - DNA, 380 bp, Zea mays
  Clone ID: LIB189-013-Q1-E1-A6
acccacgcgtccgggatagagagggagaggagcagaagatagcagagggccagaggcgcagaaggcagtcgcggacaggaggaagaggaagaagaagcggcagcgagcgaggatgccgtgcctgaacgtgtcgaccaacgtgaacctggagggggtggacacctccgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgt

SEQ ID NO: 17979 - DNA, 331 bp, Zea mays
  Clone ID: LIB189-013-Q1-E1-A7
aaaaatgctaatgtacttgttgtgaagtaattgatttgatgtaatcacactcttggccactgtgggctgactacctctaatgtgctgaaaactaactgcatcctgtggctcagtatagtgttcgtcacaatactgtgtacaccacaactgaacatgttatcatgtggtctccgaacccaacggtgtcagtcgatctcctgcatcagctggaaggattctgtgcacgtaacgctagtccttactagttcaatggctagggaatgttgccattcacaaccttgcagatggtacagttagctgtcatacgacgttcacatgaaccatcatttgt

SEQ ID NO: 17980 - DNA, 369 bp, Zea mays
  Clone ID: LIB189-013-Q1-E1-A8
ccggcttcttcggcctccagtcgaacacgctgcagagctaccccgcggagctgacgctggcgacgctgatctgcttcctgggctcggtgctgaccggcggggtggcgctggtggcggagcgccacgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggtcctcggctccaccatactcaaagaggagaccaccttgggaagcgtgatcggcgcggcgatcatagtggtggggctct

SEQ ID NO: 17981 - DNA, 393 bp, Zea mays
  Clone ID: LIB189-013-Q1-E1-B12
gcgtccgcacacgcatccgcccacgcgtccgcccacgcgtccgggagagcagagagagcgggagatcatggagctctgcgtctctaccactgcctccgtccgcgccaccgccgcgcccatatccttcgccccgccccggcgaggcgcgtctgcttccaccgccctcccgctccaccgccgaatcccaactcgaggctggtgttgcgccagcgcggccgtgcctgacccggcgccctccgaagagctcgcatccgcctcctacaccgtcgtcgtcgcggacaagcccgattcgcctgccgatgacaaggtcgacgaggttagcgccgcgcctagtggctccgcggaggcgcccgtatcagaaccggtgtcatcagaggcgtccccgtccccgtc

SEQ ID NO: 17982 - DNA, 380 bp, Zea mays
  Clone ID: LIB189-013-Q1-E1-B2
acgttcaccaaaagctgctactcatcccacctttgccacttccgtgaaaaagcccattggcgcaaagaaggttggaggcaaaactggagggcttggtgttcgtaaactcacaacaaagccaaatgaaagcctgtatgagcagaaaccagaagagccaaaacctgctatacctgccttgactgctccaactgcaaaaggtggtccatccttgcattcacgttttgaatatgtggataacgaacaatcatctgtttcaagaaccgggggatctggatctcgtgtaaccggtcatgtagcaccaccaaaatcatctgacttcttccaagagtatgggatgggtaatggattccaaaagaaatcaagcaacgcctcaaaagctc

SEQ ID NO: 17983 - DNA, 356 bp, Zea mays
  Clone ID: LIB189-013-Q1-E1-B5
cccacgcgtccgactcgatctcgcacctagggtttcgtctcgtcgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacga

SEQ ID NO: 17984 - DNA, 380 bp, Zea mays
  Clone ID: LIB189-013-Q1-E1-B6
agccagggtccggcgtggtgagccagcccatcgtgctggtgggagggctgtggattccgcaggagcaaagcagctcgcagtccgggtctccccacggcccgctccacttctccacctcaggcatcgcagtctcgtcggcggccaccgtcagctgcgaggaggaagacggacggtccgagagctatggctggaaatgatggagaggctgctgctgctgctgctgctgagaggggagctgcagcctcaggaacgggaatcatcaggagggaaactgagagtagtgtagctgtctgtacacatacatagttacattacattacatacagggagtgagggagatcgggccttgagcgctcgagaccaaactgatgcttcgggtt

SEQ ID NO: 17985 - DNA, 372 bp, Zea mays
  Clone ID: LIB189-013-Q1-E1-B7
agcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccc

SEQ ID NO: 17986 - DNA, 375 bp, Zea mays
  unsure at all n locations
  Clone ID: LIB189-013-Q1-E1-B8
acagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaacaaaggtagctagctagccgcgactcgttggctagacgattcaagcagcagcgcaagatggtggcgccggtggtgattgcgtcggccgggctgggcatgctggccggcgtggcgatggccaaccggtcnctcgggaacgggctctcggcggcctccaggtgggacgcgcgcncgcgctgcgccacgtg

SEQ ID NO: 17987 - DNA, 394 bp, Zea mays
  unsure at all n locations
  Clone ID: LIB189-013-Q1-E1-B9
gtccacgcgacccgtccggatttggtaaagaaagcaggaggaagccggcggtgtaggcgacccatggctccacagacgaggagagagaggttggcgggggaggcgcggccgagctcgtcggggctaacaccggcgaagccgggggcggtcgaggtgcagcgccgacgggtgggcagcggttggacgagccgtcggatctccatctacgcctcccgagtctacttcctcctcatcatgctccagatcccgctcttcagggtcccttgtanagctggcacatgcacaactcctattcaagtaacatcatctcagttggtctcaaatgatatattcccagcagctgttgtgaaggccatgctctaccctggagctaccgtgagcagcctaactaaaa

SEQ ID NO: 17988 - DNA, 392 bp, Zea mays
  Clone ID: LIB189-012-Q1-E1-G5
agcagttggcagctgcaagtgctgctgcagctgttacgccaagagctgtccctcaagctcggaaagcgtcgctcgcccggttcttggagaagcgaaaggaaaggtatggactgtgccttggtatactttctatggtgtatatgctctgctcaagcttgttgtcgtcgacatctgaccgatccctgcgtcaggacactagtcttcatcctccttgtttctctccgcagagtggctagcgtcgagccatacctgacgtccaactccaagagcccgctagagagcagtgacgccgtcggcagcgctagcgctccaacgaaatcgtcatccacagacgtcgccccggcgagcagccaaaacggcggcggcgcaaagcttgtgcgccatggcggata

SEQ ID NO: 17989 - DNA, 208 bp, Zea mays
  Clone ID: LIB189-012-Q1-E1-G6
atccgggtcacacacgcgtccgatcaggcttgaattgcaaaaacttgaggaggagaggaaaaggtctatgctggagcgagagagaagagaggaagagctgtctgaaacaaagaaaactatagacgcgcttaatgggccacgcgagaaatttccagaagcaagaaaactggcttcattcaaaccgaaattcatttaccaaccaattgca

SEQ ID NO: 17990 - DNA, 221 bp, Zea mays
  Clone ID: LIB189-012-Q1-E1-G7
acaagcgtgctctgggggcacccactgaggcgtctacgaaaggacgcgcatgcaaccgtgcttgccatgaagtatttcgtagtactcttctgcgctagcttcgtttactttcgagtaaagaataaggtgtcccttgtttcaataatgattctgcatgtaattacattccatggcacggccattccggcaacaggctcagtaaaaatatcttttttagtgcc

SEQ ID NO: 17991 - DNA, 414 bp, Zea mays
  Clone ID: LIB189-012-Q1-E1-G9
aaagcacttcgacgtcgcacgggcgctgcacacagacacaccaagcgtcggcaccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcacggagagcttcctcgccagggctaactgagccgcccggcagccggcatccacgcccgttcgtgcctgcctgcgtgccttatgtatgtctgtggttgactggt

SEQ ID NO: 17992 - DNA, 69 bp, Zea mays
  Clone ID: LIB189-012-Q1-E1-H1
ccacgcgcccggacacgcggcaatgaagccattcactaacgagttcgagaactagtacgagatcctgca

SEQ ID NO: 17993 - DNA, 422 bp, Zea mays
  Clone ID: LIB189-012-Q1-E1-H10
aggctgttgataaggaccttgaggacgaagtcatggaaattccagtcgtctcaactagtgttgcctatggtgtatacatgtccatttctagtaacctcaggtatcagcttctggctggtgtgatcgagcagaggatgctggagccgttgctgcataaccagaagctactgctgagtgcaatgtgcttcatcgttcgtacgggcaacacattccttggctctttgctgtgggttgactatgccagatggataggcgtccagaagtctcacgaagaggcctaaagttctagcagcttgcctgcatgttccgctgtcactgcctcactaggcacgttcacaataccatcgatggcttgcctgcctctatagaatgctgatctactcttcactggaagcccccttatatataggacaaaaatccca

SEQ ID NO: 17994 - DNA, 381 bp, Zea mays
  Clone ID: LIB189-012-Q1-E1-H12
atgattattgaactatcattaatgaaatttaactttaatttgttacaaatgccaaatgcaaactcctttgtttaaatatactgggtaattcttgtagttatgttgttttgtaggtacctatagcatattggcgaccatgtcatcccgtaaatgtcagcaaagtaggtgagccgtcaaaacacgctcttaaacaaggcagctactagttactccgatttattagttatgttcggtttgtattaatgtaaggctcttaaatatgaaagacatggtacggtaacaccgattattagggtatgtacaatcctgatattgttgtatgatactttaagtataagacacaactaaaacacaatataatacagtaacaaaataaatgct

SEQ ID NO: 17995 - DNA, 142 bp, Zea mays
  Clone ID: LIB189-012-Q1-E1-H2
atccaggggtcaggacagcttgcaaaatataatggatgagatagctaaagaggacaaggaaaaggagaagaggcacaaacgtcgaactgtggttaaagaggagagacgtaaatcaggcccacctcgtctgggcagacacaaa

SEQ ID NO: 17996 - DNA, 118 bp, Zea mays
  Clone ID: LIB189-012-Q1-E1-H3
ccacgcgtccgaaaaacatgcaaaataaaaaataaaaaaataaataaaaaaaaaaatgaaaataaaaaaaaggcaaaacaattaaattaaaaaataaaaaagagggaaatgaatcaag

SEQ ID NO: 17997 - DNA, 252 bp, Zea mays
  Clone ID: LIB189-012-Q1-E1-H4
gtgggcggacgcgtgggcccacgcttccggtcctacctgacacccggctcgtcggctctgtacctcttcctgtatgcagcattctatttcttcacgaaactgcagatcacgaaggcggtctccggcgtgctctacttcggctacatgctcatcgcggcttatgccttctttgtactcaccggcaccattggcttttatgcctgcttctggttcaccaagcttatatactcttcggtgaagattgactaggaa

SEQ ID NO: 17998 - DNA, 382 bp, Zea mays
  Clone ID: LIB189-012-Q1-E1-H5
accacgcgtccggggaggcagctggggaggaggcgcagcagctgaccatcttctacggcggaaaagtggtcgtcttcgacaggttcccctccgccaaggtcaaggacctgctgcagatcgtgagcccgccgggggccgacgccgtggtggacggtgccggtgccggtgccggtgccgctgtccctacgcagaacctgcctaggccttcacacgacagtctctctgccgatctgccgatcgcgaggcggaactcgctgcacaggttcctcgagaagagaaaggacaggataaccgcaaaggcgccgtaccaagtcaacagttccgtcggcgctgaggcgtccaaggcggagaaaccctggctgggtcctgggcaaggaacagg

SEQ ID NO: 17999 - DNA, 286 bp, Zea mays
  Clone ID: LIB189-012-Q1-E1-H6
tccgggtcgacaacgcgtccgaccacgcgtccggacacgtcttctctccggttgcgacttgcgagcacggtcggaagagctagggtttcgccgcagcgagatgtctgcgtacgacgaggtggagatcgatgacatggattgtgaacccgagctgaaggcgtacacttttccgttgccccggggccaactcctccagatcacgctcgacgacctccgcctcggggaggagattgcgcgctgcccctcgtgctccctctttcttaacgtcgtccacaacgccgaggat

SEQ ID NO: 18000 - DNA, 466 bp, Zea mays
  Clone ID: LIB189-012-Q1-E1-H8
cgcgtccgatggagtagtggtaggaaaagctcgtcgccgagtcgccgtacgggggctccggtccggttaaccaaccggcggccggcggttactgaggcctgagggcgaggcgatgggccgcctccgtgacgggcgagccttcctccaccgcgcgcttgtcctctcgtcgctgctccttctcgcctccggcgaaatcttcttcgaggaacggttcgatgatgggtgggatagccgctgggtgaaatctgattggaagaagagccaaggacaagctggaaccttccgacacacagcgggaacctactctggagaccctgacgataaaggtatacaaacaactggggatgccaaacattttgctatatcagcaaaattcccacaatttagtaacaaggatcggacattggttatccagtactctctaaagatgaacaagatattgaatgccgtggtgcttacatcaaac

SEQ ID NO: 18001 - DNA, 276 bp, Zea mays
  Clone ID: LIB189-013-Q1-E1-A1
cccacgcgtccggcgaactttgacaccctggcaatggtgtttaacaggtcgagcagatttggaaggctgcagggagtgaagtgtgcgattgcagggaggaacctttacatgaggttcagctgcagcacaggggatgccatggggatgaacatggtctccaaaggtgtacagaacgtgctggactacctccaggctgacttccctgatatggatgtcatcagcatatcaggtaacttctgttctgacaagaagtcagctgctgtgaactggatcgat

SEQ ID NO: 18002 - DNA, 396 bp, Zea mays
  unsure at all n locations
  Clone ID: LIB189-013-Q1-E1-A10
ggtccacgacgcgtccgaaaagaacagaggttgctgaagacttagtgctcganaaaaaaaccttgcccccggggtgttccggtgaatggttttggatccaagcccgaaggcctaatccaaaatgggttcttaagcattccgaattggaatgggcctcccccgaaaaggtggaaaaaaagcaatgagatcgaacacagtaattacataaggttataactggcgcatttcctgacaacgtgggtaaaaaacttattggccttgttacaagtagagatgaaatcgctgatttactaaagcttgatgatgtcattgatcttgtcattccaagaggcagcaataagctggtttcgcanatcanagcatcaactaagatacctgtcctcggtcatgcggatg

SEQ ID NO: 18003 - DNA, 356 bp, Zea mays
  unsure at all n locations
  Clone ID: LIB189-013-Q1-E1-A11
acccgtccgcgtgcacatcggcgccgacctcgagatgccctccgccaacgctaagctcggcggcatgcagtacccatggccgtccctcgctgctcatgttgttgggcaataatctacccatacagtattattcttgggggcttaccgggaaatttgagaatcatcatcaatgtattataatcgtctcattaggtangatgactggatgatgacgaatagtcaactagtcttcgtctcctgtcttttttttttattctgtgcgggatactgaatgtggagtataattatgtttgcaacagattaaaccacatatgaatatcaattgcaagttgcactgcaaaaaacaaaacacaaac

SEQ ID NO: 18004 - DNA, 65 bp, Zea mays
  Clone ID: LIB189-013-Q1-E1-A12
ctccgccaacgataatctccgctgcatgctctatccatggttgttcctcgctgctcatgattgtt

SEQ ID NO: 18005 - DNA, 416 bp, Zea mays
  unsure at all n locations
  Clone ID: LIB189-012-Q1-E1-E2
ccgggatcaccacgcgtccggacgcgctggcacagctcaacatcaaaacgggggtgcccatcaacgaaataaacccgctccgtcatccttcaacgtcctcttcttcttcatcgccgccatcaaccccggcaatggcaggttcatcatcggcgaggaagaggaataggctgctggcctcggacatgagtcgtgtgcgtttacttttacctgtgactgtgagtgatcgatcgattgctgtgtatcaattactcgtgatgagacctcgaaggtanggtgtcgcgttgggcggatggcgcagctgggcgtggccttctccatcatcggcgagatcatcacggngaagggcgcgctggcgcagctcaacatcgagacgggggtgcccatcaacgagatagagccgctcgtcatcttcaacg

SEQ ID NO: 18006 - DNA, 380 bp, Zea mays
  Clone ID: LIB189-012-Q1-E1-E3
cccacgcgcccgatatcctcttatctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgaccgcggacgtgcgggcgaaccgtcgagaggcacgccaacgccgtctcggcggcggcggtcgacaaggccaagcgcgtctgcgcggaccacccgcacg

SEQ ID NO: 18007 - DNA, 377 bp, Zea mays
  Clone ID: LIB189-012-Q1-E1-E5
acatcaaggccatcgacaagcttcctcttctgcctggtgtccttgagattgttggaattgggtatacagggaggctctgatcggcaaaatcaagagcacttacaaagaaatcaccgggagcagcaactgatcgaacatcatttacaagatgggttcttaagcatatggtagaattgcatccgtaagcactgaagctgccatgcaagtgaaagtgcttctggtcccgacctcagtcagagaaaaaaaactctgcagttgagcaagccgttttactttgtttcagtgtaatatttatgacgtattcccagttctttttcaaaaaaaaaaaaaaaaaaaaaaaaaacaaaaaaaataaaaaaaaggggggacacactaaa

SEQ ID NO: 18008 - DNA, 423 bp, Zea mays
  Clone ID: LIB189-012-Q1-E1-E6
cattcagttgataaggagaaggtatttttcgaatgagcttcctgcccctagcccatggtcactcactcccagggaagataccattcttcccgtagaaactgtgaacgatgatgacatgttccaaagaaaaagctacggcggacagagctacaaatacaatggggttaccccactgcctgcacagcggaacctaactccgccccccacactctatccacagcagccaatgtcctcttcatcagaaaactacagataccacagattttcctcttcgtcaatacctgattcaagtggtggttcaaaaagccgagcgaaccttaatatatgatgggatatgtaagtccttatccattatcacctggagtgtgggaaaaaaacatgacaactggggttttttgggtctcacggtttttgatccttttt

SEQ ID NO: 18009 - DNA, 432 bp, Zea mays
  Clone ID: LIB189-012-Q1-E1-E7
gtggggctggtgagaaacgtggagacgatggttcagattatactatatttgttggggacttggcctcggatgttacagatttcattctacaagatacgttcaagagtcgttatccatcagttaagggtgcaaaagttgtctttgacagaactactggccgttcgaaaggctatggttttgtaaagtttgcagattcggatgaacagacacgggcaatgactgaaatgaatggacaatactgttctagcagggccatgcgccttggaccagcatcgagcaggaagaatactggtggaccacaaccatcgagtgctatttaccagaacacccaaggaactgattctgatagcgatccgaacaatactactgtatttgttggcggccttgacccgagtgtgactgacgagcttctgaagcaaactttcagtccat

SEQ ID NO: 18010 - DNA, 434 bp, Zea mays
  Clone ID: LIB189-012-Q1-E1-E9
cccacgcgtccgagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcaggagctacctcatcgccatcagcggcgagaagaagcccgccatgagggagatcatcatcgacgtcgagctcgccacccgcctcctccccagggggttcatctggcccgtcgccgcctaccgcgagctcatcaacggggacctcgtcgtcgacgacaaggacatcggctactactagctgcgcttgttcacctgcttgcactgtgcatatatattgctgctgccgagctgggcgcttggatagtacgtggggaaacatggatggctt

SEQ ID NO: 18011 - DNA, 405 bp, Zea mays
  unsure at all n locations
  Clone ID: LIB189-012-Q1-E1-F1
cccacgcgtcagacctcctctgctctcccccacctcccggtccggcagcagagagcgggggtgcagagagatcgagatccggaggccgcgagtgggagcgccaccaccagcgtctgcggcaatggcgggcacggtgacggtcccggggtcgtcgaccccctccacgccgctgctcaaggacgagctcgacatcgtgatcccgacgatccgcaacctcgacttcctggagatgtggcggcccttcttccagccctaccacctcatcatcgtgcacgacggcgacccgacaagaccatcaacgtgcccganggcttcgactacgagctctacaaccgcaacgacatcaaccgcatcctcgggcccaaagcctcctgcatctccttcaaggactccgcctgccgctgc

SEQ ID NO: 18012 - DNA, 416 bp, Zea mays
  Clone ID: LIB189-012-Q1-E1-F12
aggacgcgtgggtccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccaggggaatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgccgggga

SEQ ID NO: 18013 - DNA, 274 bp, Zea mays
  Clone ID: LIB189-012-Q1-E1-F2
cccacgcgtccgcacacgcgtccacggacgcgtgggggctatcagaggaagatatttcttactatgcagaaaaatttgcaaaatcaggctttactggaggacttaactactacaggtgcatagacaggagttgggagctttctgcggcatggactggagctccgataaaagttccgtcgaaattcattgttggggaccttgacattacatacaacgccccgggggtaccggactacattcacaagggtggcttcaaggcaagcgtgccaaatct

SEQ ID NO: 18014 - DNA, 394 bp, Zea mays
  unsure at all n locations
  Clone ID: LIB189-012-Q1-E1-F4
accacgcgtccgcagacgcgtggacgcgtgccatcctagggtttctttccccgtcggcgcctcnccagatttggccgccgccgccgctgacccaggttgtcttgatggcgcccgctgtagaagccgtgaaggagacaggcaccttccagaaagttcctgccttgaacgaaaggatactgtcatccatgtccaggaggtctgttgctgcacacccttggcatgatctggagataggtcctggtgctccaaccatattcaactgcgtcattgagataccaaggggcagcaagggtataatatgaacttggaggggaagactggactgattcaagtggaccgtgtgctgtattcaacagttgtttaccctcacaacaatggattcattcctcgcacg

SEQ ID NO: 18015 - DNA, 255 bp, Zea mays
  Clone ID: LIB189-012-Q1-E1-F5
tccgacacggttctgttactaacatgtttacttccattgtgggtaacgtatttggattctaagccttacgcgctctacatttggaggatatacgacttccccctgcgtagtcacgaactttctaaggtcctcctcacggtatccaagttgacagggataagttgaacaagtacggtcgtcctttactatgatatactactaaaccataaataggattatccgcatcacacttactgtacagcgtattatcattgt

SEQ ID NO: 18016 - DNA, 231 bp, Zea mays
  Clone ID: LIB189-012-Q1-E1-F6
acgagctcttccacacccgccctctctcttgtgggtcggcggccgagtgtctgcgtcgtccacggagatcagggatcggcggcggggtatggcaagggagcgtcgggagataaagaggatagagagcgcggcggcacggcaggtcacgttctccaagcgccgccgcggcctctacaagaaggctgaggagctctccgtgctgtgcgatgccgatgtcgcgcacagcgtctt

SEQ ID NO: 18017 - DNA, 315 bp, Zea mays
  Clone ID: LIB189-012-Q1-E1-F7
aggacgcgtgggcgagactcaagatgaagatgaggtatattggctccaattcgggagatactttgcacgagggccagtggaaagagatgattacgcgctagaacttgcaatgggagacgaatgagctgtgcctaagagaccttgccatctaaaatttgaataccatctcaaatttggacccatgtagttctgagtatgccggttatctttttgtggctccaaatctcactctcagccttctttccttcggctgttagcgtttagagtgacaaggacacttcctgagaggaggaataaagttctgctctgctctct

SEQ ID NO: 18018 - DNA, 427 bp, Zea mays
  Clone ID: LIB189-012-Q1-E1-F9
agcagcacgaggaactcgttggtggcatcgagcgagcggtgcgagtggcacgagtgcgtgcgcgagcaagatcggagcttttccttcgtcgcagttgtggggaacgcggcgagcgcttccgtgatgggcgccggcgcccaggaggatgaggaggagataaccacggtggccgagggaggagtcggagaggaggagcaagcggcggctgagggcgcaggggaggaggagcagttggagcagggtgcagggggcgagggagagggtggggaggagaaagctccggcggtgatgttgtgctcgatctgcctcgacacagtggtcgccggaggcgaggagaggtccaccgcgaggctgcagtgcggtcacgaatttcacctcgattgcattggttcagcatttaatgccaaaggaatcatgcaatgcccca

SEQ ID NO: 18019 - DNA, 413 bp, Zea mays
  Clone ID: LIB189-012-Q1-E1-G12
gtgatcgcggccatcgttcgccgatggtctgcgtcgtcttcactcgtcagggaaccggctgtgacggcttggttctaacaggcgccgatggaggccatggagctcgtcgtcgcgctcaccgcctgcgccgactccgtcgcagcctgcaaccacgacgtcgccaactactacctcgtgcggctgggcgagatggcctcccccgcggggcccacgctgatgcaccgcgtggccgcctacttcgtggaggtgctcacgctgcgcatggtgcgcatgtggcccagtcgagatctggtcattagattcaatagtgtggtactggtggcatgtggcccagccgagatctgacagttcttagaaaaattcagctttcatttccaatcgttacagctttaaactattatgatcgttacttt

SEQ ID NO: 18020 - DNA, 150 bp, Zea mays
  Clone ID: LIB189-012-Q1-E1-E12
cagggccgccttcgcgcgctccctcgcggcgtcgctctcctactggaagtccgtggggaaaaaaagggtgtggttgaaattaacggtggatttaaccgaattcgtccctttaacaattaaagaaagcttcaagttccaacaagccgaaga

SEQ ID NO: 18021 - DNA, 398 bp, Zea mays
  Clone ID: LIB189-012-Q1-E1-C7
gttgattctgtagataaaccccccatatctgtattgttaactttttaaaatttgtatcgtggtagattgatagtgaccctaaagcttgcggtctcatccttcaaattgtggtcataaggacatcatcgattttttaaacttatcaagaacatatgaattcaaaatggggcagttctcagtgtgcagaaggcgagctcgtcctcttccttaatgaggttcttaagagtgtttcctcagctgtattggttacccttactactttggattttggaaacagtccgagacccttattagttaacaatatcatagttgttgcaaagatactctactttttttcatcatctcttctttaacattcatatctcccagttgttgcaaggggaaaataaccccagtaa

SEQ ID NO: 18022 - DNA, 236 bp, Zea mays
  Clone ID: LIB189-012-Q1-E1-C8
cggacgcgtgggctgtcgttgtgagaattcttaattcatgagttgtacggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaaacaggagctgcagtagctgcgg

SEQ ID NO: 18023 - DNA, 434 bp, Zea mays
  Clone ID: LIB189-012-Q1-E1-C9
accacgcgtccgcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggacgagggcaccccgttccgtgtcaaggtgatgaa

SEQ ID NO: 18024 - DNA, 260 bp, Zea mays
  Clone ID: LIB189-012-Q1-E1-D1
acgcgtggaccgctcacctacaacctactagaaggcgaacacaaccgtacattcacttctcatcgcatccgtacgacacgcgcaggatcagtacagaccgaggcgcccgcggttcagcattccttccatgcaccgtacaagagacaatttgctggagtcttcgacacgatcagggttccgatggcccagcaatggatgatcctgccgttcctcgggccggtagaacctgcggtggctgctctggtcacgctcccggtgcc

SEQ ID NO: 18025 - DNA, 430 bp, Zea mays
  Clone ID: LIB189-012-Q1-E1-D10
gctactttggttatgtcaactgtggttaagaatggtggacttgcacctggtggcttcaactttgacgccaaattgcggagggaaagcactgatgttgaggacttgtttcttgctcatatctccggaatggacaccctggcccgtggcctccgcaacgccgccaagctgatcgaggatggttccctagatgctctcgtccgcaagcggtaccggagctttgatagtgagatgggtgccttgatcgaggctgggaaaggagactttgaggcgctggagaagaaggtccttgagtggggtgagcccactgttccgtccggcaagcaggaactggcggagattctgttccactctgctctatagatggcgccatgtccgtagcggtagctcctggaataagcaagcactgagcctgcgcccctcctaacgcgcg

SEQ ID NO: 18026 - DNA, 424 bp, Zea mays
  Clone ID: LIB189-012-Q1-E1-D11
cggacgcgtgggaactaccttcgccgctctccttgatccgcaattttctcccacatctctcttctgcccacttgcctccatcttggcctccccctccactccccacccccgaacatccggcgccgtccacacccttgcaccccgactcccctcgtccttcgtggccacgatgggggcgtccatggcatcgccttaggggcgatcgatctgggagaaagtgctggagcacgtggcgtcgtaccaccagcagcaacggaggcagaagctacgcaagagcctcacctacaccggcagtgagttctcgttcgctgtccggggtcgtggggacgaccccgcctccacgtccgttggggcacagaacgaggacatgcctcttgagcacgtctttaaaatcattagatccgatggcaaaagtgtgtgttta

SEQ ID NO: 18027 - DNA, 401 bp, Zea mays
  unsure at all n locations
  Clone ID: LIB189-012-Q1-E1-D12
gaactcgtcagatatgttagcatgtggagaggaccttggccttatccctgcttgtgttcaccctgttatgcaagaactggggttgattggattgcgtatccaaagaatgcctagtgagccaaacttggaatttggtattccttctcagtatagctatatgacggtttgtgctccctcatgtcatgactgctctacattacgtgcttggtgggaagaagatgaaggaagaagaagtcgtttctacaagactgtagttggcagtgatgaggaggccccatctcgttgcaccccggaagtagtgcacttcattgttcagcagcattttgacgctccatcaatgtgggcaatctttccacttcaggacctccttgcactgaaagacaagtacnacacaagaccag

SEQ ID NO: 18028 - DNA, 429 bp, Zea mays
  Clone ID: LIB189-012-Q1-E1-D2
ttccgggaccacccacgcgtccgcaggacgcgtgggggcccgtgtccccgccacaaggaggagcgtccgtgtagctgccgtcgtcgcgaccgaggccgcgcagatcgactacagctcaagcgtctcgtacgtgttccctggccttgatcaacaaacaaccagtcggtgtagagctaagttctggatggtatggttagaatttgggtcggtgacactgacacgcatgttggtgacgctgcagggtgttcccgatggaggcctgcgacctgcttggtggcgacgcgtgcaacgggcccatgtgcccggagggcaagcccgcctcgggggcggcggcggcgagcaggagtgtggtcggggtggacagggactacctgtcctacgacgagccaaagacgtaagcagcagctagcaactaccataggataaccc

SEQ ID NO: 18029 - DNA, 431 bp, Zea mays
  unsure at all n locations
  Clone ID: LIB189-012-Q1-E1-D3
ttccgggaccacccacgcgtccggcacagtccaatattgccgtctcccttttgcgtgagcaaagaaagagagcgagaagagcagtcgccatgtctggcatcatccacaagatcgaggagaagctccacatggggggcgaccacaagaaggaggatgagcaccacaagaaggccgaggagcaccacaagaaggaggagggggagcaccacaagaaggacggcggggagcataaggaaggcatcgtggagaagatcaaggacaagatcaccggcgagcacggcgacaagtccggcgaccacaaggaaaagaaggacaggaaaaagaagaaggagaagaagaagcacggcgagggccacgaccacgacggcggccacagtagcagcagcagcgacagcgactgagatctggtgtcgcagcaaangtgcaacaca

SEQ ID NO: 18030 - DNA, 440 bp, Zea mays
  Clone ID: LIB189-012-Q1-E1-D5
cggacgcgtgggcggacgcgtgggcggcggcgacgagaagtggcgagccccgagagcgggtttagttagaggctacgggcggtcgggcgcggcggcggcggcggccatgagcagcgggagcgagagcactaccgccagcaggtggctcgagctggccacgctgcgcgcgctggcgcgcgacgccgcggagcagcttcggctgccgcgggccggcacgtcggcgtcggcgtcgtcgtcgtcgccgtggcgcgggcgcgaggaccacctccacggccacggcaagacggccaaggtgatgcacctgctgctctggggacccaagtgaagcggcggcgagaggccaccgtaccgccgggctctcccgccggcgttgctcgttttgctctgcctgcaatccgccccgcacggactgtactgtacctatacacctatatactacg

SEQ ID NO: 18031 - DNA, 265 bp, Zea mays
  Clone ID: LIB189-012-Q1-E1-D6
gccctacagaggaaaccagaacctccccacaaaggcaaacggcgaggtcgagactgaaccttccggcccactcgctgtgctcaagggcttcaagaacttgcccacggggatgccgtccgtgctcctcgtaactggactcacctggctctccttggttcccgttcatcctctacgacaccgactgaatggcccttaaattcaacaacggcaaccccaaggttacaaacccccaattcccggctttcaacaaaggcttcaaatttgg

SEQ ID NO: 18032 - DNA, 365 bp, Zea mays
  Clone ID: LIB189-012-Q1-E1-D7
gaatcatcatcagtgcctcatgcatcatatgctactgagagactgaaaaaatatctttgttcccctgtgctagagaacatgtattggcaggctttcacttcctatcacgaaccattgttgagtaggtcggactgataactagagtttcttcttcagggctccgttgtattgttttgctcttatcttatcttgggtggtgtggcaaagaatttgttgttgtaacggttgatgcagctagagttggcagcgacattttctgtaagagcacacggcagggacgttaattaaatatattcctctgtagcggttgatggaaaaaaaacaagatacaggacagaataacataagcggcggcagccacaaaa

SEQ ID NO: 18033 - DNA, 447 bp, Zea mays
  unsure at all n locations
  Clone ID: LIB189-012-Q1-E1-D8
cccacgcgtccgcccacgcgtccgcaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggccgggctgaagctggaggcgcgcgactccggcctgcagacgggtgaccccgccgggttcnacctcgccgacacgctggcctgccgcgccgtcggccacatcctcg

SEQ ID NO: 18034 - DNA, 66 bp, Zea mays
  Clone ID: LIB189-012-Q1-E1-D9
aacacgcgtccgctgacgcatccgcggtactctggtctaacacaggattgtaaactaggtttcacg

SEQ ID NO: 18035 - DNA, 394 bp, Zea mays
  Clone ID: LIB189-012-Q1-E1-E10
gccaaacacacgcgaagaaaaggagatagagtacaggttacagacaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgccttcgtcgtcgtcgcctcgtccgcggcgacgcagcccagggcgcgccaggagcagcggagccggcgccgggcgcccgaccagcagcagtacaggggcgtccggcgccgcccgtggggcaagtgggccgccgagatccgcgaccccg

SEQ ID NO: 18036 - DNA, 383 bp, Zea mays
  Clone ID: LIB189-012-Q1-E1-C5
acgctttctgtgaagttgacaccagatgagatggccgaactcgagtcctgtgctgctgcaggtgaaatcttgggtgaccgttatcctcaaatggccaacacctggaaggactctgagaccccgccattgtcttcttggaaatctgagtagccaatctggtgtctcttcaattctgccaccgtcacattggtgtatctccaaattgtcggactgcagaagatactcaggtgcactttgcaaaagcgtccatatgatgtgcttgccttttgcaagccatgatgtttggtacttggtgtgtattgcatgcctcaatttgtatcaagagtatttacccatgagtatagcttgaagggttaaaacactggttcgacgaataaccatat

SEQ ID NO: 18037 - DNA, 425 bp, Zea mays
  unsure at all n locations
  Clone ID: LIB189-012-Q1-E1-E11
cccacgcgtccgcccacgcgtccgctcaggctggtggctccttcactgtcgcacgtgatacctctggggagcaacttggcaggggtacaaagatgaccctctacctcaaggatgatcagttggagtaccttgaggagcgccgcctcaaggatctgatcaagaagcactccgagttcatcagctacccaatctctctctggattgagaagaccactgagaaggagatctctgatgatgaagatgaggaggataagaaggatgaggagggtaaggttgaggatgttgatgatgaaaaggaagaaaaggaaaagaagaagaagaagatcaaggaggtttctcatgagtggcaattggtaaacaagcagaagccaatctggatgangaagcctgaagagattaccanagaagagtatgctgctttctac

SEQ ID NO: 18038 - DNA, 202 bp, Zea mays
  Clone ID: LIB189-012-Q1-E1-A8
tacggtcatgcattccgggtccgaccacgcgtccgaggacgcgtgggcgcgcacgccgcctgcctgtccattgagatctctttcacgcccctttctgccatcgcacaactgagccgcaggtactactatccacttggcaggtcagtatctcctgcgaggacaaccattgattatttgaaggtggaggtggtacactcatcat

SEQ ID NO: 18039 - DNA, 429 bp, Zea mays
  Clone ID: LIB189-012-Q1-E1-A9
aagcctccgaccaagcctccgaacaaatttacagacgatgctgaactccaaagatctgagctttgtggggtatacgtacaaaaacttcgatgcggtgaaagcaataaaaatttcagatctgcaaaggaattcatctctaacaaggccttccattggttcaatattcggtccaccaggcatggattctcccatggaaccaaacgggaggggcacacatatgcacacagtttcatctggtgatccaatgattccctaacctgcagtgctgtttgtcctcggcaaatttctgaactaaatcagcatgcaaacgcctggatgatgtggctccagctggataacctgctcatttttagccaggtttctgctttctcaatcgtgggcaagcggtttgtagaaatccaccagagtttctaattgtaaaatagtatt

SEQ ID NO: 18040 - DNA, 440 bp, Zea mays
  Clone ID: LIB189-012-Q1-E1-B1
ttcacgggtcagcacacgcgtccactgatattaacgggacaccaggaaaatgcagaatttgcgcttgccatgtgtccagcagaaccatatgtcctgtcaggaggaaaggacaaatttgttgtcttgtggagcatccaagaccacatatctgcccttggggattcctcgtcttctcccggagcatctggcagcaagcagtctggcaaaattgcaaatgaaaaggagagtcctaaagttgatcctagaggtatattccatggccatgacagtactgttgaagatgttcagttctgcccttccagtgcgcaggagttttgtactgtgggtgatgatgcttgtcttattctgtgggatgctcgaactggcactgacccagctgttaaaggttgagacagctcacagtggagatgttcattgtgtggattgggatccccttgatg

SEQ ID NO: 18041 - DNA, 331 bp, Zea mays
  Clone ID: LIB189-012-Q1-E1-B10
cgaccaccatgaacttgctgtccgcgctcgacgcggccaaggccaccgtcggggagccagaaggccatggccaacgcaccggcgggaatccaatggaggcaactggggaggaggcgcagcagctgaccatcttctacagcggacaagtggtcgtcttccacaggttcccctccgccaatgtcaaggatctgctgcacatcttcagcccgccgggggctcacgctgtggtgtacagtgccggtgccggtgcccgtgctgctgtctctacgcataagttgcctatgccctctcacgacagtctctctgccgatctgccaatcgctatgctgaa

SEQ ID NO: 18042 - DNA, 421 bp, Zea mays
  Clone ID: LIB189-012-Q1-E1-B11
accacgcgtccgcgtcaatctgctccttgtgtcctcttctttgatgagcttgactcaattgctactcagagaggaagcagtgtgggtgatgctggaggtgcggctgatagagtgcttaatcagctactgacagaaatggatggcatgaatgccaagaaaactgtgtttattattggagctacaaacaggcctgacatcattgaccctgctctgctgaggccagggcgtcttgaccagctgatctacattccactgcctgatgagcagtctaggctccagatcttcaaggcctgccttaggaagtcccctgtggcgaaggatgtggacttgaatgctcttgctaagtacactcaagggttcagtggagcagatatcacagaaatttgccagcgtgcgtgcaaatatgcaatcagagagaaca

SEQ ID NO: 18043 - DNA, 409 bp, Zea mays
  Clone ID: LIB189-012-Q1-E1-B12
caagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgc

SEQ ID NO: 18044 - DNA, 376 bp, Zea mays
  unsure at all n locations
  Clone ID: LIB189-012-Q1-E1-B4
cagacgcgtgggcaggtggtacaatacctggaggcagcagcggtatggtttcaaacctgatgaatcaggcgagcggccttagaccgccgctgatgatgccaggctcagtgacccagtccagcatgccggcaatgtatgcaaataacatgcaggggcatccccagatggctctgctgcaacagcggcaacagatgctctcgttcggtcctcgtttgcctctctcggccatcaaccccggctcatcctcgtcggcacccaacatgatgttcaaccatggcatgcccaactcggcagctcctaatcatcaccctttgctgagataccctcaggggaacattcanatgtaggttagtgagatgagttttttcattttttg

SEQ ID NO: 18045 - DNA, 64 bp, Zea mays
  Clone ID: LIB189-012-Q1-E1-B6
accacgcgtccgatatttttggtgcgcaaaattagaactttgtttgaatttgaaataggagttg

SEQ ID NO: 18046 - DNA, 417 bp, Zea mays
  Clone ID: LIB189-012-Q1-E1-B8
ggagattagacctatcggccgcccagtgaaatcattgctggtgaccctgttttggtcgtgcctcctgttgtttggtgccatcgagttcttcaagtggacgcagctcctatcgacatggagaggagtggcattcactgccgcagggatggcgctggtgacagggctcatgcacgtcttcatcatgttctcccaggctgagcggtcgagctcagccaaggcggcacggaaccgggtcaagaaggaatgaaaacggagggtggaaatgtgattctgggctcgatttatgggcagctttcaaaatgactcgattcatattaatgtatacagcaccaaattccagacagaaacaggatgctctgctcctcttgtatttgtgtgcaggaaagaattttagggagttcatttttgcccccctct

SEQ ID NO: 18047 - DNA, 419 bp, Zea mays
  Clone ID: LIB189-012-Q1-E1-B9
accacgcgtccgcccacgcgtccggttcctgcacgcacgccctggtacccctgctcgctgttgggccgaccgtcagcagcttcccggcctccgtcgtgctcagcagcgagtaatttatgtcggagcagttactgagacgccctcctttgcgtcgtgctcgccagatcaagcctcgcgtcgtcgatttgcgcagttcatgttcggcaatcggtttagtctccgtcgaacttctatttaccgtgacgccgagctccttcaacactgccccactccgttgtcgttattccgtcgcctcacttcgatgtcagttccttcatgacatctcctacttgtgttcgcgccgacaaaaggatcctaagagaatgtggaaaaacaagccccaagttgatgcctcaaatactcgacgaaaagcctgaact

SEQ ID NO: 18048 - DNA, 414 bp, Zea mays
  Clone ID: LIB189-012-Q1-E1-C10
attcactccactcatcttttctcgtttagaacctctaaaatttcccccattcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcg

SEQ ID NO: 18049 - DNA, 418 bp, Zea mays
  Clone ID: LIB189-012-Q1-E1-A5
cgcgtccggcattctcaccgttccgagaccagcgccagacgcagacggccccgaacgccggcggcggagcatcaggtcgtcgacctccgagcatcgacccgccgcgatggagaagggaaagggcctcgctcgccgctgggcggtggagctccccgacgcctcctcctcctcccccgccgtccccgacccgcccggcttcaccagatccgcgcctgacgcggacgacgccgctggagcgcgccagcgcaaggactccgaggctgcatggaaggcgcagaaggcttgggaagttgcgcaggctccgttcaagaacctgatgatgatgggatttatgatgtggatggcagggagcactgtccacctcttcagcatcggaattaccttctctgctctgtggcaacccctcaacgctctccga

SEQ ID NO: 18050 - DNA, 128 bp, Zea mays
  Clone ID: LIB189-012-Q1-E1-C3
ccacgcgtccgcccacgcgtccgaaggaatcgggcgctcttgctgttaagcccgagcttgcaataatggattcttgctggatcacacatttatacttagaataatcgaatgcttgcttccttggttac

SEQ ID NO: 18051 - DNA, 351 bp, Zea mays
  Clone ID: LIB189-012-Q1-E1-C4
cacgcgtccagggtaagaccgcgtccttcgggtaaatgaagtcttggcttgaaccgcacccgtcagttggtctgagggtgttaaccagccatgattaggagcgttgggggtacccctaattatggtactcgacaagaatcatcataccactgttaactgactagttgcattccattgtacttgctttcaaatagattcatgcattgatatcctttctttgggtactatgttattacactcaaataccattgtctgtgatctttggtgcatcttggcattttaatttgattcaatccatgtctctaggttgtttattaatcccttacaaactctctcctatctgtggactaa

SEQ ID NO: 18052 - DNA, 434 bp, Zea mays
  Clone ID: LIB189-011-Q1-E1-G7
acggacgcgtggggggacagcaaccgcaacgtcctgctggtaggcgtgctgggtctggtggaatgcagcagcccatgccaatgggtagtcagcaacagatattccctagaggtggtcgtggctaccgctatgctactggacgtggaatgcctgatcctggcatgcataatgttggtgctgtgatgccatctccatatgagatgggagggatggcaatgagagatgctggtgtctcacaacctgttccaattggggcactagccactgcgcttgctaacgcctcaccagattagcaaagactgatgcttggtgagaacctgtatcctcttgttgaacagctggagcgtgagcaggctgccaaggtcactggcatgcttttggagatgggacagacggaggtctctcactgctggagtcgccagatgctctcaagg

SEQ ID NO: 18053 - DNA, 346 bp, Zea mays
  Clone ID: LIB189-011-Q1-E1-H10
taaaaaaaaaaaaaaaaaaaaatcaataaaaaaaaaagacaaaaaaataagttcatccccagtaaattggtcacctgaaatgtaagggggattactctaaagactgaactctaaattacattggtcgggtcgcctcattcgtctgtcacattgtcatcatcttcggtgtcgggatgtctgttatccaggttgagaatagggaatccgctgccgtgagtaaactatatgctgattctggaaaataccgcttacatcagctggcgaatgcacaatacgatcttcaacggtatcagtttccacttattcgccacctgggttgagggcgtgaatggcagctttatgggcc

SEQ ID NO: 18054 - DNA, 431 bp, Zea mays
  unsure at all n locations
  Clone ID: LIB189-011-Q1-E1-H11
ccacgcttcggaagggcaattaatacccctttgaattacattcaaaaaaagtttaagggaacctcaacaaaactcccggtacaatcaaggccaaaacggggcattaacttggtcccttgccggccaatccccaatggtttttgactaaccaaaatgtctttgctttcgactacacaactcaagttctgtttttcatcatgctgtcgtgcctgatttcagtctcggtgaacttcagcacttttctcgtgatcgggaagacgtctcctgtaacctacaaagtacttggccatctgaaaacatgcttggtcctcacctttggctatgtcctgcttcacgacctatttagctggagaaacatacttgggatcctaatcgtggtaattgggatggttctgtacttgtacttctgcactanagagactcancaaata

SEQ ID NO: 18055 - DNA, 117 bp, Zea mays
  Clone ID: LIB189-011-Q1-E1-H12
tggtccctggccggccaatcctccaagggattttggccaaaccaaatggccttggcttccaataaaaaaatccagttccggttttcaacaaggcggccttgccggattcaatccccg

SEQ ID NO: 18056 - DNA, 444 bp, Zea mays
  unsure at all n locations
  Clone ID: LIB189-011-Q1-E1-H2
cgaaaacactggtacccaaaacaaccgtcaaccaagggcaaattcaacaacctccaaagaataatccgggtgccttccaagaatcctccaaccacccttggtgcccaagcaagccacaaaaagtgggcaaaccaaagaggacagcaatgctaggaaaatgacgatgacaaagacgagggcatcgggcaacatacttgttagccgtaatgacgacgggccatgctatctagattccggtcttaatgagtacgtctgcagaaagactaataagtgctataagagcttggtgctctgcgtggcgagttgtcaaccatcatcatgaattcaagatactgcggagacatcatgatactgcggagacagacggccagagatgangctagctagatgccgtttcaccannatattatgtaacacccaaatctcccattttaagaaataaat

SEQ ID NO: 18057 - DNA, 264 bp, Zea mays
  Clone ID: LIB189-011-Q1-E1-H3
ccccaatttaaaatccgtttgacaagacctgcagttgaatttttaaattttaaattcctggggcctactttaattgaacggggaactgttgccactaatttaaaccgttttgcaattccaatcctttaattaactaagggcgttgggaattaataattaaaattgtttaattaatgttattaatttttttaaatgggtctatttacctactatgtattattatcgaattaagaggataaaaaatataaggattatgaatatatg

SEQ ID NO: 18058 - DNA, 366 bp, Zea mays
  Clone ID: LIB189-011-Q1-E1-H4
gtccgcccacgcgtccgcccacgcgtccgcccacgcttccggaagcggcagcaagcgaggatgccgtgcctgaacgtgtcgaccaacgtgaacctgaagggggtggacacctccgccatcctcgccgaagcctccaagtccgtcgccaacatcatcggcaagcccgaggcctacgtgatggttgttctcaagggttcggtgcctatggcatttggaggtacccaagagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgac

SEQ ID NO: 18059 - DNA, 326 bp, Zea mays
  Clone ID: LIB189-011-Q1-E1-H6
accgacgcgtccgcagacgcgtgggcggactcgttggaaggagagtacgtggaggagcagccatggcttcatcggtggccgccacggtaagcacattcctgggcacccgcctggcggtgccggagccacagaacgggtgcatcgtggtccggttcgggttcgggttggtcggcagggctaaacctgctccgaaaaatgtggcaactatatcgaactcctctgaccgaccgctgtagttcccccgggccgtggcgcccgagtatctggatgggtcactggtcagcaattacgggttcgatccgttcggtctcgggaagcccgtgggg

SEQ ID NO: 18060 - DNA, 223 bp, Zea mays
  Clone ID: LIB189-011-Q1-E1-H8
acgcgtccggacctcccccagtccctgtaaacaaaagtggataccgtcagtaggctctaggacatgactggatgatatctatccagggtttcacctcttgtttttttttcttctccatttttgagggattttgttgacaggcgtattggcctgtctcagatgagggtttccttctctgctcttagtagagttatctcctatgattctgtccatgagacattgg

SEQ ID NO: 18061 - DNA, 419 bp, Zea mays
  Clone ID: LIB189-012-Q1-E1-A10
gaaggaggtggtgctccacgtgtatgacgtgaccaacagtgactccgagaagacgaacaacaccatcctccagatcaaccgcatcttcaaggaccgcatcggcctcggcggcatcttccacagcgccgtccaggtagtgggcctggctcccctctcccccttccctcgccaatcgctcagatcccagggaccgacgcttgcgtgccgcttctccagatccctaaatctcacgccatttcttgaacccctcaacgcaggtctatggctaggacgagtggtcgttcgggttctgcgagtccggcagcggcgtgtttagttgccccataggcaagaaccccatgtacacctaccgggagcgcatcgtcctcggggagaccgagtgcggcatcgccgccgttaaccggatcctgcgggagctc

SEQ ID NO: 18062 - DNA, 79 bp, Zea mays
  Clone ID: LIB189-012-Q1-E1-A3
cggcattctcaccttccgaaaccagcgccacaggttgggaactccggaattcctggtcccaatccggtaaatccgaacc

SEQ ID NO: 18063 - DNA, 225 bp, Zea mays
  Clone ID: LIB189-012-Q1-E1-A4
agattcaagctaccataaatatattcatactgccctataacaaattacaagatcagctatggcaatctccagtaagcatctgttagtaagacgggggtgcgccattacatgtcactgcaacattagactaatcacagctatacaggtcgcattggcgtacgtctgacaagtaggtgaacttgcatcttcaacgacagggacgcatgcatcgagggtggggggggg

SEQ ID NO: 18064 - DNA, 361 bp, Zea mays
  Clone ID: LIB189-011-Q1-E1-F10
cttccctaccccaacgggtcctggtcaaggtccgggtccttggccaaaaggaaaaaaatggcggcttcggactttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgcc

SEQ ID NO: 18065 - DNA, 317 bp, Zea mays
  Clone ID: LIB189-011-Q1-E1-F12
ccaagcctccggtttaagcaattcccgaacctgttaaaaatccgacattgcctaaccggatccaacaagccttaacggcaaaaacaacctttgccaaattggaaaacctggcatgataaccgtataactgccgttcgatgcagtcaattgtgcaaaccagcatcattggctgctgattgcaaaatttgcaatgcccgtatggtcattgatggaaggggacgattgggactgttgggcttttatggttgggccctgtggtaatttagacatgtcgaataaacgcgatacgagcaatgaaagatcgatgctgatcattg

SEQ ID NO: 18066 - DNA, 438 bp, Zea mays
  Clone ID: LIB189-011-Q1-E1-F2
agcacgaccacaaccggttcaacaacggcaaggcaaaggaggaggaaggcgcctccggcaaggtcaactacgagaagaaggagaagcaccacaggcacatggagcagctcggccagctcggcgccatcgccgccggcgcgtacgctctgcacgagaagcacaaggccaagaaggacccggagaacgagcacggccaccgggtcaaggaggaggtggccgccgtcgccgccgtgggctccgccgggttcgccttccacgagcatcacgagaagaaggacgccaagaagcacgcccacaactgatccgtcgcaggctgcctcagccgaagcagcagcacatcgtcgcggttgctgtttcatctgttcccccaacctcgtcgtcgtctacggtttgccgggcaggccttgatttgaggctttgagctaccgatatttgcac

SEQ ID NO: 18067 - DNA, 383 bp, Zea mays
  unsure at all n locations
  Clone ID: LIB189-011-Q1-E1-F4
cgaccaaacctccgaaaaaaaatgggaaagtgtaataattcaataaacaatttaaaaaagttaccccaacaaaaggcaattgttgaagggccaaattaagaaaccggtaaactggtaaaacctaagttaaaattaatttaattatataattaaaaaaaatttaattgtaaagtaaaattgtaaatctgaatgtttatgccactttgatttgattttaagcgtangggaatcttctgattttgcggggagtaaaccactaaaggttcattgtttgatttttcattatatgtggcacagaaatatcttccctttgataaaacaactaagggagttctatttttttgacatcagataaaaatactttttcacctttcccgtttgtg

SEQ ID NO: 18068 - DNA, 397 bp, Zea mays
  Clone ID: LIB189-011-Q1-E1-F5
gggaaaccatggaaattccacaaagtattcggtccattgtttgtctcaatttgcccagcttctctggtggactaaacccttggggaacaccaagtaagaggaagcaaagaaaacgagacttggtgatgcctccacttgtggatgatggccttctggaggttgtgggtttcaaagatgcttggcatggccttgtcttgctatctccaaaaggccatggaactcgccttgctcaggctcaccgtgtccgattcgagttcctcagaggcgcaactgatcatgcttacatgagaatggatggggaaccctggaagcagcctcttcccacggatgatggcaaagtcgtggtagagatctcccatgctgggcaggtgaagatgctcgcgaacaaagactgcat

SEQ ID NO: 18069 - DNA, 411 bp, Zea mays
  Clone ID: LIB189-011-Q1-E1-F7
cggataatgaaaccacatcagttggaaggtttcaactttttggttaagaatttgattggagacaagcctggaggttgcattctagctcatgccccaggtacagggaaaacatttatgcttataagcttcattcagagcttcatggcaaggtatccatctgcaaggcctcttgttgtgctgcccaaagggattctaggtatatggaagacagaaattaaacgatggcaagtgcaggatataccagtgtacgatttttactctgtcaaggctgaaaaaagagtagaacagttgcaaatcctcaaatcttgggaagacaagatgagtatactatttcttggatacaagcagttctccacaatcgtcactgatgatgggggcagcaatgtcacagctgcatgtcgagacaggctg

SEQ ID NO: 18070 - DNA, 442 bp, Zea mays
  Clone ID: LIB189-011-Q1-E1-F9
ttccggagtcacccacgcgtccgaagacgcgtgagcgctagtctcataccacaaccctagagatcaagagagagaaagataagtagagatggtggggctgcagtacgatctcgtcgggaatccattgggcgcggtgcgcgccaccttcgagaggacggccgccgccgctgctgcggagtctggaggagccgaccctgtggcggcgttccgtggcaaagactggggcgccggcgacctcttccgctccttcctcttcgagcaagacggtcttggcaaggttccggtgttggattcgtcaaatcttggattgatcaaaccgaacaccctggtccggtatcggggaatggttcaggatatgcttgggaatgagtactacattggtgctttcaaggatgggtcaacttggaggacaaacaagtagcctgacttctcaccgtactca

SEQ ID NO: 18071 - DNA, 347 bp, Zea mays
  Clone ID: LIB189-011-Q1-E1-G10
gaaaaccctccccaaccttcaaatcgctatgcaccccgtcaaggtgtacgccgaccggcggtcgcaaccctcccgagctgtcatcatcttctgcagggtgaaccagatcgatttcgaggaggtcacggtggatctgttcaagtctcagcacctcacacccgaattcaaaaaaataaacccaatgggacaggtacctgcaattgttgatggaagattcaaactatttgaaagtcatgcgattttgaggtatcttgcatcggttttccctggagtagctgaccactggtatccttctgacttgttcaccagagccaaaattgagtcaatcttggattggcatcactcaa

SEQ ID NO: 18072 - DNA, 407 bp, Zea mays
  Clone ID: LIB189-011-Q1-E1-G11
tcagccaacccttcggccaagccttcgttaaagccccccccgggtaatcaatttgggtatgggttaacttcaatgccggaaataaattgggatttggaaccaccggttggggataggaagataagcagcagttacatcacctcgcttatcggcaacaggatcaaggcttcggttcgtcagatcttggtgatgcccaactgtgaaagctttcctatttcctggatgatagcagatacggatgactgggtgccccgcagaattgcaccttttatatggctgaaccgtgagcccgctgagaggcgtgctgcagacacaactagagagatgatgccaggggaagcttccacatccaaggccattgcaaagaacaagtcgagtccgctgccgtcttcaaaaagaatcaccaa

SEQ ID NO: 18073 - DNA, 256 bp, Zea mays
  Clone ID: LIB189-011-Q1-E1-G12
tggaaaacgctgcctctgcaattccaaacccgtcattgtctaagaatccctcgcattctttccgcgtccggaacggcagcctcaattcaatgcgcctgcgccgcgtgttcgacatcttcgactgcattggctacggcgagatcaccctcgacgatatggcctccgcgctctacgcgctctgcctcggcgccgtatgctccggtctggaggcctctgttggcgggtacatcccggccggctccgccgggctccactt

SEQ ID NO: 18074 - DNA, 404 bp, Zea mays
  Clone ID: LIB189-011-Q1-E1-G2
cgggccgagccacgcgtccgcggaagcgtgggctactacacacaaacacagctagccggcgctgccaggttggctttggcgagcaacgacgacgacgacggcgctcaggactcaggtgctttcggttcaggcggaggagggcatggagcgcggcgactgccagttcacggtggtgccgccgcggcagtacgacgaggcccagttcatgcaccagctgatggtggccggcgaccagcaggaccccgcgggcgcggggcggggagctgccgccgccggcggggagaggaagcggcggttcacggaggagcaggtgcggtcgctggagacgacgttccacgcgcggcgcgccaagctggagccccgggagaaggcggagctggctcgggagcttggcctgcagccgc

SEQ ID NO: 18075 - DNA, 416 bp, Zea mays
  Clone ID: LIB189-011-Q1-E1-G4
cggcaaaaattgaaccttggccatggcaggtgccaagaaccaatccgaaaccaaaggtccataaaccagaataacatttggtaccaaaatggggtcaaaggtaaggtatccctaaaaatttggtaaggtttatgtaaaaaagataagggtttgtcactagcatctgtttccaatggacaaatgttctagattctaaaaggtcaaccaaaaaatattttaagattttttgataaatttagttataccaatttgatggaccattctacctttcacagcttccatctgtaaactataagaatcttctacaagaactagttcagaaggaaggctttcccttgcctatctataatacagcctcggatgtctcgaactattctgctgccttcgtatcaactgtggaaatccatggtgtaact

SEQ ID NO: 18076 - DNA, 433 bp, Zea mays
  Clone ID: LIB189-011-Q1-E1-G5
aggccaggaagctgtccctgactagggccatcttctacattatcatgcaatgcctgggtgccatctgtggagctggagtggtgaagggcttccagcaggggctttacatgggcaacggcggtggcgccaatgttgtcgcccccgggtacaccaagggggatggccttggcgctgagattgttggcaccttcatcctggtgtacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggagccttggcgccgccatcatctacaaccgggatcatgcctggagcgaccattggatcttctgggtcggccccttcatcggcgccgc

SEQ ID NO: 18077 - DNA, 387 bp, Zea mays
  Clone ID: LIB189-011-Q1-E1-F1
acagaaggagagcaccctccacctggtgctccgtctcaagggtggtatgcagatctttgtgaagacactcactggcaagacaatcacccttgaggtggagtcttcggataccattgacaatgtcaaggccaagatccaggacaaggagggcatcccacccgaccagcagcgcctcatcttcgccggcaagcagctggaggatggccgcaccctggcggattacaacatccagaaggagagcactctccacctggtgctccgcctcaagggtggcatgcacatttttgtgaagacattgactggcaagaccatcaccttggaggtggagagctctgacaccattgacaatgtgaaggccaagatccaggacaaggaaggcattccccc

SEQ ID NO: 18078 - DNA, 248 bp, Zea mays
  Clone ID: LIB189-011-Q1-E1-D12
cggtatcaactattccctagaggtggtcgtggctaccgctatgctactggacgtgaaatgcctgatactgctatgcataatgttggtgctgtaatgccatctccatatgagatggtagggatggtcatcacagattctggcgtcgcacaacactgttccaattggggcactaaccactgcgcttgctaatacctcaccagattatcacagattgatgcatggtgacaatctgtatcctcttgttgaac

SEQ ID NO: 18079 - DNA, 405 bp, Zea mays
  Clone ID: LIB189-011-Q1-E1-D2
acggacgcgtgggctatagcaaccggtccagcactttcacgctcagctccagcaatggctgcctccaacatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgttctccccgagctgctctcccgc

SEQ ID NO: 18080 - DNA, 447 bp, Zea mays
  Clone ID: LIB189-011-Q1-E1-D4
ggtccaagatacccggggccaaccaagccttcgacggacccttgggcggtcaactaaaacctaacaaaaagggaaccaacccggaaaatcaattcccctcccaaccgttagaactcccaaattaaaaaaaacgaagggcccgccggtccggcttccctccctggcccgttcaacaaaaaaatttccgggagtcctccaactccaagcaagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcgccgccttccagatcctcgatctctactggaagaaggagcacagactgatgtgcacctcggagattttgcacgccga

SEQ ID NO: 18081 - DNA, 380 bp, Zea mays
  Clone ID: LIB189-011-Q1-E1-D5
acgcgctggccgccgaggtgggcgcggcgagccgggactggggcttcttcgtggtcgtgggccacggcgtgcccgcagagaccatggcgcgcgcgacggaggcgcagcgcgcgttcttcgcgctgccggcagagcggaaggccgccgtgcggaggaacgaggcggagccgctcgggtactacgagtcggagcacaccaagaacgtgagggactggaaggaggtgtacgagctcgtgctgcgcgagccgccgccgccggctgccgtggccgacggcgagctcgtgttcgagaacaagtggccccaggatctgccgggcttcagagaggcgctggaggagtacgccaaagcgatggaagagctggcgttcaagctgctggaa

SEQ ID NO: 18082 - DNA, 260 bp, Zea mays
  Clone ID: LIB189-011-Q1-E1-D6
cccacgcgtccgcaacgggcacctgctgctgttgctgggaggaggagatgatggctgccttccataccgtagttaactatcttcacattgttttctgttttttttggggtattgtatcaatcttaccttgactgcatcatctatggcactgcatgatgatgccatcttttgcttgtgttgaaacacgtagcctatccaagacaatgtggttcctatacatctgtagccaattttggccactagcatgccattggacactg

SEQ ID NO: 18083 - DNA, 401 bp, Zea mays
  Clone ID: LIB189-011-Q1-E1-D8
ggcgcggcggaaggcggaggagaagcgcgcgtccgcggaggccaagcggggcaccaaggtggcgcgagtgctggagctcgccaacttcatgagggccgtggggagggcgccctccaccaagcgctccttcttctgaacccaccggcctcttcttcaccagttcctctgtcttgccgccgccgcctgtgcagttcagttcagttcagttgtcctgtgggtcggaccgttcaccgcttcactccacgggatcaggcacagtgatcagtgccgtgctagctgtgtggaacgcttgttttagtgttgtatccacatgtacgatttgtaacgtttccttgcttctcccgtttcgtgttttcgtatggtatctatggtattgcaaagtccatggccacgatagacag

SEQ ID NO: 18084 - DNA, 406 bp, Zea mays
  Clone ID: LIB189-011-Q1-E1-D9
accacgcgtcagcccacgcgtccgccccgttcccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagtggggtcgtgttccagcccttcgaggagatcaagggggagctcgccctcgtgccccagtcccctgacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccag

SEQ ID NO: 18085 - DNA, 198 bp, Zea mays
  Clone ID: LIB189-011-Q1-E1-E1
cggtcgacgcacgcgtccagctgtaaggtaatatgtttagcttgctaggcatgctacacgctatttggatgtagcaacgttatcaccagctgtatacgctttttaatcgacaacatttgaataatatgtacataacattatgttgtgctctgttctctgtctgtttgatgtgcttatgggttttgatctgtagcttac

SEQ ID NO: 18086 - DNA, 395 bp, Zea mays
  Clone ID: LIB189-011-Q1-E1-E10
gctgtctgccgctgccgaccagcagctcaagcagctccaaaccgaccgcaaggccgacaaggaaaaggataaggagagcgatgctggcgacaagctggctccgacaggtggcgacctcgtgctgtacaggcggattgctgaagtaaaagagaaggaacggagaaggactttggaggagatactctatgctctggttgttcagaagttcgttgaagctggtgtctctctggttccagcactctcacgctccaccgatccttctggaagagttgatcagtgggcagaaactgtggaagaaaagcttcaacgtctgcactcgcatgaggcctatgaaatgatcgagaatcacctcaccctcattctggggcagcgtcaaggtgacgccactatcgcag

SEQ ID NO: 18087 - DNA, 357 bp, Zea mays
  Clone ID: LIB189-011-Q1-E1-E11
cactaccaccgccgcctgacccggaccgcgtccgtggggccgtgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgagaagacatggtatgttgttgatgcaacagacaagatcctaggcaggctagcatccaccattgcagtacatatcaggggaaagaatgaacccacttacactcccagtgttgacatgggaacctttggtaatggg

SEQ ID NO: 18088 - DNA, 388 bp, Zea mays
  Clone ID: LIB189-011-Q1-E1-E2
acccaagcgtccggcaacaaaaatttctaccagcactgagccaactagctgtggtgaaccctgtcgcctacttgcaacagcagttgcttgcatccaacccacttgctctggcaaacatagttgcataccaacaacaacaacaattgcaacagtttctaccagcgctcagtcaactagccatggtgaaccctgccgcctacctacaacagcaacaactgatttcatctagccctctcgctgtggttaatgcacctacatacctgcaacaacagttgctgcaacagattgtaccagctctgactcagctagctgtggcaaaccctgctgcctacttgcaacagctgcttccattcaaccaactgactgtgtcgaaatctgctgcgtacct

SEQ ID NO: 18089 - DNA, 318 bp, Zea mays
  Clone ID: LIB189-011-Q1-E1-E4
taataatttcccgggtccaaaaggaattaattttccagccctttaaatctcttaaccaaagccccaaaaaaggggccatcccaaattcaataactttactttaaaaaaaagtggaaaaaaccaagggcgcgaaaatgaaaaaacccctttattttttaaataaaaaaggcaccacaaggaatctaccccaaatacaatttcccggttttaaattaaaattctaattaacaaggataaaattaacaagttattcaagttggtcaataaactgcaaaattcaggcatatcaccccagacattactctacaatacagtact

SEQ ID NO: 18090 - DNA, 422 bp, Zea mays
  Clone ID: LIB189-011-Q1-E1-E6
agaaattttcccatgcccaaaaaggattcttcagcaggtggagcttcgaagttaccaaaagaatatgcagaaccatgggactatagccatgattatcctgttactctcccactaaggaagccctactctggaaatcctgaaattctggatgaggaagaatttggagaatcttctgccagcaggacccaagatgatgaattatctgcagcagagcagcttggattaatggatatgtcgtcggaatcacagttcctcttcttccagttgccatcctctcttcctttaccgaggcagccacaatcaggtgctgaccctaacgaagtccgcgatgagaaacgtgaggacatgaggccatcatcgcacaatggctcgaaactcaaagaagttcctgaaggctatatggggaaaatgctccgtatata

SEQ ID NO: 18091 - DNA, 348 bp, Zea mays
  Clone ID: LIB189-011-Q1-E1-D11
tggtcaccgtcctcgtcgtgtgcctggctctgtcagctgcaaccgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagca

SEQ ID NO: 18092 - DNA, 376 bp, Zea mays
  Clone ID: LIB189-011-Q1-E1-E8
agcattgtctgctcaaagtttgactcagcatctaatacttgtagttgggttggttgtgatgtatgtcttcattggtgccacacagattgtggtctacgccactctctgattcgataggggcaaagtgcttcaagggcatatggaactactgagatgcagtttcactgttctgcctgtggatatccatcggagatgtttggttttgtgaaagaagtatttcgaacatgtgcacaacactggaggatagacatgctggttagagagttacagtatgtataaagatttttttctgcaagtgaagatgtaatgggcaatacggtccgggacttcgtgaatcagatgctacttaagtcagaaaacaaagcctatcatgctg

SEQ ID NO: 18093 - DNA, 304 bp, Zea mays
  Clone ID: LIB189-011-Q1-E1-B7
cccacgcgtccggaacacaaggatcaccgtgagcggctatgacaagagcgcgatcggtcagtttgctgctaccataaagaagtggaggccacctgagccatacaagggaaagggtatcagatatatggatgaagttgtccgaaggaaggaaggaaaagccgggaagaagaaatagaaagtgtttttttgccctctccttacttcatttcaattttcccactgtaatggtcttcgtctgctaaggctgaacctaagaaatatattgttctgtgctgaacgtggcatatagatgtacactttgagc

SEQ ID NO: 18094 - DNA, 386 bp, Zea mays
  Clone ID: LIB189-011-Q1-E1-B8
cctacgtggccttcttctccagcggcctcggccccatcacgtgggtgtacagctcggaggtattcccgctgcatgtgcgcgcgatgggctgcgcgctgggcgtgggctccaagcgcctgaccagcggcgtgatctccatgaccgtcagctcgctgtccaaggccatcaccatcggcggcgccttcttcctctacgccggcgtcacggtgctcgcgtgggtgttcttcttcaccttcgtcccggagacccgcggccggacgctggaggcgatgagcaagctgttcggcgccatcgacgacgagctgaaaccccaggacggggccacgacagacaagcataagctcgaactggccgcctacggcaccatctaacttcacattattaga

SEQ ID NO: 18095 - DNA, 301 bp, Zea mays
  Clone ID: LIB189-011-Q1-E1-B9
tttttaatcacaggcatttgtgaagatcgcacaagcagtttcgtcacggccggatgttgttccacctgcataccttgatgagctctcactacttcaggaccgcatagcaccattttcaaacgatgttgcttttaatattatagagaaagagcttgggcttccactggatatggttttctctgagataacaccagagcctgttgctgctgcatctcttgggcaggtttaccaggctaggctccgctccagtgggaagattgttgctgtcaaagtacaaagacctggagttcaagcagcaatt

SEQ ID NO: 18096 - DNA, 330 bp, Zea mays
  Clone ID: LIB189-011-Q1-E1-C1
aagaaaacaatgctaaccgtatagagtctaatacaaaatcattataagttagtttgcggagataataaaaaaggtttgcacacctgaaggatataaagtaaatgatattgatagcatcgatgtcattgatactcttcaatgtttccaacttccaagtgaaaggattacattttgaatttttgtattcgctatagctcagatcaaatttcacacatatctcctcttcctcagttaccgctgaaccaaatacctataatcttctatgtccaacttggtttacagatgtacattttgtccatcataaaagctaaatggagccaggttctttaa

SEQ ID NO: 18097 - DNA, 409 bp, Zea mays
  unsure at all n locations
  Clone ID: LIB189-011-Q1-E1-C11
aaccaangctccggaattaactaaaaagtgctgttgtcaacaatgaaagtaacaatgttgttggtgtttaaaggggaaaaaagtccatccaaagattttattagctcaaggcaaaacctttaaaactggcctgctgctgtttggtggtgatgaaaacacaaaaatggaagctgacaagccagtgaatagctgtgtattggtctggcaaggtagtgtggcaaagcccaccttccacagaccacaggttcactgtacataattgccggagtgaggctgcagctaagaaggttttcgttgatgcttctgttcctcactactgggaccttgctgtcaatttctcagaagattcttcctgagcaaagtgttcagaaccttggtagcgtctgctgacctttgctggctacatgct

SEQ ID NO: 18098 - DNA, 420 bp, Zea mays
  Clone ID: LIB189-011-Q1-E1-C2
acatgattgagaatcagaagtcagaattgatagcatttggtctttgcttcagccttgtctcttacctttatgttctcgctacaaggaaaaacatgcgatttcaagtttcatatggccgtaacagtgatcagcagcacccaacactacaaatggtttctgatcttctgaattcagcaacacttgccctagaaagagttggtgaagaaaaatatatgcttttaaacaagatccgtgacttaaatgagttgtccagaaaggaggttgatgagataataaaagtgtgcatgaagcaagattgcatatctcctaacgataacatccgtaaaaggaggtacattgcaatgatagatttgtgttgcatggctggcaaccgagaccaactcattacccttctactccaaataacgggatgtgccgtta

SEQ ID NO: 18099 - DNA, 446 bp, Zea mays
  Clone ID: LIB189-011-Q1-E1-C4
ggtccgagatacccggggccagccaagccttcgaccaaaccttcggccaagcgtccggtgaataagtgatcctgcaaaacttaactcaaaccaacacaaacttgggctaaaatgtgagttagagggaattagaaccaagtttgagagtagagagaagagagaagttcctttcacttgattgctccatcaagatttaatttagatttagagcaatatcacaagtgaagaattggaacaaagaagagataaagattgcaataatgtaaatggcacaagagacatgacaattttattccgtggttcggtcaagcataatatgcttgcctactcacgttgtgtcgtcccaatgaacgagggttgcactcaacctctctcaagtgatccaaagaccaaacttgagtatcttagttcctcctaaggttttaaaatatccccgattgtgagga

SEQ ID NO: 18100 - DNA, 394 bp, Zea mays
  Clone ID: LIB189-011-Q1-E1-C5
gagctttgaactggaaccgattcaaccgccatgggtcgcatatgctgttattgctatgtctatactcattctacgcaacagagttgccacaactgcggacatggaatctgcgataactgcgagcatgacggtcaagacagtcttcgtgtttcctctgctaggggaaacaatgaattggagactcgactgattgcgtacggcaaggacgacaaaacagccatgcctccaagtgctctgtttctgcaagaggagaaagcctacaccctgccaattccagctggcataacggaggaggataatatactgcagaaaagctatatccatccatttgtttgatcggaagaaacggccgcatttagtatgctgcccatgtgaggagagcctggcctaaact

SEQ ID NO: 18101 - DNA, 406 bp, Zea mays
  Clone ID: LIB189-011-Q1-E1-C6
cggcgcgtgggaaagaaaggagatccgaagaagaaaaaaccaaagaggaagcctctttttgtgaagaatggtgcaattgttgtttgccgcattcaggtgaataacttgatatgcatagagaagttctctgatttcccacagcttggaaggtttacacttagaactgaagggaagacggtagccgtaggcaaggttgttgatgttccgcctgctggcagcccaacattctgagcttaagccaattttgaacaggatggataatcatgaagcagtgcgttgtcttgagatacttttctttgggagaagtgagattagttgagcataggttttttccgagcccggcttgagaatggtctatgccttaatggtttaagcaacaagcctgtttagattggttccataaatg

SEQ ID NO: 18102 - DNA, 370 bp, Zea mays
  Clone ID: LIB189-011-Q1-E1-C7
acccacgcgtccgcccacgcgtccgcggacgcgtgggcccaaccaagcccgcacgacacgacaccaagtcgaggagctcgagagggcaccaataatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcc

SEQ ID NO: 18103 - DNA, 420 bp, Zea mays
  Clone ID: LIB189-011-Q1-E1-C9
acccacgcgtccgaccacgcgtcagctttcaattaactgggggtgagggatatatgctctgtgtagtttattattttttgtgtatgaccaaagcaatagcaaacctaaatggtccaattgatgttctgttttttggtgcatgcacactactgtataactttagggcctgtttgtttcagcttatagattatataatctgaattataatctaaattatataatccagattataatctagatatattataatatatatgtagttgtttggtagtttagattatacaaatgtagattattcacaaagacaacaatacccttattgcttatttaaggtgagaaaaaaaggatgtcatatattgtaatttctatttacattaccatgggtagtaggtcttttgccaaaataatctcaaataagct

SEQ ID NO: 18104 - DNA, 375 bp, Zea mays
  Clone ID: LIB189-011-Q1-E1-B5
ccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctaga

SEQ ID NO: 18105 - DNA, 210 bp, Zea mays
  Clone ID: LIB189-010-Q1-E1-H8
tgatatgccatggcgaaaagagcgcgcacgcatgcggtctcgacgaggtccgcagtgggcattcttcaaggcctttcgctggtccaggttctcatgcatggtacatggctgcactactgagcgcttttgatcgcacgggtcacattgcacaactgtgcttagtttttctgcctctacttgtcgcgtcacttgtggctgtttctcgagttg

SEQ ID NO: 18106 - DNA, 384 bp, Zea mays
  Clone ID: LIB189-011-Q1-E1-A1
gagccagaacctgttccagaaggacatcttcacaagcatcaactggttccccaaggccaacaccatgagcgcgctggaggaggtgtaccgcatctcccgcgcgcagaccctcatcgcgctctgcggcacagtcccgggctactggttcaccgtcgcgctcatcgacgtcgtcggccgcttcgccatacagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccaactg

SEQ ID NO: 18107 - DNA, 423 bp, Zea mays
  Clone ID: LIB189-011-Q1-E1-A11
ttcacgcgtcgagacaagcctccgaccaagccttcggcccacgcgtccggtgaaacgctgagaagtattcaacatcggaatcttcttcccatcataactgcatgctcgagtatagatacaacgggaaattcttttaaggctttaatttatgagcttatgcctaatgggaacttggataaatggatacatcacaaagacaatgaggcacttccaaagcgtctaagcttagctcaaagaattgcagttgtcgtcaatgtagctgatgcattggattatttacaccacgactgtggaaggcccaccatccattgtgacttgaagccaagcaacatccttctcggtgacgatatgaatgctgtcttggcagattttggcattgcacatctttattctgattctcagtcaacttggaaaagttcattt

SEQ ID NO: 18108 - DNA, 384 bp, Zea mays
  Clone ID: LIB189-011-Q1-E1-A4
cccacgcgtccgcggacgcgtgggcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcg

SEQ ID NO: 18109 - DNA, 378 bp, Zea mays
  Clone ID: LIB189-011-Q1-E1-A5
ggagtgggccacgccctggtcccgcactgccgagaacttcgctaacttcaccggcgagcagggctacccgggcggcaagttcttcgacccgctcggcctcgccggcaccgtcaaggacggcgtctacatccccgacgtcgacaagctcgagcggctcaagctggccgagatcaagcacgcccgcatcgccatgcttgccatgctcgccttctacttcgaggccgggcagggcaagacgccgctcggcgcgctcggcctatgatttgcatgctgccggcgaacgagtcagttctcgattgcgtggggtgggtgagctcctagggacgtacggctgcagcggatcagacgccttgcctcgcagattggaggcgaaagaag

SEQ ID NO: 18110 - DNA, 118 bp, Zea mays
  Clone ID: LIB189-011-Q1-E1-A6
accactgcctttttaattgtcaggcacactggtctggaaatcagtagcctgttggctgctgttgcaagtaaccatttggaaaaggaaaatggccagaaggaacatcggattcccattg

SEQ ID NO: 18111 - DNA, 387 bp, Zea mays
  Clone ID: LIB189-011-Q1-E1-A7
cccacgcgtccgcccacgcgtccgcccacgcgtccgcccacgcgtccgattcagaaacacaccaagcgaagcacattagcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcac

SEQ ID NO: 18112 - DNA, 396 bp, Zea mays
  Clone ID: LIB189-011-Q1-E1-A8
aagaggaacagttggatatgtgcctccagaatacggggagtgccgccaggtctcctcgtgcggagatgtcttcagctttggagtcacgctccttgagatgttcacagggaaggcccccaccgacgccatgtttgaggacggattgaccttacagggcttcgtggagatagcgtttccagagaagctgatggacatcgttgatccagtactgctgtccactgatgagaggttcgcaagaaagccgcgacacagaagcgttggaggggaagagattgagaacgccatagcttctgtcactaagctcgcgctgtcctgcaccaagctaacaccatcagagagaaagcccatgggtgatgccgcagccgagatgcgcatgataagggactgctatctcgc

SEQ ID NO: 18113 - DNA, 425 bp, Zea mays
  Clone ID: LIB189-011-Q1-E1-B10
accacgcgtccgcagacccttgggcggacccttggttattgaaaatccataaccacccagtttgaattccccaaagtttaagttccgccaaaaaacccatttaggaaattggggttcacatttcggaatgctaataaaatacctttttgagaaatttccaaattggcaagagattggtagccaggccattggagaccttcagattttctataaagcatccaagcatagatttgacaatgatccagaatttaaagcaagggctcaacaaggagttgttcggctacagggaggagaagagagatatcgagaagcatggaaaaagatttgtgacattagcaggagtgaatttgacttggtctacaaacgcctaaatgtggtgcttgaagaaaagggggagagtttctataatccttatattcctcaag

SEQ ID NO: 18114 - DNA, 401 bp, Zea mays
  Clone ID: LIB189-011-Q1-E1-B11
gctaaccaagggtccccttcccttcgggttcgtccaatgggaaaggaggccttgttgcaagggccggcggcggttggaattaaatcccggccggattgcatcaattcttcaaacccttaccacaattgcactgacaacggcctccgcaaattccccaaggccaggcaccgcctcgacgacaagctccccgactcgtggaagcgcccgcccgagcaccgcaccttccaccgggactgcatcaacgcctgcaacccctaccacgagtgctccgactactgcttcaagcgcatcgccgacgccaagtcagggcttgagcgtggggagcaacagccaccagctgacgtggccaccgctgccggcacgtctgatgccgtggagcagcagcaacttgaagataacga

SEQ ID NO: 18115 - DNA, 337 bp, Zea mays
  Clone ID: LIB189-011-Q1-E1-B3
gccaaaatggcggccttggcaacggagaattacgcccccttctcctccaaggaggccccctcctccaataactcaaattcggtaaaaccggaaaccaattacggaaggataaaaaccggaacccggcaacccaaaagaaggcccggcggcggaataacaaccctggccgcaaccccctgattctccccgtgaaccaaaacaagtttcaacctccccttgtggctgggagtccgcgccgcattcaagttccccatcgacaaggacgtcaggaacttccaggtcctcaaagagatgtacaacgagtggccattcttcaaggtcaccctggacctgctgg

SEQ ID NO: 18116 - DNA, 417 bp, Zea mays
  Clone ID: LIB189-011-Q1-E1-B4
ctcatgtattttcattttcaaaatgatactgggaaaactcctgcaataacccaagggaatggggaagaagatcctggtcaaccccccgttgggcaatgtccaagaaagtgcatatactatgtgacgccttgccaacgcactattttggaggatgttcttgctagtgtgttgatggtgccttacgatcttgctgaagcagcagttctggattccctcctttcaaaagcgaagttcgagaataacaggtataagaagccccaaagaggagcaaaatcatcctccgattatgttgattggatgtgatctgatcccgagacacaaagaggatgccagattcagccgaaggcagttcggtagatttatgctggtttgcctattctccttggtcagttgcccgatagtttataaaatggaata

SEQ ID NO: 18117 - DNA, 367 bp, Zea mays
  Clone ID: LIB189-010-Q1-E1-H7
gaatatacttgggatctttgatctgcgaggctttcgggttgaaaatggtgatctccagttcctaaagtttttgatggacgttttttactattactacccgaagcggcttggccaagttctttttgtcgatgctccatttgtttttcaaccaatgtggcaggttgttaaacctctattgaaatcatatgcctccctggtaagattttgtgatgccgagactgtgaggaaggaatacttcaaagaagaaaccgtgcctcctgatttccgcgattaggtgacatgattatttcttcagtaattgcaagtcagttctacctctgcctttgtgtaacgattgaaattctaaattgtgcagattatttttagt

SEQ ID NO: 18118 - DNA, 388 bp, Zea mays
  unsure at all n locations
  Clone ID: LIB189-010-Q1-E1-G2
cacgcgtccagatggcctatagatcaaacgctgcactgtagggagcgtgaagccaccggcgaatggaatccctagccgccacctccgtgttcgcgccctcccgcgtcgccgtcncggcggcgcgggccctggttanggcggggacggtggtaccaaccaagcggacgagcagccggagcggaaccagcggggtgaaatgctctgctgccgtgacgccgcaggcgagcccagtgattagcaggagcgctgcggcggcgaaggcggcggaggaggacaagaggcggttcttcgaggcggcggcgccggggagcgggaaggggaacctggtgcccatgtgggagtgcatcgtgtcggaccatctcaaccccgtgctcgcctaccgctgcct

SEQ ID NO: 18119 - DNA, 219 bp, Zea mays
  Clone ID: LIB189-010-Q1-E1-G3
cacgcgtccaatcaatctaaacatcaatcgtaggatcgctaaggaccctcaagccagagagaatggagtccctaaccgccaacgccgtggtcgctgccacgcgagtcgctttccacgacggcagggccctggatagggaagagagcgtggttcgatccagacggtcgagcagccaaagagcaactagacgggtcaattgctctgctgccgtaaaacctc

SEQ ID NO: 18120 - DNA, 419 bp, Zea mays
  Clone ID: LIB189-010-Q1-E1-G9
cccacgcgtccgcccacgcgtccgagcagctgaacaaacatttgactgtatatcaagctgttcaaagacaagtagttcatgccgaggatgatgaagatcgattcggtggatctgatttacctgatgatggtaaccacttctgggatgatataaggggtgatgtgttcactataacgtatcagaaggctgataacacagcggagaaggggtctgttggaggttcagcttcagtgccaaaatcttccaaatcagattcttgcagaactttgtctgaaaaacagtgtacttctcttcttgatagtattttgcaaggagagcttccctgtgatttagagaaatcaaaccaaacctacaatatcttatcactattacatgtgttggagggtttgaatcagttatcacctcgtctgagactgcag

SEQ ID NO: 18121 - DNA, 290 bp, Zea mays
  Clone ID: LIB189-010-Q1-E1-H12
gacccaagcgtcaacccacgcgtccggtgatagcttatgtacctgacatattctttcattctaattttcctcattcatctaccaaaaaaaaaaaaaaaaaaaaaaaaaaaaaaaaaaaaaaaaaaaaaaaaaaaaaaaaaaaaaaaaaaaaaaaaaaggggaggaaaagaaaaaggaaaaaagaaagaaaaaagagagaaggaaagggcagaaaataaaaaaaagggaaacagaaaataaaagggggggggggtcgaaaaggaaaaaggttaaaggggaaaaccgggggg

SEQ ID NO: 18122 - DNA, 322 bp, Zea mays
  Clone ID: LIB189-010-Q1-E1-H2
caaacctccggccaagcctccgaaaaaatgccgaaaataaaccaccacaaaccgttaagtttccccaaggcttcaaggtcccccgggggctgatgacttaggaagatggactcatttgctcgaaggctggaagagaatttatgggatcaaaacatgatcggaccttggaactaaaagctccacccaagataacggtaaccaaatacacaaggcggctgtcattggtgacaccattggggatcctcacaaggacaggtctggcccttccctcaatatcctcatcaagcttagggcggttgaatcccttgtcttcgcccccttc

SEQ ID NO: 18123 - DNA, 159 bp, Zea mays
  Clone ID: LIB189-010-Q1-E1-H3
cacgcgtccagaaaaaaaaaaaaaaaaaaaaaaaaaaaaaaaaaaaagaaaaaagatcaaggggatgaggacctaaagtcttcaggttaaggtgttcgttaatcttaaatgataagatcattcgatcttgtaaatgggcattaaattttaagttcaggg

SEQ ID NO: 18124 - DNA, 397 bp, Zea mays
  Clone ID: LIB189-010-Q1-E1-H4
gcgtccacagaatattaataatataaccaccgatgtgatatgccatggagaaaagagtgtcatcaaggaaggtcataagagtttcccaagtgggcattcttcatggtctttcgctggtctaagttttcttgcatggtacttggctggaaaacttaaagcttttgatcgcaagggtcacattgcaaaactgtgcttagtttttctgcctctacttgtcgcgtcacttgtggctgtttctcgagttgatgattactggcatcactggcaagatgtctttgccggcggcatcataggtcttacagttgcttcattctgttacctgcagttctttccatatccctttgacaatgatgccctatggccacacgcatacttccaacagctagctgagacacac

SEQ ID NO: 18125 - DNA, 419 bp, Zea mays
  Clone ID: LIB189-010-Q1-E1-H5
cggacgcgtgggcggacgcgtgggcggacgcgtgggcaaagatttcaaatgttaagggaatggatgtggaattgtggacacatgatgggcttccttcagcacaactcctgaagctgatgagagatgtggttgctggccttgtgcatctgcatgacttgggaattattcatcgtgatttgaagcctcaaaatgtcttaataagcgcaggaggacctattagagcaaagctttctgatatgggtatcagtaagcacctgcaagatgacatgacttctgttagccatcatggtacaggatttggaagctctggctggcgggcacctgaacagcttcgtcatggtcgtcaaactcgtgcaatggatctttttagtttgggctgccttattttctattgtatcactaaaggcaagcatccgttt

SEQ ID NO: 18126 - DNA, 287 bp, Zea mays
  Clone ID: LIB189-010-Q1-E1-H6
cgggccgacccaagcgtcaggacttcttggtgagagcgatatgagtgtcccaggtcaatgctcatcccagccacaatttatcaccagcgttgggaggagtaaccgctccaatggccccggcactcctcttatcgaaagcatagatgttgatcaaattgttattccagagaaaaacagttggaagaacttattcccatacataaggcctggatttcccgtcccaattgcatatattgatcctggaaactttgagacggatttacaagctggagcacagttcaaatatg

SEQ ID NO: 18127 - DNA, 424 bp, Zea mays
  Clone ID: LIB189-010-Q1-E1-G10
cccacgcgtccggccttttattccccccccctctctctctaggtatgattgggctgccaagaagaccttgcaatctggctactttttgtggtcaatggtggcatatggttccggtctcctaattacatacgttgccttgaaccttatggatggccatggccagccggctctcctttacatcgtgcctttcacaatcggcaccttcttatcactgggcatgaagagaggcgagctcagaaacctgtggacaaaaggacagcccgagagagtgtgcacgcacatgcacccatcccccaaggattcgcctgttgcggtcagctcgctgtcgtatacaaggctaacgaccttacctgatgttgcctggccccggagaatgttgctgatgaccaaaacaaagtttccagggttaatgaaggagtctact

SEQ ID NO: 18128 - DNA, 78 bp, Zea mays
  Clone ID: LIB189-010-Q1-E1-E6
acccacaagtcaaggcatgtcaacgctactgtgacggtaattcctttgacacatattgtatgtgactggattgtctag

SEQ ID NO: 18129 - DNA, 415 bp, Zea mays
  Clone ID: LIB189-010-Q1-E1-F10
cccacgcgtccgcccacgcgtccgcaataatgattgtagatagatatgttattattgcattgcagttcatctatatcgatcactccagtgcttttgtttcattgtatgcttgcagccttgcacttcaatttttgcagtccaaagttctattctttacttggatatattactctcttaaaacatcaattcattgttttgcattcctttgtttatttgtagatatgaacaagtcctttgttctttaatgggtttgattttgctggcttgaactctttaggtttttgaactaatgataacatgtgtagacctgaaaattcgtagactattgtactgaaccttctgatgtttgttcctttcttcatgttgtaggttgctgatcaatttttaagcaagaaatctggtatgacgcatgaca

SEQ ID NO: 18130 - DNA, 422 bp, Zea mays
  unsure at all n locations
  Clone ID: LIB189-010-Q1-E1-F12
agcccacgcgtccgcccacgcgtccgccgaggcggggatgacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaagagcaagttcccgtggacctactccgccaaggagacgtgctacctgctgcaggggaaggtgaaggtgtaccccgaaggccacggngaggagttcgtggagatcggcgcgggagaccttgtcgtcttccccaagggcatgagctgcacctgggacg

SEQ ID NO: 18131 - DNA, 361 bp, Zea mays
  unsure at all n locations
  Clone ID: LIB189-010-Q1-E1-F3
acacaacagctccgctcgtcgatcagctctcggctgacaactccatcgcaattgggtgcctgccgacaagttctcgccgccgcaaccgccgcggtaaaaaggggagggagagggggaaaaaactggcccagatcgaaaggtacagcacgaaaaagagaggcaagagagataggggaccggagggcggcgggccggggcccaagaccgaggggctcgtgcgcaggaagctgatgaggctcctgtcgctcgtcnccttcggctgccgtgctggacccatcgacgacgcgccgccgcccgtggaccacgccgccgccgcgaggaggcgccggaggaagagggccaacaaggccgcccagctgct

SEQ ID NO: 18132 - DNA, 326 bp, Zea mays
  Clone ID: LIB189-010-Q1-E1-E2
cccacgcgtccagtacaaggcaattgagggtttccttgctggaaaaaacccaggacaagatctatttgacaagattgatacatctaggctaaatgctcacttgaaggatctaatgcctgggctcactgcaaaagtgttccgtacatataatgcttccataacattggacggaatcttgcatgaagaaacagaagatggaactgttttagaaaaaatcgctgtctatcagcgggcaaacaaagaggttgccatcatctgtaaccatcagcgtagtgtctcgaaatcacatgagtcccagatgactagaatgaacgaaaagattgatg

SEQ ID NO: 18133 - DNA, 416 bp, Zea mays
  unsure at all n locations
  Clone ID: LIB189-010-Q1-E1-G1
gacccacgcgtcaaaatccagatcagcaaagcggcagtgcgtanagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcaccttgagcgtgccgctgccgcca

SEQ ID NO: 18134 - DNA, 380 bp, Zea mays
  Clone ID: LIB189-010-Q1-E1-D11
aggtggtgaagcgactgaaaggctgcagaaaggttacatgccaacttctcggtgttgtttttgaggagacaattcctgaggagcttcagaaacatgccaccgttagaccctccgtggtagagctgctactggaaatatccagatattgtgatctctacctaatggagactgtaattgacgataagagcgaggaaaatgctctcatggccctggagacctctggacttttcagaactggtggcctgatgaaagagaaggtgctcttttgcagctctgaagttggtcgaacttcatttgttccacaatttggaacaaaatttcaaaataacaacaaccttgacaaaatttcccaaacaaccccggttaattcaatgcaaact

SEQ ID NO: 18135 - DNA, 332 bp, Zea mays
  Clone ID: LIB189-010-Q1-E1-D2
gggaaaaaaaaaaaaaaaaaaaaaaaaaaacaaaaaaaaaaaaaaaaaaaaaacaaaaaaaaaaaaaaaaaaaaaaaaaaaaacaaaaaaagggggggccccccaaaaggttcaagcttaagtaccccttcaatgaaaattaaaacccctccaaaatggcccccaaattcaattccaaggccctctgtttaaaaactcctaaacgggaaaacccttgggttaaccaacttaaacccctttgaaaaaaaccccctttccccaaccgggctaaataccaaaaaggccctaaccattcccctttccaaaaatttgcgcaaccctaaatgccaaag

SEQ ID NO: 18136 - DNA, 436 bp, Zea mays
  Clone ID: LIB189-010-Q1-E1-D5
acccacacgtcaggtcaaagggaagcagcacctatattggcaagctaagatcaaacttccttggaacatagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccacgaaggatgaactgtgttatggattccatccctgcattaactgttaaggaatgagggaaaactcctacacagactgaatttccacttagcagccttgactctttcccatcatttccattcttcacatctaaatcagctcggatagacagttcaacgtcgaaatcatccagtcagagggaagataggttggtgctgaagaa

SEQ ID NO: 18137 - DNA, 414 bp, Zea mays
  Clone ID: LIB189-010-Q1-E1-D7
ccgggcagacccacacgtcaacccacgcgtccgcccacgcgtccgcccacgcgtccgcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgcc

SEQ ID NO: 18138 - DNA, 299 bp, Zea mays
  Clone ID: LIB189-010-Q1-E1-D9
cccacgcgtccgctcatctgcgtacacggtctccctcttcctgtcagtagtagagtgagagtgaggcagcgagtgggagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagccatgtgcactacctaacggagatgcgcatcgcgcac

SEQ ID NO: 18139 - DNA, 300 bp, Zea mays
  Clone ID: LIB189-010-Q1-E1-E1
cgggccgagccacgcgtccagcagagaccgaactctgccgtctcttcctcctccctctgcacccccacgagctccatggccgccaccgccatgattgggattaccaacctacgttgccgccacgacccgctctcctcccttccccgggctacgtcgtcggccgcccggtcctgtacgctgcttcctcctcgatgccgccgccattcttcttgctgctccccttcctcctccgtctctccgtgccgggcccgggtccgaccaacagcagcactgaagcgcatccctgccgccgacaccggc

SEQ ID NO: 18140 - DNA, 390 bp, Zea mays
  Clone ID: LIB189-010-Q1-E1-E12
agcggacgcgtgggcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtg

SEQ ID NO: 18141 - DNA, 423 bp, Zea mays
  Clone ID: LIB189-010-Q1-E1-C7
aaaggacccaggggctgctatgatgcttgcggagctagcaatggaagctggtttgcctaagggtgttttgaacatcgttcatggcaccaatgatgttgtcaataatatttgtgatgatgaggatattaaggctgtatcttttgttggttccaatacagctggtatgcatatttattctagggcatctgcagcaggcaagcgtgttcagtgcaatatgggagcaaagaatcatgcaattatccttcccgatgctgatagagatgctacattgaatgcccttattgctgctggatttggtgcagcagggcaaaggtgcatggcattgagcactgctgtttttgttggcggttcagaatcatgggaggatgaattagtcaaacgtgcaagtggccttgttgttagttcaagaatggttaatgatgc

SEQ ID NO: 18142 - DNA, 429 bp, Zea mays
  Clone ID: LIB189-010-Q1-E1-B12
gacccacacgtccacgcttcatacttggtctcttgttaaactattgacaatgtatcttgttttttgttgaaaagtttagtacttgagtgtcaatcatacgtattcgcttgctaaactattgacaatgtatcttgttctttgttgaaaagtttagtacttgagtgtcaatcatatttcagagtcattgtgatatactgagcttggaggttttggccattgatctgcagaagttcaatacaattggaagaataagttaaaaaaaacgtggtccaaagtaaccttcagcagtaatgtttgtgtggcaaatgctcttccggagaattgtggtgatgcaaaccttgtaccactgaatatactgtcaatctgctatcttttccgtggcctctaactcttagagtgtgtttggtttgagttgaggaattacttcat

SEQ ID NO: 18143 - DNA, 403 bp, Zea mays
  unsure at all n locations
  Clone ID: LIB189-010-Q1-E1-B2
aaatctgatttcgcgtaaatggactcatcatgttgacactctaatggtccttggaattgggaattgggcaatgttggaaaggctcaaaggaaaatgggaatcaagaaaaatgggtggaattgtagcaaaactggtgaagtcttaagaattataaaggggaatctaaaattaaaactaaggcaaacgatgatacgaagaaacagcaaagacaatttctcatgcaaatcttctcaacaaattttcattaaagcattttcaattacattctttggtgantggggtgacaagagccagattgctactattggcttggctgctgatgaaaaccatttggtgttgtcctgngtggaatcatagcgcaagcactctgcactactgctgctgttcttggtggaaagagcct

SEQ ID NO: 18144 - DNA, 138 bp, Zea mays
  Clone ID: LIB189-010-Q1-E1-B3
cacgcgtcaaataaagcactgctgtggtaggactttgtgtgataatcatggagtggcgaatttctagagaatggcatgtactccagtgctacctgtacattgaccagaaaaaatgtggtatctagttgccttctgtgt

SEQ ID NO: 18145 - DNA, 411 bp, Zea mays
  Clone ID: LIB189-010-Q1-E1-B6
gcggatgctaagaaggtggatttgtcatccacttaaagacattgatgctatcaataaaaggcttgatgttgttgaggggtttatccaaaactgtggactaggccctacaacacttgggtatctccagaaaattcctgatcttgagagattattaggacaagttagatccactgttgggttatcatctttgcttcaactgccctttattggagaaaaaataataaagaaacggattaaaacatttataatgcttatcaatggcctccgcaatggtattgacttgctaaatgatttacaaagagcggaccatggtatcttggcgctttataagattgtggatattccatcattgagctatcttcctgagttaatccataagtttgaagagagaatgcaaaatgagtttccatg

SEQ ID NO: 18146 - DNA, 393 bp, Zea mays
  Clone ID: LIB189-010-Q1-E1-C11
cccacgcgtcggcagactcgtgggaggcagcgtgggatccacatggaagtgtgagactgcttgttgccactgttgtcggcgaagggcacgtctgcgccaatggctaccacacactcatcattgcgattcaatagctactagggatgctgccatgcacacgttcattgccaatcggcagagtcttttggcaccctgctgacgatacgacaccatcccgaaagctcagtatcctgtacaaacttttcccgatatcattcgtaatgaaccaggcaggaggacaatcattcacaggcaagcaaaggcctcttgatgtggtcccagccaagatcgacgataggtccccgatattcctcggaagctacaacgacgtggaggagatcatagcgttgtacg

SEQ ID NO: 18147 - DNA, 426 bp, Zea mays
  Clone ID: LIB189-010-Q1-E1-C3
acccacagcgtccgcggggaactttccagcctgattgatcttgacttgcgtgcaaaccagctaaagtctcttcctacatcatttggaaatctcacgagcctcgccaatcttgacctgagctcgaatctgttgaaggtccttcctgattgtttaggaaagttgaaaaacttgagaaggttaattgctgagacgaatgagcttgaggagctaccctatactattggatcgtgcacctctctcgtggagcttagactggattttaatcagctcaaagccctcccagaagccattgggaagttggaaaacctggaaatcctgacgttacactacaacagaatcaaaggcctgcctacaacaattggccatcttaccaggttgagggagctggatgtcagtttcaacgaagttgagactatacctgagaac

SEQ ID NO: 18148 - DNA, 422 bp, Zea mays
  Clone ID: LIB189-010-Q1-E1-C5
tgtcaattaggtggtctttggacttttgtcgctctccatggagcttttgcactaataggtttcatgctacgtcaatttgaacttgctcggtctgttcaattgcggccttataatgcaatttcattctctggtccaatcgctgtttttgtttccgtattccttatttatccactgggacaatctggttggttctttgcgccgagttttggcgtagcagctatatttcggttcatccttttcttccaaggatttcataattggacgttgaacccatttcatatgatgggagttgccggagtattaggcgcagctctgctatgcgctatccacggggctaccgtagaaaacactctattcgaagatggcgatggtgcaaataccttccgtgcttttaacccaactcaagctgaagaaacttattc

SEQ ID NO: 18149 - DNA, 418 bp, Zea mays
  Clone ID: LIB189-010-Q1-E1-C6
gacccacgagtccgtgtcaattaggtggtctttggacttttgtcgctctccatggagcttttgcactaataggtttcatgctacgtcaatttgaacttgctcggtctgttcagttgcggccttataatgcaatttcattctctggtccaatcgctgtttttgtttccgtattccttatgtatccactgggacaatctggttggttctttgcgccgagttttggcgtagcagcgagatttcggttcatccttttcttccacggatttcataattggacgttgaacccatttcatatgatgggagttgccggagtattatgcgcagctctgctatgcgctatccacggggctaccgtagaaaacactctattcgaagatggcgatggtgcaaataccttccgtgcttttaacccaactca

SEQ ID NO: 18150 - DNA, 397 bp, Zea mays
  Clone ID: LIB189-010-Q1-E1-A10
gtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacac

SEQ ID NO: 18151 - DNA, 417 bp, Zea mays
  Clone ID: LIB189-010-Q1-E1-A12
cggacgcgtgggcaaggagatctccaagagcaacgtggtggatgacatggtctcaagcaatgccattctctatgggcccggcgagcatcccgatcatgttgttgtcatcaagtacgtgccgtacgtgggagacagtaagagggctatggacgagtacacatcagagatcttcatgggcggcaagagcaccatcgtgctgcacaacacctgcgaggactcgctcctcgccgcgcctatcatccttgatctggtgctcctggctgagctcatcaccaggatccagctaaaacctgagggaacggacaagttccactcctttcacccggtggccaccatcctaagctacctcaccaaggcaccactggttccccctggcacaccggtggtgaacgctctggcaaagctagaggcgatgct

SEQ ID NO: 18152 - DNA, 410 bp, Zea mays
  unsure at all n locations
  Clone ID: LIB189-010-Q1-E1-A2
tccatcgatcgctagctagctgacgaccatggcgtccctctcctctgccgccatcaccgccccttccttcacgggcgcgcccgctcgcgcaatggtcaacaagaggtccttcaacgtgcgtggctccctccgcaagggcactggcaacggcgccgtgggcgttgccgccagcctcctgctttgcggccgccgccgcaatggccaagaggtgctgctgggcgcaagccacngcgggctcgtcttcgagcccagccagttcaccgtcaaagccggcgacaccatcaccttcangaacaacgccggcttcccgcacaacgtcgtgttcgacgaagacgaggtgccgagcggcgtcgacgcctccaagatctcgcangaggagtacctcaacgcgccaagcgagacctactccg

SEQ ID NO: 18153 - DNA, 446 bp, Zea mays
  Clone ID: LIB189-010-Q1-E1-A3
ggcacgacgtacacccacacgtccggatggagctaatgaattagccgtaagtatacacaatagtactcaatctaagcaactagaatcaacatcagattcggctgaagatagcatggatgatagagagcacgctgatgctaaaaggatggaaacgatatttcattttatgatcgcatctttgaagtctgggcgatcttctgttctactggacactattattaggcttgtgtacccaattctctcactacaggaaacatcacataaagatttatcattgcttgctaagtcagctttcgagttgctgaaatggaggattctacatcggccttttcttgaaactgctattacgtctattcttcctttagtcagtgatcctaactggcgtaccagatctgcactgttatcgtatctcaggacctttacctacaggcacacattcatacttt

SEQ ID NO: 18154 - DNA, 397 bp, Zea mays
  Clone ID: LIB189-010-Q1-E1-A4
ccacgccgtcgagtttaatgcgtgaatgtgtaaatttcatttcatgccatctgtatgtatgaaacggattcaacagcgcattcggtttctttaaaacagctgaaaatagcatggatgaaaaaaaatcaagctgatgctaaaaggatggaaaacaatatttcattttatgatcgcatctttgaagtctgggcgatcttctgttctactggacactattattaggcttgtgtacccaattctctcactacaggaaacatcaaataaagatttatcaatgcttgctaagtcagctttcgagttgctgaaatggaggattcgacatcggccttttcttgaaactgctattacgtctattcttcctttagtcagtgatcctaactggcgtaccagatctgca

SEQ ID NO: 18155 - DNA, 418 bp, Zea mays
  Clone ID: LIB189-010-Q1-E1-A5
cggacgcgtgggcggacgcgtgggccagaggcacagacgagacgacagagatgaaggacggaacgtcgtcggggggaggggcgttcgctgcgggcagcgatccaaggcagccgtcgacggcgaagccatacgcgccgccgaagctgtcgccccaggacctacccatcgactatgcaggcttcctcgccgtcgccttcggcgtcctcggcgtcatgctccgctacaaggtgtgctcgtggatcgcaatcatcttctgcgctcagtcgttggcaaacatgaagaactttgagaacgatctgaagcagctttctatggccttcatgtttgctgttatgggtctggtgacgaactattttggccccgctcgtccaggcagtacaaagcgctaaactgcggaagaacatgtgctacattcttc

SEQ ID NO: 18156 - DNA, 411 bp, Zea mays
  unsure at all n locations
  Clone ID: LIB189-010-Q1-E1-A7
cggacgcgtgggggcgagcgtgatggaccacctctacctggtcggcttcaggacccccggcggggtgtggtgggagttcggcaaggacggcgacacccacctcctcgacgacaacgccaagtggctcggctttggcggccggtaccaggacctcatcggcagtaagggcctggagaccgtcaccatgggccgtgccgaaatgaccacggccgtcaactacctggcgaagaagacgacgacgacactagcagaggcggcggaggaggaggaggagctgctgctgctgcaggcagcggctgaccccaaagccgaggagaagagcaacctggcgaagctagtgatcatggtatgcgaggggctgcggttcttcaccgtgtcncgcaaggtanacgangggttcaagaagccgca

SEQ ID NO: 18157 - DNA, 404 bp, Zea mays
  Clone ID: LIB189-010-Q1-E1-A9
cgtccagccacgcgtccggtccaatatcatcctcgatcgggagccggacatgtcccgcgtcatcggctgcgtcaccttcgccactgcggatgcgatgcagttcaccatcgacggcacttatacgtcaaggagctgttcagtcgcacaatcatcgtcttcgaagtcgattctcgtggcagctgtagtcgcgtcggcgctaggtacgatagtagcctttgtggcggctgcaatagccgtaagatttccagtggagatgtgctgagcattatattcccaggtggaccatggctatcagtatctcaggttctgtaacgaggagtatatagtcgtcgaacattagagcgtgggttcgtgactacgctagtctacgttgtacctcatttaagtagaccttgctactgtgt

SEQ ID NO: 18158 - DNA, 450 bp, Zea mays
  Clone ID: LIB189-010-Q1-E1-B1
gccgagccacgcgtccaccaaaattggatcagcttcgagttcttcacagatgtattgcaagggtcacggaggaaattcaggaaacaagatttaacactgcaatatctgcaatgatggagtttctgaatgctgcatacaagtgggaaacccagccaaaatctgttattgaatcctttgttctgctgctttcacccttcgcgccacacttggctgaggagctttggtttcgcctcggacatccacaatcattggcctatgaacagtttccagaggcaaaaagtgagtacctggaggaatcaaagcttgtactccctgtccaaatcaatggaaagaccaggggtacaatccttgttgacaaagcgtgctctgaggatgatgcttttcgaactgcagcctcggatgagaaactctccaaatatcttgatggaaaaggcatcaagaagaaaattt

SEQ ID NO: 18159 - DNA, 426 bp, Zea mays
  Clone ID: LIB189-009-Q1-E1-H8
ccgacccacgagtccgcagcaaacaacaaacaatggcaccgaggctagcgtgcctcctagctctggccatggcagccatcgtcgtggcgccgtgcacggcccagaactcgccgcaggactacgtggacccgcacaacgcggcgcgcgccgacgtgggcgtcgggcccgtgtcctgggacgacaccgtggccgcgtacgcgcagagctacgcggcgcagcgccagggcgactgcaagctgatccactccggcgggccctacggcgagaacctcttctggggctccgccggcgccgactggtcggcgtccgacgccgtgggctcctgggtgtccgagaagcagtactacgaccacgacaccaacagctgcgcggaggggcaagtgtgcggccactacacgcaggtggtgtggcgcgactcccacgcat

SEQ ID NO: 18160 - DNA, 429 bp, Zea mays
  Clone ID: LIB189-009-Q1-E1-G5
ggccgcactctcgcggactacaacatccagaaggagagcacccttcaccttgttctccgcctcaggggtggtatgcatatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctccatatggaggttgtcgaagtatctgctgttcgtgtcagtgttggtttaataatggaccggttgtgttgtgtg

SEQ ID NO: 18161 - DNA, 437 bp, Zea mays
  Clone ID: LIB189-009-Q1-E1-G6
cccacgcgtccgcggacgcgtgggcttcttttgatcttttgattgtctttgcaagagttgaatgaagtgaaggaaccggtgcatttttattttcgcaaggaaatcgatactctcttaatgggaattgtaagcttaaagctgtggctgtatcaagagatgaagggttcacggatgccagattacatacctaactgactttttttgtggtcggtcctccaaaggtctcatctgtaattgtgaatccaagtgagttgagctcagctcttttgaatactttggtaatccctgccctcttcatcttcccactccagttctgtttcatcagctcatcatgatttatttatcattcctgtgattcattgcacgatcattatcaatttgtttctttatttgcatggacattaactgttacaaaatgccgccttcgccctcctgtg

SEQ ID NO: 18162 - DNA, 405 bp, Zea mays
  Clone ID: LIB189-009-Q1-E1-H1
aatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcg

SEQ ID NO: 18163 - DNA, 437 bp, Zea mays
  Clone ID: LIB189-009-Q1-E1-H10
ggccgcgtccgggaaaacaaccaccacgaccccgtccattccgttccacttccacccgagctcagcgatcgcggcggcggatgcggatgcggatggggaaggggccgtcgtcgcgggcggggtcgcggcaccggcagttccgcgcccgagccatgacccgcgtcgacgacctccaggaggtcttctcgggcctgcagtccgcgcgcaaggactcacgctccgcggacgccgccgtcctcgaggcgcagctccagcagatgctgcgggagtggcgctccgagctcagcgattcctcccccgcctcctccctgcagggcaacgccagggaactgtcggattcgccttccgatactcttcgtctgctgcagttggtggtggccgaggaggaggatgacgccacgagcaagatggtcgagcagcagcagcagcagccccca

SEQ ID NO: 18164 - DNA, 415 bp, Zea mays
  unsure at all n locations
  Clone ID: LIB189-009-Q1-E1-H11
cccacgcgtccgcccacgcgtccgcccacgcgtccggacgagggaggggaaaagagagatggtggaggcatcgccggagtccggcgccgcggcgaccggaggtgcctctagtacggcggcggtgcggaaggggaagtcatgcaagggctgcctctactactcgtcagtgctcaagtcccgcggttacaacccaatctgcgttgggatcccccgctccatcccccaagttcctaactacgtggtggatgaacctaaggaggaggcgacggcgcaggggcatgacctcaggcggttcaggtacgggtgcgcgggttactccatgttcgtggacaacagggacggccagggtggtgagagcgagggcaagacgttgttgccatattgcangggcctcgagttattggtggacagcaga

SEQ ID NO: 18165 - DNA, 246 bp, Zea mays
  Clone ID: LIB189-009-Q1-E1-H12
agcccttcggtgacatcatacgttccggtcaaggaagggcacactaataatggtgacggaacccccggtttccggctccccggccacccaaggtgcccctagtatcgcccgcgtgccaaaggggaattcattcacgggctgccctctactacccgtcagtgctcaagtcccgcggttacaacccaatctgcgttgggatcctccagtccatcccccaagttcctcactacttggctggatgaaccc

SEQ ID NO: 18166 - DNA, 447 bp, Zea mays
  Clone ID: LIB189-009-Q1-E1-H2
gtacaggtctagaagtcccgggcccacgtccacgcccccaacacgcccacaacccgaagcagcgaaagctcccctaaccctctccgcgcatccgatcgcaaggaagaagagggagatgagctactacgggcagcagccccccgtcggcgtcccgccgcagcaaggctacccgggcaaggacggctacccgccagcggggtacccgccggccggctaccccccgccggggcagggctaccctccgcagggctacccgccgcagtacgcgcagccgcctccacagcagcagcagagcagcgggccttccttcatggagggatgcttggctgccctctgctgctgctgcctcctggacgcctgcttctgagagtgagaggggccgaccgacggattcgacacggcgacaagtgaaactactagctttctatgcgagggagatagatagag

SEQ ID NO: 18167 - DNA, 435 bp, Zea mays
  Clone ID: LIB189-009-Q1-E1-H3
acccacgcgtccggggtgatggagaaaaaagttgtgaagacattgatgaatgccaagagaaactttattgtcagtgcaagggttgcagctgcaagaatacgtggggaagctatgaatgcagctgtggtgatgacaatatgctatacatgagagagcatgacacttgcatcagcaaagagggaactgccactactgttggctggagcttcctctgggttattttctttggacttgtttttgccggggttggagcatacgctgtgtacaaatacaggctgcggagttacatggattcagagatccgtgccatcatggctcagtacatgcctctggataaccaagaaggagcaaaccagcatcaggtcgtgcacgccaatgatatctgaagctgcactccttttctgaagcagaaataaaaggggcgtgcaacatttc

SEQ ID NO: 18168 - DNA, 427 bp, Zea mays
  Clone ID: LIB189-009-Q1-E1-H5
agcacctctgttgttaccacttgcatccctattgttgaagctttgaaattttagctgtattttctttgcaaattctatttacaattaaatatcacaagcttaattgattagttttgcatgtcgggacatcttaaatcgaataagttgttgttttgttactacaatgcgaccttgatttttacaggtgagagcaagagctgcggacctcaatttgtcacctacttctgatatcaacttattggagagccgtgatatccacatacattttcctgctggtgctgtgccaaaggatggcccttctgcaggtgtgacattggtaacggcactagtgtcgctttttagtaacagaaaagtgagagcagatactgctatgactggcgagatgactctaaggggccttgtattgccagttggtggtgttaaagac

SEQ ID NO: 18169 - DNA, 430 bp, Zea mays
  Clone ID: LIB189-009-Q1-E1-H7
ggctgcagtatattctgtgagaatggcatggggtcaaggtgctaagaggtccatactagggcttctctttcgttctcagcaccaaactgctcgggcatactcttcttcagcattccagactcaccaattgagcactcatgttccccaagatggagtgtttattaggagattcggctctgaggtgtcttcttcagagcaaatgaaccttattaagcaactcagacaaagaacgagtgctccaatcaaagatgtcaaggcctctctagttacctgcaactgggatattgaggctgcacagaaggacctaaggaagagaggtgttgctcttgctgccaaaaagtcttcacgcactgctgctgaaggtttgctagctatcgcacaagatgacaaaagggctgctgtagttgagcttaactgtgaaactgatttc

SEQ ID NO: 18170 - DNA, 420 bp, Zea mays
  Clone ID: LIB189-009-Q1-E1-F1
agtttcgcgtccgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagataaggctgccgtcaagaagatgtatgacatccaggcaaag

SEQ ID NO: 18171 - DNA, 271 bp, Zea mays
  Clone ID: LIB189-009-Q1-E1-F11
gggccgagcacgcgtccacccacacgtccgcccacgcgtccgcccaagcgtccgcccaagcgtccgattgggactaaattaacaatattaagggtaatttgggaaacccattttcccctgggattcctaatttccaaaggaaaatgaactaattttcttgggaaaatgaaattcccttgggaaaaatgtggtttccaaactaacctaacccttagagttaatttgtcaactctatttttctaaggaaattcctctcataaggcttggtttc

SEQ ID NO: 18172 - DNA, 415 bp, Zea mays
  Clone ID: LIB189-009-Q1-E1-F12
tgggcggacccttgggcggacccttgggcggacccttgggcggacccttgggcggacccttgggctataacctctaaaatattcttcatgaaaacatattagttcctgcgtaaatgtgatttgcaaacttatctgctgtttaaattgtagaccatataagttgctatcctatctgctgacgaagtcggtcatgcattgggctagcttccatgttcattttgatccttttcaagcatcatttgtaattcttaaaggttgaacctatgctgtgattttttatttcaaaagtatagtgatctattagcagtttgatttcatgtgattcatctttctaatgttcttgatagtgattttctcgatgaaataattggttcatgatgtttttggtcatatccaggtagctgctaatggagat

SEQ ID NO: 18173 - DNA, 327 bp, Zea mays
  Clone ID: LIB189-009-Q1-E1-F3
accaagcgtccgcccacgcgtccgcccacgcgtccgcccacgcgtccgaaaaatatcaaaaaaaacaagaagatctcaaaaaggaaagaaaggtaacaaaaaaaaaaacgatcaacctttctctaaaaaggattggtaatgacatcaaggcaacgtcagtgttcactgtgcacaatcatcgggaatactctcgtatccagaaaacagggtatgaggattgcttctgaaggtctgaagcacagaatctttgaagtttgcctaactgatcttcatggcgacgacgataaagcttacacgaaaatcatgttccatgctgaagatgtgcaa

SEQ ID NO: 18174 - DNA, 416 bp, Zea mays
  Clone ID: LIB189-009-Q1-E1-F5
caaggcagtatccttggtatatcgtgacattttcaacaatttcactactagggaaatgggccttgctatggtactctgagtctctgacaaccccttaggaaatcaccttacacctacttgtgttgaaaaaaatgctaactatatataattgatctaacatgcaactatcatataccttttcatgacatgtcacacctgtgacatagtaattcatgttcgcgtactcgcctatacacatttctcttttgtttatgtcacatttaagaactaaaaactttactcatgtcacattcaaacaaaaacattgcaaggaagaattatgcaagtgtcatgttgcaaaaaaaggttataaggaagtgacatattctgacaagaagtaataggaaatcacgttagaatactatatcacttacatg

SEQ ID NO: 18175 - DNA, 447 bp, Zea mays
  Clone ID: LIB189-009-Q1-E1-F6
aggagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgc

SEQ ID NO: 18176 - DNA, 434 bp, Zea mays
  Clone ID: LIB189-009-Q1-E1-F7
cccacgcgtccgcaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggcctgcagacgggtgaccccgccgggttcaccctcgccgacacgctggcctgcggcgccgtcggccacatcctc

SEQ ID NO: 18177 - DNA, 270 bp, Zea mays
  Clone ID: LIB189-009-Q1-E1-F9
ctttcgtggcataggccacaactgggagccaatcgtattacacgacctgttggaactcacatcacaaagctttgatttgtttacattaaatgtcgactccggcgatcaatagaggtgcttgaaatggcgccggccttgttctgtgatggctccgaaattctatgcgatgtctgagaacaaccttcatgttgtgttcctggagctctcatgcacacagcccaacacgctgcttgtcacggacctgggcataaatggtgtgccaacgttcaa

SEQ ID NO: 18178 - DNA, 391 bp, Zea mays
  Clone ID: LIB189-009-Q1-E1-G1
acccacgcgtccgaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgc

SEQ ID NO: 18179 - DNA, 442 bp, Zea mays
  Clone ID: LIB189-009-Q1-E1-E8
aagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcatctactgctgctgaatcaaaggtcttctacctcaagatgaatggtgactatcacaggtatcttgc

SEQ ID NO: 18180 - DNA, 402 bp, Zea mays
  Clone ID: LIB189-009-Q1-E1-D5
ggtaaagcagagagcctcttgctgttagtgaactaaggcgacggagaccgcgagggcggcgaactaggctgggcagcgatgatggcgacctcggccagcggcgtctccctcctcctcctcctcgcccatccggcgccgccaccgcaccccgccaacggcgccagcagcctgtggcgcggcggtggcgccgcgctagctcctcatcctgctcgcttcgcggccaagaggaggacgctccggttggttaacgtcagcgtcagctgcagcgccgaggcgctgcgctccgacggcgctggcgcggagccggcggtgccgcggtctgtgccggtgcgcgtcgcctacgagctgcaacaggccggccaccgctacctcgacgtcagaacggagggcgagtttagcgcc

SEQ ID NO: 18181 - DNA, 402 bp, Zea mays
  unsure at all n locations
  Clone ID: LIB189-009-Q1-E1-E10
acttacacttcngcatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtcgaagcccttcgctggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctccagg

SEQ ID NO: 18182 - DNA, 392 bp, Zea mays
  unsure at all n locations
  Clone ID: LIB189-009-Q1-E1-E11
gcgtccacccacacgtccgaataaaccaaacagggtagagactaaactttagttccgaaactaaaggaaccaaacaggtaagaccttgcctctcagcaccctgcacgtcataacactgaatatgaaggacagaatagcagtatagtgggaaacagcaagcctcacaccttggtttaggaacttatttaaggattcgaggttcttggtgcatgtactgacggacagatcatccacagtaactttaatacattgatgtgcttgttcccaggcagaggaagggcatgtcgagcttctgggcaatcttctgtatgctgcaaaggttgtagcagagcaggaagggcttgctgatggcttcagaattgtcatggacgatgggcccagangatctcaat

SEQ ID NO: 18183 - DNA, 415 bp, Zea mays
  Clone ID: LIB189-009-Q1-E1-E2
accacgcgtccgcccacgcgtccgctcagatttgaataacactccccaaattgtatactggtatacttaatttggggtggtcgagctgttagcatccccttgcttgtcaggcgaccgtcaagttgtcttctgtgcattgttttcttatcccaggtcaggtactggtctgaatttaatcaaatgagcatcgagctgttagaaaaccaaggcaccaactctaatagattcaccatctggaaagcgagggcagttatcatgccttgtgaagatggtttgttgggattgcgattccctttatgcgtcctattttttttatttgtcatcttctgttgtatcatcctttctttcaactatagtttcatgtggtacatgatgccttttgttaccttcgccacagtactgctcacgaatagca

SEQ ID NO: 18184 - DNA, 443 bp, Zea mays
  Clone ID: LIB189-009-Q1-E1-E3
agctcaacgaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggcgatggccagatcagctacgaggagttcgtcaaggtcatgatggccaagtgagtaaagcctgcggtaacggtatagtaccccgcgggaattgaaggaggaaaccaaaccgtgcatcgcatattagaaaggcagtgcaggtcttgtttccttcgtcttccccatgaagaaaccgtactagctgtagctgctgaacgtttgagtccccctgctgccacccttatctccatttgtgtcatcgaaactccttgcttcacctgctgtgtgaatctgtacggctttgcatgttctggacactga

SEQ ID NO: 18185 - DNA, 414 bp, Zea mays
  Clone ID: LIB189-009-Q1-E1-E5
aaatgaaggataaggacatgaagtgtataaagattgaagacatggaggctccagtattcaaggccttgctccatttcatgtattgggatgagttgccggatattgaagagcttactggtgtaaatacaacttgggtatccaccttgatggctcaacatttactagctgctgcagaccgttatgcattggagagattgaagttgctctgtgaacttaagctgtgtgaagatgttgcaataaatacagtggcaaatactttggcactggctgaacagcaccactgttatcagctaaaaactgtttgcttgaaatttgtagctttgcctgaaaatttgaaagctgtcatgcaaaccgatgggtttgattatttgcaacaaagctgcccatccctcctgaccgagcttctcgagtatg

SEQ ID NO: 18186 - DNA, 408 bp, Zea mays
  Clone ID: LIB189-009-Q1-E1-E7
gctaattctacttctacttcggaaccgccgccgctcccggcgcctcggattatcaactaccgcaggaggtcgcggcggcaggatcggtggtccagcgtgcgatggcggcggcgcctaccgtgcggggctacgggccagcgtcgccgtcgtcgtcgtcgtcgtcggtggcgctgcctcggccgcgatcgcgggtgcccgcgccgctcgtgcccgtgacgacgcggcggggggcgccgtcggtgcgcctgcgcgcggcgggcgcggacacgcctccccgcggcggcctgcagctccagcggctggaggaggacgaggggctgtcggggaccgtgttcggccgaggggaggaccatgaggtgtcggagaaggtcggggaggagaccgtggagcggtggatgcgggagtcga

SEQ ID NO: 18187 - DNA, 382 bp, Zea mays
  Clone ID: LIB189-009-Q1-E1-C2
acgcgtccaggcaagcaggtcggcgaggagggcaggaagaccgaagaccgagccgtgcgggggctcgggacgggaacgggacaggaccccacaatcccagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaacccggcttcgacttcgacgacaaaatcctcggcttcatcaacggctacaagcgcacctttaatctcgcttgcattgaccacagacgcacaccggagcatccggcgaggagctgcacgcttgaaaccgacga

SEQ ID NO: 18188 - DNA, 417 bp, Zea mays
  Clone ID: LIB189-009-Q1-E1-C5
agtgacaacggagcttgtcttaaaagacaccttgtctgcaacggaatgaatgactgcacggatggtagcgatgaaaaaatgtgtgaaaactgggagtgcaattttgatgaattgaaatgcccgtcttccaaccaatgtattccgatcgtctggaaatgcgatggaaccaaacaatgcaccaatggaacagacgaagaaaactgttcagaaacatgcccgaaccctgatgatttcttctgcccaggagggccttgcataagcagcacaaaacgctgtgacggtgtaaacgactgctcgaacggaaaagacgaagccgattgtaaagatacgtaagactgcgacgattccctttaggtcgttaccgctttgttttttaaaaacatttttctttgttatgatttttgtaaatatgtacgt

SEQ ID NO: 18189 - DNA, 394 bp, Zea mays
  Clone ID: LIB189-009-Q1-E1-D12
gagccacgcgtcgaggggacccaacaacaaaaatcaaggacaagccggcaaccaaaaatcctgtggttgggaacccggcgaactttgccaatggcaaacttaaggaggaaatgttggccatcaggtttggttcggtagaaaactgcaagaagttcaaggagttggttgaggagatagctgagtcgcttacaaagaacgagggcaaggaaggtgaagatggtggttccacggctggattgctggcgaagctcactgtgagcgagggcaaatctgagggaagtggcaagtctgagtccactgattctggcaaagtgactgaaaccaaagccgacacagccccagctgagtagttggtgtggttgcacttgcacgcagattcgcctggtgctgaact

SEQ ID NO: 18190 - DNA, 415 bp, Zea mays
  Clone ID: LIB189-009-Q1-E1-A5
tccagtacaaccggcgcaacaagtttgatcctctctggaactcacttgtacttggtggggtgaaaaagggtccaaagggtgatgagaagtatcttgggatggttaacatgattggtacccacttcgaggaaaaccatgtcgctactggatttggaaatcatatggcaatcccgatactccgtgctgaatggcgcgatgatatgacttttgaagaagctgttaagctggttgagaagtgcttggtggtcttgctgtaccgagacagatcatctatcaacaaattccagattgccaagatcacaagtgaaggatcaaccatctacccaccatattccttgaagacctactggggcttcactcacttcgaaaacccagcccaaggcgctgtgggatcatggtagatttatgctctgca

SEQ ID NO: 18191 - DNA, 431 bp, Zea mays
  Clone ID: LIB189-009-Q1-E1-B1
gggccgagccacgcgtccaccagaaacccacgcgacgcgaccgaccaccatggccgcctccgcgctcctcctctcgccgcggctcgtgtctttcccgcctcacccgagcctcgccccactcttcaccaagagaccaccgccctaccccctcggcggcgccggcgcgaggctccgggccgtcggggacgggcccggcgcggggctgccacccgagcaggccacggtctacgacggcgcctacggtccctggaccctggaggactccgacgtgcgcgaggtcctgctgtaccggtcggggctggtgacggctgcggcgtccttcgtggcggcgtcctccgcggcgttcctgccggaagggaaccccgccgcctccgccgtcaccggcgccgccgacctcctgtacgccgccggcgccgcggggctggggctgt

SEQ ID NO: 18192 - DNA, 414 bp, Zea mays
  Clone ID: LIB189-009-Q1-E1-B2
acccacgcgtccgcccacgcgtccgcggagaccaacggccgtgcgtcctcgctccttgtgcgctgcgttcgcctccatagcttctgcaggttcatccaacaccttatgaccattttttcttcctcagtagcgcaaaccagtatctacgattttccagtctatcgatcttcgcggccgtcaatgtcgccctcgtcctcgctcttctccctaacccagatgatagggagtcagcccgtgcctgaagctggttcatccaacaccttattattgccttttcttcttcctcagtagtgtgtaccggtatctatggttttccaaagtctcgaatatttgccgccgtgaatgtcgccttcgccctcgctcttctccttaacccggacgagaagaagtcagtccatgtcggatctgaatgat

SEQ ID NO: 18193 - DNA, 455 bp, Zea mays
  Clone ID: LIB189-009-Q1-E1-B3
gggccgagccacgcgtccgaccaaacgtccgcaaatggtatggtatgttctgaacaattgtagtcaggttgacaaatatatgaaaaggttcaaaaatgatttacaaagaaatggaatgcctaacattgaaaaaacattgcaaaaaggattccagacttggttcaaaaccaatatcctaagaatgaagaatataaatcaagaagacgctgatgatgatctattttccttggcttgtggtcctgatttcagagttcgaaaatactcctcacgcatagtgaatggtgtgcggtttaacactagtgaccgtgacaagcatcgaaagacacaaaatagtggagtaatgacacaaggtactcataacggtcaagaaattgatttttttttggaaccttaagagagatcattcagttagagcataaccttgatgagagatcagtagttttgtttaaatgtga

SEQ ID NO: 18194 - DNA, 442 bp, Zea mays
  Clone ID: LIB189-009-Q1-E1-B5
ccgggccgacccacgacgtccagtcacttacactacactgatcagcatacactgcaaggatggcgacatggaggaggctagaaagctgttccgaaaaatggcacagaaaggggctacgcccactgttgtgacctacagtgttatgattcatgggtacgccacaaatgggaggatccatgaggctgaaaagttcatacagcacatggacaacaaagggtttgttccagatgtatacacctatgcatcgctatttcatgggcactgtgtcaatgggaacgtggatgtggcgctgaagctattcgaatagatgacgcacaggggaacggaacctaatgtcgtggcctatacagctctgatatcaggtctagccaacgaacggagatcagaggccgcattccaactgtatgatcatatgctgaaagctggattgagtccacatgac

SEQ ID NO: 18195 - DNA, 443 bp, Zea mays
  Clone ID: LIB189-009-Q1-E1-B6
agaccagaggacggctggaaagggtaacttcgcctcctgatttcctcccccgcccgcgctcacccggtgaccgcatctcgggcgcagccacctcccaatctccgatggcgctccaaaccctaaacccctaccggcacgcggcggccgtctccccggtcccgtcgcccgtcccgcaccgcggccacccgccgccgcatgccgtcctgcacctccctccccgccgccgcctatcgggcggcgccgcccggccgctcgccgtcgctgccgccgtctcgggggccgtcaacgaggccaggaggcgtggggttcctcaagagggcggggaggacgggaggaaggacacggacctcgccacgctcggaaacctatgcgtcgacgtcgtgctcagcgtgccccagctcccgccggcgcatcaggatgagcggaaggcctacatggagcga

SEQ ID NO: 18196 - DNA, 397 bp, Zea mays
  Clone ID: LIB189-009-Q1-E1-B7
acccacgcgtccgcccacgcgtccgcccacgcgtccgcccacgcgtccggatgagatgctggcatcatatctatcttttgttgatctgatcccttagcttgctgttgatatacatgcatgcataatattattattagtagtaattccgtcgtcaggccagcgttcgttgttcacgcttggttcgccgtcgttgacaaatatcggcgaattgaagctttaggctgtgctcagcagaattagcaagtgcaacgcgcagtgtccaagagcatcccaacaaggaagatatatcgaaggctgcagtgatcgatcgatcgatcgaggatggaaggcgcggcggctgggtggccggagccggtggtgagggtgcagtcgctgtcggagagcggcgcggcgacga

SEQ ID NO: 18197 - DNA, 443 bp, Zea mays
  Clone ID: LIB189-008-Q1-E1-G8
ccgggccgacccaaacgtcagctaatcagcttactaggatgaagcctgcaacggtggcactgctcattttgttgaacatgatgtgcatagttgcatactttgatcatggaacgatggctgaagaaaccaccttgctggcaaattcgtatggaagaaatgaaggaaccaagggcatacatcatggaagaaagctgatggacaatagtattggttcaaaccgtgagtattcaatcgatgatatgtctcatccaaaggcaccacatactgagctcaagcaaccctcatacttagctcctggttgctcaagcaaccctctcaagcaaccctcaaacttagctcctggttgcattccctaaagttcatgcatacatatatagccttccactcatcatatgctggtatccgatctatatatagacacatatgatatgttgcatatcgcc

SEQ ID NO: 18198 - DNA, 413 bp, Zea mays
  Clone ID: LIB189-008-Q1-E1-H10
acccacgcgtccacagcaggcagcagccatgtccaaggtcttcaccctcgacgcggtcgccaagcacaactccaaggaggattgctggctcatcatcggcggcaaggtgtatgatgtgacgaagtttttggtagaccacccaggaggtgatgatgttctgttgtcctcaactggcaaggatgcgactgatgatttcgaggatgtcggtcacagcaacactgcccgcgcgatgatggatgagtacttggtgggtgaaatcgacgcgtcgacgatcccttccaggacgaagtatgtccccccgaaacaaccgcactacaaccaggacaagactcccgagtttgtcatcaagatcctccagtttttggttcccctggcaatcctgggcttggctgtttccgttaggatgtacacca

SEQ ID NO: 18199 - DNA, 148 bp, Zea mays
  Clone ID: LIB189-008-Q1-E1-H12
gggaaaaagaatgccaacaataacgtgaagaactatacatcaaaaaaaacaaaacaataaaggacaccataaaaaatgaatgtgaaaaaaaaaattcatcaatttctcaatacaaaaataaacaaaaaataggggggggcccccctag

SEQ ID NO: 18200 - DNA, 377 bp, Zea mays
  Clone ID: LIB189-008-Q1-E1-H2
cacgcgtccacggaagcgtgggtggagaccgacttcaggaccggccaggacccgtggtggagtgcatgaggaggatcatccgacacaagcggtgctcagtgctcaaaagctttctccgaaggcgttgttgctacaaattcacttgcctcttgcctccaaattatatatattacacacactgcatgaaacaagaacacagctgtttgtcatctcttcactataaccttttgaacactctgaaatctaatggaatcaaatatagactttctctgccatctgctgatcaagtgaccagcagggagagcaatttagaccttttttttttgccgaaatgacttttatgtagtaggctcacatcaatttctagttacttggtc

SEQ ID NO: 18201 - DNA, 329 bp, Zea mays
  Clone ID: LIB189-008-Q1-E1-H4
acccacacgtccacctacgcgtcagccttccctacagcaactgcatacatacaacacttcaatctgcccgctcgtcttcgataaattcccaagtcaaataataatataacagcaatggtggttcccgtgatcgacttctcaaacctggacggcgctgagagggctgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgct

SEQ ID NO: 18202 - DNA, 417 bp, Zea mays
  unsure at all n locations
  Clone ID: LIB189-008-Q1-E1-H6
gacccaagcgtcagaaggtcatggacgacttcgacacgtcccgcaacgacgtcgtcgaggaggaggagttcgtgcaggggatgaggaagtggctggacgaggccaggcgcagcgtgcccgtgggcggcgccttctccagcaagttcatccacgagtaccacgagaggacgaggcaggagcacgacgagctggtcgacaggtccgacgaggcggtggagagcgtggagaaccccgggtggtgcatagccaaggccgtggcgctgctgctgctgggctccgccgccgccgccgcgttcgccgacccgctcgtggacgccgtccacggcttctccaacgccacgcgcatcccgtccttcttcatctccttcatcgccctcncgctcgccaccaactccagccaggccgtctcccgcatca

SEQ ID NO: 18203 - DNA, 285 bp, Zea mays
  Clone ID: LIB189-008-Q1-E1-H8
cgtccacccacgcgtccgacaaacaaaaaaaaacaaaaaaaaaaaaaaataaaaagaaagttctcagttcattacatagaatgcaaaaagttagtttctgataagggggatccgttcgtgcgggttctaagtattaggtcggtgtgtacgcgtcttcctcgtgctcctacacgtcaccatgtctcaattccagtggcggccgtttattagggtggcccctggaacacccctgggcgctgccaatttactgccctagcagcacagcacccttgctccagttgcggt

SEQ ID NO: 18204 - DNA, 443 bp, Zea mays
  Clone ID: LIB189-009-Q1-E1-A10
gggccgacgcacgcgtccatgcaaaccaaaacaatgtgtggtatcacccatatctttccaaattgtgggaaatggattgcatcaattaatctatgagttttactatattgtgctctaactaaccgagcatctttgttaaacttatattatgtagtacctcacctactcaaattatgtggtgacttgttgcacttgcagctcaattaagaacgttactgatttctagggctacacttatgtttcgttaactgctaaaaatgttgctgatttcataagcaacattgggaagaactatgttgccattatttcaagtctagattctgggaagaggacggtaattgatgcatccagcggggaaagaggggcctttccagccagattcttctttgacgtgccgctgggcatcaccgcgacctccgtcgcatcgccactctcgctagctc

SEQ ID NO: 18205 - DNA, 365 bp, Zea mays
  Clone ID: LIB189-009-Q1-E1-A11
gcgtcaaccggcaaccgccgcgcgcgccttttcctttcaacctaaaatcaatcggcaacctcccccgatcttttacaaaagcagtattcttttgaccaaatacaatttaattatccgggcatgaaaaatgcaattgcaaggtctgagtaattaattaattaattgtaacggtcaaccttgggcgttagtaattgtcagtcgtcctgtctgacgcagacagatagtaactccttaccactagctagcagatcgtttggacacagctgcttgttgtacgtgctacttgttgattctttgaatgacaaacgaatgaatcgatgacagtaactgattctgtctgaaagaaaaaagggccttcccaacca

SEQ ID NO: 18206 - DNA, 304 bp, Zea mays
  Clone ID: LIB189-008-Q1-E1-F4
acgcgtccatctaaggtcggtctaagtgaagcaaaaatgcttaccttgtagtagctaaatttacatgtgcggggatatacgttgtaatagaatatttctgcgccccgtacgtggctgtttgatgaaaaaaaaaaaaaaaaaaaaaaaaaaaaaaaaaaaaaaaaaaaaaaaaagacggctgcaaaggaataagatttaagtatacgtgcaattaaagtcaaagtaatgttacaacgagagaagcaacaaatttaaaataacgtggagatcaatttacaacgatcgcaaaagcaaaaactgtaac

SEQ ID NO: 18207 - DNA, 371 bp, Zea mays
  Clone ID: LIB189-008-Q1-E1-F5
cccacgcgtccggtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgc

SEQ ID NO: 18208 - DNA, 369 bp, Zea mays
  Clone ID: LIB189-008-Q1-E1-F7
cggacgcgtggggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgttacaagtttgatgcactgggaatgccaggcaactaatgtggtaataaacattttgccaatctttttttttc

SEQ ID NO: 18209 - DNA, 430 bp, Zea mays
  Clone ID: LIB189-008-Q1-E1-G2
cgggccggcccacgcgtccacccaagcgtccgcccacgcgtccgcccacgcgtccggacgagggaggggaaaagagagatggtggaggcatcgccggagtccggcgccgcgggcgaccggaagtgcctctagtacggcggcggtgccgaaggggaagtcatgcaagggctgcctctactactcgtcagtgctcaagtcccgcggttacaacccaatctgcgttgggatcccccgctccatcccccaagttcctaactacgtggtggatgaacctaaggaggaggcgacggcgcaggggcatgacctcaggcggttcaggtacgggtgcgcgggttactccatgttcgtggacaacagggacggccaaggtggtgagagcgagggcaagacgttgttgccatattgcaggggcctcgagttattggtggac

SEQ ID NO: 18210 - DNA, 381 bp, Zea mays
  Clone ID: LIB189-008-Q1-E1-E12
ctctacgcgctgctcaccgaccgggtgctcctcgtgcacgtcccggcggagcaggagggcctcttctgcgagccgttcccggtcagctcgtgggtgctcccgggcagcttcccgcagaacaatccccacaagctccacatcggcgcgccggagagctacgcgaacatgctcaagaacaacatcgtccgcaacgacgacggccccggcgcgccggcgtcgtcgtcgctgcctccgtacgtctacctccacctggagcagttccagctgaagctgtccgacaacgtcttctgcgacgaggaccaggtcacgctcagcaagttcaactggatgctgctcaagtccgacagctacttcgccccggcgctgttcctgacgcccatg

SEQ ID NO: 18211 - DNA, 403 bp, Zea mays
  Clone ID: LIB189-008-Q1-E1-E4
cgggccggcccacgcgtccacccaagcgtccgattttttttccagggcagcgtcatgaagattaaggggaacttgcatgtttgatgtacccctgtagcaaaaaattcttgtgataaaatttgttgaattagtcactgtcagggagggatctagttgtcagttgtttgtattaaagctgctggcactttccttgcagggtttctgtagaataaatgggagaaggtaacaattttcaactttatattgtttcttgtggatcaattgactgttgcacctttgcaacatcagagtccgtcattgtagaattgtgcttttctgttaccttcagaattagatgttattatacctgccatgtgtaaacatcagcatggctgcgtgttcctcctggggcctctttgtcatg

SEQ ID NO: 18212 - DNA, 426 bp, Zea mays
  unsure at all n locations
  Clone ID: LIB189-008-Q1-E1-E5
cccacgcgtccgatggataattatggaatactgtggtggtggaagtgttgctgacttgataggcatcacagaggagcctcttgatgaatcccaaatagcttacatttgtagagaagcactaaagggccttgcttacctgcactccatttttaaagttcacagagatattaaggggggcaacatccttctaactgagcaaggcgaggtgaagttgggtgattttggtgtanctgcccagctgacaagaaccatgtcaaagcgcaacacgttcattggtactccacattggatggcaccagaggtcattcangaaagtcgttatgatggaaaggtanacgtttgggcattaggtgtatctgcaatcgagatggcagagggcatggccacaagatccactgtgcatccaatgagagttatcttcatgat

SEQ ID NO: 18213 - DNA, 321 bp, Zea mays
  Clone ID: LIB189-008-Q1-E1-B9
acgacgcgtcaacggacgagtgggaccaggcgttccgcgacgccgcggccaacgagctcacgggcatcctcgaggtctgcgacgtgccgctcgtgtccgtcgacttcaggtgcaccgacgtctcctccaccatctacgcgtccctcaccatggtcatgggcgacgacatggtcaaggtcatctcctggttcgacaactagtggggctacacccagagggtcgtccacctcactgacatctgcgccaacacgtggaagtgaagcgttgcattgtactcgcactttgtacctcctcaccccccacaagggctttgggattcac

SEQ ID NO: 18214 - DNA, 428 bp, Zea mays
  unsure at all n locations
  Clone ID: LIB189-008-Q1-E1-C12
acccacgcgtccgcccacgcgtccgagattatgaatgccagccaacccaatgggcttgtcgttcctgatgcaacggtgcatcctgttaattcaacatccgatgttattgagttaatgagaataggacatgcaaacagagcagtgggttcgacaatgttgaatgaaagaagcagcagatctcacagtattgttacaatacacattcgaggtgtagatttganaacaggagctactctgtgtggtgcactacatcttgttgatcttgctgggagtgagagagtggaccgatcttctgttacaggcaatagacttaaagaagcacaacacataaacaaatctttgtccgctcttggagacgtcatattttctctaccgcagaagaatgctcatgtaccctaccggaacagcaaacttacacaagtcctaca

SEQ ID NO: 18215 - DNA, 447 bp, Zea mays
  Clone ID: LIB189-008-Q1-E1-D1
ggtctagaataccgggccgagccacgcgtccacccacgcgtccgcccacgcgtccggactagttctagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaggcgcacgtgttcaaggccgacgtaccggggctgaagaaggaggaggtcaaggtggaagtcgaggacggcaacgtccttcagatcagcggcgagcgcaacaaggagc

SEQ ID NO: 18216 - DNA, 400 bp, Zea mays
  unsure at all n locations
  Clone ID: LIB189-008-Q1-E1-D10
aactagttctagcccacgcgtccgcccacgcgtccgctgctccttgtgtcctcttctttgatgagcttgactcaattgctactcagagaggaagcagtgtgggtgatgctggaggtgcggctgatagagtgcttaatcagctactgacagaaatggatggcatgaatgccaagaaaactgtgtttattattggagctacaaacaggcctgacatcattgaccctgctctgctgaggccagggcgtcttgaccagctgatctacattccactgcctgatgagcagtctaggctccagatcttcaaggcctgccttangaagtcccctgtggcgaaggatgtggacttgaatgctcttgctaagtacactcaagggtcagtggagcagatatcacagaaatt

SEQ ID NO: 18217 - DNA, 377 bp, Zea mays
  Clone ID: LIB189-008-Q1-E1-B6
agggccgactatggatgccgtggtaactatcctagaggagcttcaagactctggtgaggccgacaagcgtcaaggacccaaggctggaaccaaacaggcgcctgctgctgctgccgcgagcgctagcaagagcagtcgcaagcttcgccggagaaccctgggagggacgaaggagacgactgttggtccaaatccaaaaccattattggcccgttctcgttagcgaggaaagggaaagcgttgcttggtcaggtggtttgggtaggtagactgtagcttgtgaatatgatctgtcctgtgtataatgagggtaatcggattcttttttggcaacgagtcttgtttttttttttaatcgtgagctgctcggtttctgc

SEQ ID NO: 18218 - DNA, 411 bp, Zea mays
  unsure at all n locations
  Clone ID: LIB189-008-Q1-E1-A11
cggacccgtcaaggtgcaacatgggcatcggcgccgcgatcatgctcaccaccctcggctccatgtgctactgcatcgtcccgcacaagctggaagaaaaaaacaccaggaagatcaggagggcctccgcgagccagtcccgcggctcgtggtcccgatcggtcgactcggacgaggagatacttaacagcgagtacaagacgaagatgtacgcgctgtagcctgtaggatggatagcaagtgtaacatgacggattcttttgtacataccagtgctttgtttcgccagaggctgctccatggcattcggctcgggatgcanaggctgcggcaccacatcagtcttcaaccaaaggactgaaggcccttcctgtgaaaccaagttcaggtcacttgaccggtgtgcctgtt

SEQ ID NO: 18219 - DNA, 438 bp, Zea mays
  Clone ID: LIB189-008-Q1-E1-A3
gacgtacagattagttcgatttcaataggggttcttcctgtatttcgtcttttattatgttagatgaaggggaaaaaatgggaactcaaagatatcgaagagtaaaaaaaaggatggaataaaagagtgattggttgaaaagaaagagaaatagaataatgagaatcatatggatttacacaaacctctaatgattagaaactaaaaacgagatctcgaagtaattcgaacgatttcgattatcatttatttgtacttattagttacttctacccgatagagcttagaagttggaagtaataatttcttggttgattgtatccttaaccatttctttttttttgacacgaggaactcatcatgaatccactaattgctgctgcttccgttattgctgctggattgcccgtagggcttgcttctattgggcccggattt

SEQ ID NO: 18220 - DNA, 322 bp, Zea mays
  Clone ID: LIB189-008-Q1-E1-A4
atatggagttaatgatccagttgcactgaaacttttgagcaaggcaggtgagatgccatccctgacaccaccagatgatgagactataaggaccctctacattggcggactcgatagcagaataaccgagcaggatttgagggatcagttttatgcccatggtgagatcgagtccataaggatggtacttcaacgtgcaatcgcatttgtgacgtatactacaagagaaggcgcagagaaggctgcagaagagcttgctaataagctagtcatcaagggcgtgcgcctgaagctgatgtggggcaagcctcaaggcccaaag

SEQ ID NO: 18221 - DNA, 399 bp, Zea mays
  Clone ID: LIB189-008-Q1-E1-A5
acacgtccgcccacgcgtccgcagctctcgccttctctctctcatcggcacacccgagcttgcgccctccttccacttcgaggtccgagtcctgctttgatggcgaccgacgtggctgagactcccgcgccgttggtggatgcggccccagaggcgcccgcggacgccccggcggcgcctgctgccgacgcgaagccggccaaggccaagaaggccaccgcaccgaagaagcgcgccagcccgacccaccctccgtacgccgagatggtctcggaggcgatcacgtcactcaaggagaggacggggtccagcagctatgcgattgccaagttcgtggaggacaagcacaaggacaagctcccggccaacttccgcaagcttctgaacgttcagctcaag

SEQ ID NO: 18222 - DNA, 168 bp, Zea mays
  Clone ID: LIB189-008-Q1-E1-A8
agaaaaaaaaaaaaaaaaaaaaaaaaaaaaaaaaaaaaaaaaaaaaaaaaaaaaaaaagaaaaaaaggaatgaagaacaaataagttataatgttgtatagtcttgaaggtgttcgttataggccttctaggttgtttccattggttcgtttttttggtttgtctttt

SEQ ID NO: 18223 - DNA, 436 bp, Zea mays
  Clone ID: LIB189-008-Q1-E1-B1
gggtcccgggcacgcgtccacgtcagtgctagccatggatctaggcgctcccgctcgacggcgcttaccgatccgcctcttgctggtgtcgctcgccgtcctcatggtcctcaccgcgcgttccagtgccgaagtcatcaccctcaccgaagagaccttctccgacaagataaaggagaaggacacggtgtggtttgtgcagttctgcgtcccctggtgtaaacactgcaagaaccttggaacactatgggaggacctgggaaaggttatggaaggtgcggatgaaattgagattgggcaagttgactgtggtgtcagcaaaccagtatgctcaaaggtcgatatacactcctacccaacattcaaggtgttttatgaaggcgaagaagtagtaaaatataaaggacctaggaatgtggaatcgctgaagaacttc

SEQ ID NO: 18224 - DNA, 359 bp, Zea mays
  Clone ID: LIB189-008-Q1-E1-B11
gggccgacgcacgcgtccacacaacacgctagctctgcatcatccgttctggtgagcgagcgagcgagagacctagctagactgaccggtcgccggcagcgcaggccgagaacgaagcgtttgtgcattgaaggagcaagagccatggcggaacagcagcagccgcaggagatggacgttgaccgtaccggtggcctcgaactgcctccagggttccgcttccacccgagcgactttgagattgtcagccactacctcaagaataaggtgcacgacagggactacagctgcatcgccatcgcggacgccgacctaaacaagaccgagccatgggacctcccgaaagttgcaaagatggg

SEQ ID NO: 18225 - DNA, 439 bp, Zea mays
  unsure at all n locations
  Clone ID: LIB189-008-Q1-E1-B2
gggccgggccacgcgtccacttcaccaagctgatttctgcttgttagctactcacgtcaacagaaaatctcgcgttcagctcctctccagtctctccgcctcccgcttacttctctgactctgtcctctttcgtttctttcttgtcggcgacggctggcggctggggtgctgcgccgctctcaccttcaccgccgacgagcattcacaagtagtggtctcttactggtggcggcgtagaggtgacgaaaaagccttgacaatgagcagcataggcacaggttatgatctgtctgtcaccaccttctctcccgatggccgcgtcttccaggtcgagtatggcacgaaggctgtcgacaacagcgggaccgttgttgggatcaagtgcanagatggcattgttctgggtgtcgagaagctggtaacctcaaagatgatgct

SEQ ID NO: 18226 - DNA, 453 bp, Zea mays
  Clone ID: LIB189-008-Q1-E1-B3
cgggccgagccacgcgtccagcgaaatggctggtgaacaagctgaagggcaagatgcagaagccgctggcggacctgctcaaggagcacaacctccccgtgggcctgttcccgcgcgaggcgaccaactacgagttcgcgccagagacgcggcgcctgacggtgtacatcccgtccccctgcgaggtcggctaccgcgacggctccgagctgcggttcgacgccacggtgtcgggcacgctgggcgagggccgcctcacggaggtggaagggatcaagaccaaggtgctcgtctgggccagggtcaccgccgtcaaggccgacgccgccaaggtccacttcaccgctgggatcaagaggtcgcgcagccgggacgcctacgaggtcgtcaggggcggcatcaccgtcgacgagttctagcttagttttgctttcgccgctcacatggatggac

SEQ ID NO: 18227 - DNA, 141 bp, Zea mays
  Clone ID: LIB189-008-Q1-E1-B4
acggacgcgtgggaaaaaaaaaaaaaaaaaaaaaaaaaaaaaaaaaaaaaaaaaaaaaaaaaaaattaaaaatataacaaactaatataaacgttcattaaaaatgttaaaatctttaaaattgacttcaaaaaagggggt

SEQ ID NO: 18228 - DNA, 427 bp, Zea mays
  unsure at all n locations
  Clone ID: LIB189-007-Q1-E1-G4
accaccgtcacggaacttgggaaaactcaataaaaggataccaaaccttcctggtggggttccggtaatccaggtggaaccacaaccagaacctgaactaaaagagaagaatttaagatttgaggatgccctaaatgcaaccaaggctgctgttgaggaaggtattgttgttggtggaggatgcacccttttgcggcttgcagctaaagtcgatgccatcaaggatacactggagaacgatgagcagaaggttggagctgaaatagtaaggagggccctgagctacccacttaaattgattgctaaaaatgccggtgtcaatggcagcgtcgtcactgagaangtcctttctaacgataacttcaagtatggttacaatgctgctactggacagtacgaggacttgatggctgctggtatcattgat

SEQ ID NO: 18229 - DNA, 210 bp, Zea mays
  Clone ID: LIB189-007-Q1-E1-G8
ggtcgagggacgagtcagccgacgcgtcagccgtcgcctgaggcgatcgggtgacccctcgggatgattcagcggtaaaggattaggctgatactgtcgatgaagatgtatctagagcagatctcgtgataaatgtggtgagactgatgtctgccacaacaccaacactttcttacgggacatagtcgcgtttcatgagatgcagtggat

SEQ ID NO: 18230 - DNA, 277 bp, Zea mays
  Clone ID: LIB189-007-Q1-E1-H12
acccacgcgtccggaaggggaagaagaaggccaacaatagcgtggagacctacaaaatctacatcttcaaggtcctgaagcatgtgcaccccgacatcggcatctcctccaaggccatgtccatcatgaactccttcatcaacgacatattcgagaagctcgccggcgatgccgccaagctcgcgcggtacaacatgaatcccagcatcatctctcgcgagatccagacctccgtgcgcctcgtcctcccaggagagctcgccaaacatgccgtctc

SEQ ID NO: 18231 - DNA, 349 bp, Zea mays
  Clone ID: LIB189-007-Q1-E1-H2
ccgacccgtgggggaggcgtggccgccggcgagcttcgggcggtacaggacgcgggtggagctgccggagaacgtggacgtggagaggatcgccgcataagtgaaggacggagtgctgtagctcaccatccccaagctgtcggcgggggccaaggtcgtcaacatccaagtgcattgatgctgtgggtcagattcatcaggacgattagcacctgctgccgtgcttttcggagcttcaagaatctggatgcttgggacgagagcgatatcgatctagctaccagtcttcttttcactcttctttttctgtttcgttccgcgattttgtttgcaatgtcacacatggtaa

SEQ ID NO: 18232 - DNA, 346 bp, Zea mays
  unsure at all n locations
  Clone ID: LIB189-007-Q1-E1-H3
acccacgcgtccgggaagaaagaaagcaaccatggcggcaaccggaatgtcnccctccccctcggccgcaataactcgccacatccatgctcgtcgttcctgtgctgctgcttccttgtccctccgccgctcgggcttcctgnggcgcgtcgtgctggccgcggtgccagtggccgtggacgccacccggcgccgccgcgtctccgtgtcggtgcggatggcctgggacggtccgctctcgtcggtgcgcctcatcatgcagagcaggaacgcgaagctgagcgagaagctcaaggagcacatcgaggacaaggtgggtcgggcggtgtccangcactgccacctg

SEQ ID NO: 18233 - DNA, 416 bp, Zea mays
  Clone ID: LIB189-007-Q1-E1-H7
acggacgcgtgggcgggagaacatgtacgaggcgatgtcgccgcgccgggcgctcctcgccatcctcctcgccgtcgccctcgcctccgcttcctcggcaccccagcccccgccgtgcagccgctcgtgcgcggccctcaactgcgactccctcgggatccgctacggcaagtactgcggcgtgggctggaacggctgcgacggcgaggagccctgcgacgacctcgacgcctgctgccgcgaccacgaccgctgcgtcaagaggaaaggtatgatgagcgttgaatgccatgagaaattcaagaactggcatgaggaaagtgaaaaaggcaggcaaggttggcttctccaagaaatgcccgtacgagatggctatggctacaatgactcaggggatggatatggccatcatcctt

SEQ ID NO: 18234 - DNA, 425 bp, Zea mays
  Clone ID: LIB189-007-Q1-E1-G12
cggacgcgtgggtgcaatttgaggagagagacgagatcatgaggaagcaatactcccctgtgctctacttctgcctgatggcccttgtcgtagctgctatggtctgtgtcatgtacaccacctcggcacaagcaggaaggagtggctacaactcgtacgaacctgatggaaggggtggatacaactctgttcccatcaacggcggtggcagcccctagctaggcggtggatccgagcctgtatcagaaatcgaaataatataagactgtcttcaacggatcacactgccgctcccccacgctaaatttgggggctacagtgcacacgctagccgattaacggctcacgctaccaggcgctctacgcggatgtgccccctagccagcttctctctccccctcgttctgtggtgcctctctcaacct

SEQ ID NO: 18235 - DNA, 410 bp, Zea mays
  Clone ID: LIB189-007-Q1-E1-E7
cccacgcgtccggcagattgtacctcgagctctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagctctcgcttcgcgggcgttcctggcagcagcgctcgcttctcgggcattgctggcgccagattggacaacgacgaggagagtgaaaccacggagaggccactggtgcttcgtaataaaccgcctaggtggcacgaacagctgcagtgttggtgcctcaacttccgtggccgtgtgacaattgcctcggtgaagaacttccagctgaatgccgccgcta

SEQ ID NO: 18236 - DNA, 394 bp, Zea mays
  Clone ID: LIB189-007-Q1-E1-E9
cccacgcgtccggcgacatggagtacagaaagagggtggatgcgttagtgtttttctcgttacttctcctcggatactttgctgctcatgcacatgggaagggtcatgccatagatgatgtcggtgtttctactccagctaaagaaggaattatgcaaggaaacggagcatgatgcattgtagggtttcctccatgcaaagataacaagtgctactgctgcattggggggcgaactcatgttcgctactctacgctggctgagtgtagtcatgcctgcttctaaacaaaaattaagatcactgttattatatacattgtactggtaggtaatgctattaataatatatggtaattttagttttggtattaaaaaaaaccaaataaaacaactaa

SEQ ID NO: 18237 - DNA, 408 bp, Zea mays
  unsure at all n locations
  Clone ID: LIB189-007-Q1-E1-F10
cccacgcgtccgcccacgcgtccgcaggggctgtacatgggcaacggcggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggccccttcatcggcgctgcgctggctgccatctaccaccaggtgatcatcanggcgatcccgttc

SEQ ID NO: 18238 - DNA, 393 bp, Zea mays
  Clone ID: LIB189-007-Q1-E1-G1
gggccgagccacgcgtccacccacacgtccgcccacgcgtccggccacatcccaggccgccgagatgcagctcaaggtcggttgggccccctggttgaaggaacaggccaactacctaagacacaatcggatcctctgctcaaatctagattcccttacttcgagcaaccacccgctgctccaggatgcctcagccaccaacaactcgcccaccaagtactcgacagaatgcttcagccatgacatcgtcctgttgaggactatcagtgctgcacccacaagcgaagaccgcgcgctgcagcagaggcgccacgagtgcctcgtcacgcggcccgagttggcgaggattggcggacggaactacatcatgctcgagcatcaccccaacaggat

SEQ ID NO: 18239 - DNA, 423 bp, Zea mays
  Clone ID: LIB189-007-Q1-E1-G10
agggcggggatgacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaagagcaagttcccgtggacctactccgccaaggagacgtgctacctgctgcaggggaaggtgaaggtgtaccccgaaggccacggggaggagttcgtggagatcggcgcgggagaccttgtcgtcttccccaagggcatgagctgcacctgggacgtcgccgaggccgtcgaaaagcactacaac

SEQ ID NO: 18240 - DNA, 409 bp, Zea mays
  Clone ID: LIB189-007-Q1-E1-D10
cccacgcgtccgcccacgcgtccgcggacgcgtggggtttcaagtaacctggagcaaaagaattcccagaagttggaagattcagatcaacagtcccatggcaagggtatgaagaacttcaatttgaatgagacactgtcagattgtcaggaagatggtcttgtagaacaagatgggagatgtgcttccagttttcagcatgataaagatggggggtcagtacttgggatctcttggctcaaaaaaaacttatgtctgctgacccaacagctgtggagaagccagggaagatttttggacattcattgggaactgcaatagagctgaaaaatactaaagaccagaatgaaccagctgtgactattcggaatttgtcagattctgcttctacatctgttggctgtgcaat

SEQ ID NO: 18241 - DNA, 404 bp, Zea mays
  Clone ID: LIB189-007-Q1-E1-D11
agcccacgcgtccgcccacgcgtccgggacagggaagatataggagagagcatgacagcaacagaaggacttcagatgtgaggaagtgggatggtgatagtagcgagttcgaggcatcagatgaagaatgggactctggtgatgacaggggtaatgctctgggcttcgacaatgatagaggttctactgatgagcaccctcggcgatttggaagcatgagggaacaaaagagtagattcaatcgggcacaggattttgtccctaggggaggcgtgggtgaggggaagggtttcaatagaagctatggcaacccagatgctgatgttcacaatagaggccagggaagacataggagagataataaaagaacatcagatgcaaggatgtgggatgataatagtgag

SEQ ID NO: 18242 - DNA, 420 bp, Zea mays
  Clone ID: LIB189-007-Q1-E1-D12
ctcttttaggaccttgttttcttggatgctcctattttattttgcgtttctaacatctatgtggttcaaggttttcattgcatgttgacttatttttagctcccaatgatgttaatgttatgttgcatcttgacataagatcttttttaaaaaaaaaaatcgtgcatgtcgtctgtctgtttctgtattcctataaatgttcttagatcttaacatattgcacttcgtgggaatgatactgttctaatatatcatttttatgtatttttgcatacaagatatacagaaaaatgggtgaaggtacttttggtcaagtactggaatgctgggaccgagaaagcaaagagatggtggctattaaaattgttcgctctgtaaagaaatacagtgatgcagcaatgatagaaattgatgtcctgc

SEQ ID NO: 18243 - DNA, 422 bp, Zea mays
  unsure at all n locations
  Clone ID: LIB189-007-Q1-E1-D3
gggccgagccacgcgtccacgacatgtttcattgattcttgaagagatcaagctccttttgccacaacaaggtcaaggatttcttgcaactgcggttcaacctgcggctgcggctcaagctgcaagtgcggcaagaagtaccctgacctgaaggagacgagcaccgccgcgcaggccaccgtcgtcctcggcgtggccccggagaagaaggccgcgcccgagttcgtcgaggccgcggcggagtccggcgaggccgcncacggctgcagctgcggtggcaactgcaagtgcgacccctgcaactgctgatcacatcgatcgacgaccatggatatgattattatctatctagcttgtggtggtggttgaacaataataagcgaggccgagctggctgccatacatagggtatgtgtggtgtg

SEQ ID NO: 18244 - DNA, 230 bp, Zea mays
  Clone ID: LIB189-007-Q1-E1-D4
acgcgtccgagcgactagagccaaggcagcacgttcccggcaggagaagaacaacaccgcaggcgcccgggaaatcagttcaggggccgcaaggcgtggaagtgaaaaagcctctgctgccgctttgcgattcatctagccgaatggccaatttttttgactctttgtatcttcttctgccagttaatgtttccatataataccttgattctatgagaatgcttttccat

SEQ ID NO: 18245 - DNA, 183 bp, Zea mays
  Clone ID: LIB189-007-Q1-E1-D5
gacccacagcgtcagcccacgcgtccgcccacgcgtccgcccacgcgtccgcggacgcttgggcggacgcgtgggatggcgccctcgtagaccgctagttcggtccacgacttcagtgtcgacgatgctatcggcaatgacgtttacctcagcactgtataacgggaaggttcttctcattgt

SEQ ID NO: 18246 - DNA, 426 bp, Zea mays
  unsure at all n locations
  Clone ID: LIB189-007-Q1-E1-D9
aggcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccaaccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcangatgggcatcatcccccggg

SEQ ID NO: 18247 - DNA, 439 bp, Zea mays
  Clone ID: LIB189-007-Q1-E1-E1
ggtctagaataacgggccgagccacgcgtccacccacacgtccgcccacgcgtccgcccacgcgtccgcccacgcgtccgcccacgcgtccgccaagtttttgagcctttcagtattcttggactggaatctggggcatctgaatctgatatcaagaaatcatataggaggctttctattcagtaccatcctgataaaaatcctgatccagaggctcataagtactttgttgaatatatatccaaggcatatcaagcattaactgatcctatatctcgagagaattatgaaaaatatggtcaccctgatgggcggcaggggttgcaaatgggcattgctttgcccaagttcttactaaatattgatggtgcatctggtgggataatgcttcttggaatagtcggattttgtatattattgcctttgatgatagctgtta

SEQ ID NO: 18248 - DNA, 402 bp, Zea mays
  Clone ID: LIB189-007-Q1-E1-E10
ctcaggcatgaaagtcactattcgtcagctgggcccttccatgatacagcagatgcagcagccttgcaatgagtgcaaggggactggagagagcatcaatgagaaggaccgctgcccagggtgcaagggtgagaaggtcgttcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatc

SEQ ID NO: 18249 - DNA, 422 bp, Zea mays
  Clone ID: LIB189-007-Q1-E1-E11
gggacagctagcattccagtgactgtacctgaaggaactcatcctgatcaaacaagtgatcaagtgggaatcaatggaagcatgaacccatgcatccatccaatggtttctgctgacccaaaatttggtagtagtgccacaccacagactttccctcataattatgcggcctttgctccaatgatgcagtgcaactgtaaccaagatacgtacaggtcattcaccaacatgtcatccaccttctccagcatgcttgtttccacgttgttgtcaaaccctgccatccatgcagccgccaggctcgcagcatcatactggccagcagctgaaggtaacactcctattgatccgaatcaagaaaaccctgcagatggcgtccaaggaaggaacataggctctcctccaagcatggtttctattgt

SEQ ID NO: 18250 - DNA, 420 bp, Zea mays
  Clone ID: LIB189-007-Q1-E1-E12
gacccacgcgtcagcgttaaatcaaaaatcaaaaaacagaaaaagaaaagaaaacatcataaaaaaaaaaaatgaatccaatcggaatcattgaaagctttgttcctatgcatcgaaccaattggtttctgtcgatccagtctttggcattaatgccactccacagactttccctcatatttgtgcgggctttgctcgggggttgcagtgcgactgtaaccacaatacgtccaggtcattcaccaggtgcgtcttcatccttctcgagcattcttttttccacgttgttgttttcctctgccatctgtggaaccgcctggctctcatcatcttactggccatcaggtgaatgtcccactcctattgatccgtatcactatacctgtgcacatggtttccaccgaacgattataagctctc

SEQ ID NO: 18251 - DNA, 308 bp, Zea mays
  Clone ID: LIB189-007-Q1-E1-B4
gggccgagccacgcgtccacggaaacgtgggaccaggcgttccgcgacgccccggcaaacaagctcacgggcacccccaagtccgccaacttccgccccttttcgttcaacttcagggcccccaacttctctccaacaatcaaaccctccccaacaagggccatggccaacaacatggtcaaggtcacctcctggtactacaaccattggggctacccccagagggtcgtcgacctcgctgacatctgccccaaccggtgaaagtgaaccgttgcattgtaatagcactttgtaactcctcaccctcc

SEQ ID NO: 18252 - DNA, 440 bp, Zea mays
  Clone ID: LIB189-007-Q1-E1-B5
gacccacacgtcagccagagctttgcgtccaggtggagttgtatgcacccaggcagagagcatatggctacatatgcacatcattgaagatattttcgtcaattgccgccaagttttcaaaggctcagttaactatgcttggacaacagtacctacataccctagcggagttattgggttcatgctttgctccaccgaagggcctgctgttgatttccagcaccctgttttcaacatcgaggaggatgaacattctacgaaatcaaaaggaccccttaagttctacaactcggagatccacacggcatcattctgtttgccctcttttgcaaagagggtaattgagtcaaaggcaagctagacgtgaggatacttcaccaagtccagtcgattgggttaagtaccttaggcgcaacacaaaatttgttgtcctgttaaaa

SEQ ID NO: 18253 - DNA, 385 bp, Zea mays
  Clone ID: LIB189-007-Q1-E1-B6
cccacgcgtccggacggacaggccgttgccgcccaggagcccgcaaagaaggctgtgaaggttgagacccccagcagcgacaagaagaaggtacagttcaccaagaacctcgagatgggccccactggctcgcccagggttgacgaaaagaaggaagccgcaaagcccgccgccaagggaccccgcaacgtcagcggcgtcaccgtcgacgacaagagggagggtaagggcaaggccgccaagaagggcgaccgtgtcgagatgcgctacattggcaagctgatgaacggcaaggtgttcgactgtaaggcatgaatcccaactaacttgagctgtactgacgtgctaccagccaacaagaagggtaagcctttcgccttcaagc

SEQ ID NO: 18254 - DNA, 415 bp, Zea mays
  Clone ID: LIB189-007-Q1-E1-B9
agcccacgcgtccgagaggtgtagatatttttaagaaagcgtacataattttgccgattaatgaatcgatgcactggagcttgatcattgtttgcatgcctacaaaagaggcagattctgggccaataatacttcacttggactctcttggtcttcactccagtcaaaagctttttgacatagttgcgagggaggatatggaggcgtctttcgaaaaatatcaatagggaaaagattgaggtgccacgtcagcgtaacgagtatgattgtggcctctttatgctttactatattgacaggtttattcaagatgcgccagagaggttgacaaaagagggccttggcatgtttggacgcagatggttcaaccatgaagaggcttcagcgtttcggggagggataccggcgctactga

SEQ ID NO: 18255 - DNA, 393 bp, Zea mays
  Clone ID: LIB189-007-Q1-E1-B3
gcgtcaaagagaaattgccagaacagtccagggaacccaaggggtggaaaagccaatcaagggccccaaccccaagtggggggcgtgggcgcaagcggggcaacacaaaaacccggggccaaagccggattcaagattcccaaccgggatctcccagggggtggacgccgtgaacgtgacgagaggagatctacgagtcttagctacagcaggagcgcaagtcccaggcgttccgtctcacctgcaaaggaaaaggagcgcagtcgcacacccaatggcagtaggagcccaaggagccccagcccaagggctttggtgagcccaccactgaaggataatggtgcacgcaatggctcagaccatgaaggcagccccggtggtggagagaacagc

SEQ ID NO: 18256 - DNA, 388 bp, Zea mays
  Clone ID: LIB189-007-Q1-E1-A1
ggcctcttcatatggacgcacacgtacagcctgatgcagaagtccggcaagctgtaccacaagatgcagtccaaaagcattcagtgcccagccgacagcgacgaggagcatgagcaagcgaaagaagatgggccagctggctgcgctgacgaggaggcacctcttccgacgtcagtcaagcctcgcgagcacgagcacggggaagaagaagaacaccaaatggaggcccctctcttgtcctgcgagagcgaggttgctgacaaggggttctggacgaagctgaaagacgctatccaccagttcatcaaggagctgatggcaccgcccaccatatccgcgataattgggttcgttgttggcctggtcccatggctgaaatccctaatcg

SEQ ID NO: 18257 - DNA, 412 bp, Zea mays
  Clone ID: LIB189-007-Q1-E1-A11
agcaaggcagtatccttggtatatcgtgacattttcaacaatttcactactagggaaatgggccttgctatggtactctgagtctctgacaaccccttaggaaatcaccttacacctacttgtgttgaaaaaaatgctaactatatataattgatctaacatgcaactatcatataccttttcatgacatgtcacacctgtgacatagtaattcatgttcgcgtactcgcctatacacatttctcttttgtttatgtcacatttaagaactaaaaactttactcatgtcacattcaaacaaaaacattgcaaggaagaattatgcaagtgtcatgttgcaaaaaaaggttataaggaagtgacatattctgacaagaagtaataagaaatcacgttagaatactatatcact

SEQ ID NO: 18258 - DNA, 426 bp, Zea mays
  Clone ID: LIB189-007-Q1-E1-A3
tcccgggccgactcacgcgtcagcgagaattgggacatgggctcggcctcagcgagggagggccgctgttcgggttcaccaagtcgaacgagctgttcgtggggcggatggcgcagctgggcgtggccttctccatcatcggcgagatcatcacggggaagggcgcgctggcgcagctcaacatcgagacgggggtgcccatcaacgagatagagccgctcgtcatcttcaacgtcctcttcttcttcatcgccgccatcaaccccggcaatggcaggttcatcatcggcgaggaagaggaataggctgctggcctcggacatgagtcgtgtgcgtttacttttacctgtgactgtgagtgatcgatcggtgcgtctcggtgcgcgcgcgtaagtgctttgctgtgtgtatcaattactcgtgatg

SEQ ID NO: 18259 - DNA, 392 bp, Zea mays
  Clone ID: LIB189-007-Q1-E1-A5
agaattggaagacctgtttcagattcagtcgctggatctgattctccaagatgaatctgtacatatgcttgccttaaaatggtctcaacatttctgtgaagagtacaatccccgtaaatatagaggcactctcttttctacccctgcagttccatttaggctgatgcaactaccagatgtgtaccaggttctcctagaaagatatatcaagatgcaatgccctgattgtggctcagtgcctgatgaaccggcactatgtttgctatgtggcaaactatgttcgcctagttggaaaccatgctgcaggactgggaaatgccagaatcatgcattgcaatgtggtgctggtattggcatatttcttctagtgaggaaaacaacaatcctgttgc

SEQ ID NO: 18260 - DNA, 407 bp, Zea mays
  Clone ID: LIB189-007-Q1-E1-A9
cccacgcgtccggcttcagcgtttttcgcgttattatttacataatgtgacgatcaactggtgcccagccaaaagagcgattgaagacttgatcatcaattcttcggattagcctgcttctcgtcctccagcatccttcttggcatctctttctggagcagcgcccacgagttcaacgaaaaacaacattgaatgaagatattagcgacattgatgacattctttccattaaaacaattatcatttctgattttccagattgtccataaaactgcactacagccagatgtcaaacatctctttagcatttcttggaaaggatggagagttcttcggattaactgattttttttgaggccacacaatcagtttaattcttcggattaactgattttccagattaactg

SEQ ID NO: 18261 - DNA, 402 bp, Zea mays
  Clone ID: LIB189-007-Q1-E1-B10
cggacgcgtggggctactcggtcgcggtggtggtggtgatctgcctgttcgttctggcgttcgggtggtcgtggggcccgctgggatggacggtgccgagcgagatcgtcccgctggagacgcggtcggcggggcagagcatcacggtggccgtgaacctgctcttcaccttcgccatcgcgcaggcgttcctgtcgctgctgtgcgccttcaagttcggcatcttcctctttttcgcggggtggatcaccgtcatgaccgtgtttgtctacgtcttcctgccggagaccaagggcgtgcccatcgaagagatggtgctgctctggcggaagcactggttctggaagaaggtcatgccggacatgccgctcgaggatggctggggcgcggctgagggtcatg

SEQ ID NO: 18262 - DNA, 420 bp, Zea mays
  Clone ID: LIB189-007-Q1-E1-B12
tcgaggcgtaccgggacctcggctccaggggcaaccggcagaagacgcgcatgatgtggctcatcgacgagctcgggatggaggtgttccggtcggaggtggagaagaggatgccgaacggggtgctggagcgcgccgcgccggaggacctcgtcgacaagcgctgggagcggcgggactacctcggcgtgcacccgcagaagcaggaaggcctgtcgtacgtgggcctccacgtgccggtgggccggctgcaggccgcggacatgttcgagctggcgctgctcgccgacgagtacggcaccggcgagctccggctcacggtggagcagaacatcgtgctccccaacgtcagcaacgagaggctcgacgcgctgctggcggagccgctgctgcaggagcagcggctctcgccgctgccgt

SEQ ID NO: 18263 - DNA, 438 bp, Zea mays
  Clone ID: LIB189-006-Q1-E1-H8
acccacgcgtcagagtgaagtttattgataaatgtagcatgccatatacattgcatgactcatttgcatatgaagttttgtcgtgacctatggtccgaccgtaccggtacaacttagcatcgtacgttgcccgagaaggggtacgatgcggcttcatacccttagaggtatgaaggcagaggacatatgcattgcattcatatgcattcattgaagtgatatttgcagatgatgtggttttatactcccagaggtatgaagatagagtacctacatattgcattcctatgcatacattgaagtgatatttgcaggtattgttgacgcagggaagtgttatagaacctattgtggttgttcgaggaaatgagatggtattggttatagtgggactactgagttctatatctacaagcatttctaatttttaattgtgac

SEQ ID NO: 18264 - DNA, 427 bp, Zea mays
  Clone ID: LIB189-006-Q1-E1-G3
ctctcgctgcctttatttcctgttggcgacgctctcgccaggtcttcggcggcccgttcggcggcgactagcgcctccgtttgccaggtcttcgtcgtccgtttcgccgtcgactggtgcccagcaggtacatctggaagaatgggggtttaccttagcacaccgaaaactgacaaggtatccgaagatggggaaaacgataaacttaaattcggactttcatctatgcaagggtggcgtgcaactatggaagacgctcactcggctttgctagatcttgacaatgacactgcattctttggtgtttttgatggacatggaggaaaagtagttgccaaattccgtgcaaaatatctacacagagaagttctccataccgaagcctatgctgccggtgacctgggtgctgctgtccaaagagcttact

SEQ ID NO: 18265 - DNA, 405 bp, Zea mays
  Clone ID: LIB189-006-Q1-E1-G5
agggacaaacttcggggacgtgggacaaccgactgtcttggacatgtcgcactggtggctcagctaatgcggcggcttggtgaggtcaagccacccctgaaacattctgtcattgctgtgttcattgccaatgaggagaactcatctgtcactggcattggtgttgatggcctcgtgaaggatggattacttgacaagctcaaaacaggacccttgttttggatagatacagctgataagcagccatgcattggcactggtggaatgattccatggcatctcaaggcaacagggaagctgttccacagtggccttgcacataaggccataaatgcaatggagatgaacatggaagcactaaaggtaatccacaaacggttttacactgacttccctccacatgag

SEQ ID NO: 18266 - DNA, 427 bp, Zea mays
  Clone ID: LIB189-006-Q1-E1-G7
acccacgcgtccggcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacac

SEQ ID NO: 18267 - DNA, 391 bp, Zea mays
  Clone ID: LIB189-006-Q1-E1-G9
aacatgaatgttcatcagctccagtgcttctgtgtagtagattaggagtttagagaagaggaggaggacgacgacgaggacgacagcacgcggcgacctaatgcgaagcggcaggttgtggttgcgtgcgtggacgcgtcctcgatcgtcgtccatccgtgaccaaacaagaagaaaaagtatcgcgcgcgtgtgtggcttttgcctagcgtagccagccaaataaggttccactgcgcgtaataaatcctagtgttgtacagcagacgtagccgccactcctgctctgtgggtttcgcgcctcgaggtttttgtgctttgcagtgtatctagcgtccatactaatacgtgcttccagcttccatccagttaaaagtctaccagcttgtgg

SEQ ID NO: 18268 - DNA, 419 bp, Zea mays
  Clone ID: LIB189-006-Q1-E1-H10
gggccgacccacgcgtcagcaaaacatcagggcacaacaactacaacaactcgtgctagcaaaccttgctgcctactctcagcaacagcagtttctgccattcaaccaactagctgcattgaactctgctgcttatttgcaacaacaacaactactaccattcagccagctagctgctgcctaccaccagcaatttcttccattcaaccaactggcagcattgaactctcctgcttatgtacaacaacaactactaccattcagccagctagctgctgtgagccctgctgccttcttgacacagcaacagttgttgccgttctacctgcacgctgcgcctaacgttggcaccctcttacaactgcaacaattgctgccattcaaccaacatgctttgacaaacccaacaacgttctacc

SEQ ID NO: 18269 - DNA, 410 bp, Zea mays
  Clone ID: LIB189-006-Q1-E1-H12
cgcacgcacgaacgcgctcccaccccctcccgccgccaccgccgccaaaaccccggcccgacttggcgtcctccgccaacctcctcctgggcagcgcgggcggggggatatggcatcggaggacgtggtgggcaagagcaggggcgacacggccgtcaccaccatcgtcaacctggcggaggaggccaagctcgcgcgcgagggcgtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttt

SEQ ID NO: 18270 - DNA, 426 bp, Zea mays
  Clone ID: LIB189-006-Q1-E1-H2
gtcagcggacgcgtgggcggacgcgtgggcgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaaggtcactgtccaccacttccatggaaacaatgtcgaccttggaactgcctgtggtaaatactttcgggtctgctgcctcagcattattgattctggtgattctgatatcatcaagactaca

SEQ ID NO: 18271 - DNA, 424 bp, Zea mays
  unsure at all n locations
  Clone ID: LIB189-006-Q1-E1-H3
cgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagacgaggaaaaagcactgaaggagctcaaggccaaggcacaaaagggcgcgattggaggctcgggtctgaagaaaagtggaaagaaatgagactggtcacccgtctccattacctagaggatgataaggcagctgtctatctgtgttgcgcttcactacgtgtgattgtaacagtggtacctcttgtgttctgtgttccgcgatgttgcagttggttgcttgatcganagatgtttcagcctcccatctgctagctatgatac

SEQ ID NO: 18272 - DNA, 428 bp, Zea mays
  Clone ID: LIB189-006-Q1-E1-H4
gtccaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttt

SEQ ID NO: 18273 - DNA, 424 bp, Zea mays
  Clone ID: LIB189-006-Q1-E1-H7
cactagccgagccgagccgcgccgcgccaccacgaccacgagtcgaccggcgagtggttggcgcaagttgtcaggggcgttgccggagccgtgcggcggccggcggccgggagcggggccgatggggcgctacgagctcgtccgcagcgacgacgcgcctgccgtcgccgcggatctggaggccggcaccgccgcgccgtgcgacggctaccccaagcgccgcgtgcccacgccctctccgtctccggcgccggcgccgacccggcagcgcctcgtctcgctcgacgtgttccgcgggatcaccgtcctgctgatgatcatcgtggatgacgccggggcattcgttccggcgatgaaccactccccctgggatggcgtaacggtggccgactttgtcatgcctttcttcctcttcatcgtcgga

SEQ ID NO: 18274 - DNA, 324 bp, Zea mays
  Clone ID: LIB189-006-Q1-E1-G12
gctgcaacgatgcaggtcactttcaccatccgccgctgcggcatcttcatgaaggtttaagagctctccgtgctgtgctataccgacgtcgcgctcatcctcgtctcctccacggggaatcgctcgtaattatccaactgcaatatggatgagataattgacaactacttcacacattgctattttcgtgcgggacaacagagcagacttcgctggactttaacttatagcatagcatatatgtaaatttgaatgaccagcttgcggtaccaagccttcgactcatgcagattaaaggtgtagaacttgatggatttaatgttg

SEQ ID NO: 18275 - DNA, 388 bp, Zea mays
  Clone ID: LIB189-006-Q1-E1-E9
gcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatg

SEQ ID NO: 18276 - DNA, 380 bp, Zea mays
  Clone ID: LIB189-006-Q1-E1-F10
gaccaacgcgtccgccatcggttcaaagctcggcgtccctgctcctgtccctcccatggacgccgcccctccctcagctcactccctctagccgccatggagctcgcccctgtccaaattcggttgcctctgtttccccctctctctgttggtggctggcatcccatctcccctgcgttggacggctgccgcttcgttctcgtcgctggcgttcgtccctgctccagctagttctcatggccatgcctctgttccctaggtccgagctcgcccaactccctagccatctctgctcgcccctctctgtctctgtgcgagcagcagcacgacggggcagacctatgtcctcgacgcgcaccagatgtttgatgggaggtttg

SEQ ID NO: 18277 - DNA, 440 bp, Zea mays
  Clone ID: LIB189-006-Q1-E1-F4
attcaagggccgaccgacccgtccacggacgcagtgggcgcggcctcgccttatcccctccgtcactcacctcgaccaccgccatggccatggccttggcctccgcgaccgccgccgcactcttccgctccgccctgtccgcgccacacggcgccggcgcgcgcgtccggccgcagcgccggcagccgttcttggctccgctccacgcggcgaagggccccggctcggcgccggtggtgctggagggcaaggccaagggaaagaagaagaaggggcccagctccgggaaccttcccgcagccctcgacgtcgagatcagggaggcgcaggagtacctcgacagcgaccagcaggaacctgttccagaaaactttccatttgaattaatcgacgaagagggtatgagcgtggttattttgagaagggactacaaggacgag

SEQ ID NO: 18278 - DNA, 392 bp, Zea mays
  Clone ID: LIB189-006-Q1-E1-F5
gaagagatatcacagggacctcttcaggcttcaaggcagatccgcagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgcttcccctactacttctgaagcttcccgttgcagtcctgcgtgatcgagttcttgagcggcgacatctggtgcatgctccttacgactgat

SEQ ID NO: 18279 - DNA, 408 bp, Zea mays
  Clone ID: LIB189-006-Q1-E1-F7
aacccacgcgtccggacactttctagttcatcacccatggcaaagttcttcaactacaccatcatccaaggactcttgatgctttccatggtacttctggcatcgtgtgctattcatgcacacataataagtggggaaactgaagaggttagcatcacagggagcccgacagtgatggtcatgatgggggcaaaccgaaagataattgaagataataaaaatttattgtgctatctaagggctctagagtactgctgtgcgaggaccagacaatgctacgatgacataaagaagtgcttggagcattgccgtggttgaaaggtgtaataaaggatatgctttccttggatcttagttggtgatcagaaaaatgttctaccaattcatgcatgtaccataggataatat

SEQ ID NO: 18280 - DNA, 311 bp, Zea mays
  Clone ID: LIB189-006-Q1-E1-G1
gatcatgattgactgggacccgaagggcaaggttggcccgatcacccctcttccggacctggtgaccatccataccccgaaggaggaggacgagctgcgccctcctgtcttggcagctgaggtctaaggtcccaacagcgtcctcgaaatggcagtttgatctggtcctagctaggtttgtatcttatgataagggcagtgctaagacagttcgttccgtgtcacttctgtttaaaattaagttttgccgagacaagctatatgtaccggatgaaagtgtggttccttattgtatgctctggaattttatt

SEQ ID NO: 18281 - DNA, 402 bp, Zea mays
  Clone ID: LIB189-006-Q1-E1-G11
acccacgcgtccgcccacgcgtccgagcttttaactttctcaggacacgggagcccttcttgccacaaaagttttagttccaactgggagagctagcatggcaagttcgcgctgctttgagaacccgccggtgctggagccggccagcggaggaggcgaggtggttgacgacttcggcgggcagaaggcctacgtcagcggctccgccgggtccaaggccgccgtcgtcctcatctccgacgccttcgggttcgaagcgccaaacctgaggaagatagccgacaaagttgcttcgctcggttacttcgttgtggtgcccgatttcctgcatggggatccatatgaccccagcaataatgcccatagcaatcctggaacgtggatacagtcgcacaatccgca

SEQ ID NO: 18282 - DNA, 371 bp, Zea mays
  Clone ID: LIB189-006-Q1-E1-E7
aacggacgcgtgggcggacgcgtgggatcgagtccgcccaagaccttgtagattccttaaccaacgccggcgagaggctcgtcgtcgtcgacttcttctcccctggctgcggcggctgccgtgctcttcacccgaagatttgccaatttgcggagcggaaccctgatgtgctgttcttgcaagtgaactacgaggagcacaagtctatgtgctacagccttcgtgtccatgtgctacccttcttcaggttctacagaggagcacagggacgactctgcagcttcagctgtacaaacgcaactattaagaagttcaaggatgcacttgcgaagcacaagccagatagatgtagccttgggccaacccggggg

SEQ ID NO: 18283 - DNA, 386 bp, Zea mays
  Clone ID: LIB189-006-Q1-E1-D12
cccacgcgtccggctagacccaccgccactgccaaacggaggatctccatctgggcctcggaacatcagtgaacctgtggcagcatttggcccccctggatccaatggggagctcaacgtcagtgtcatcgtctccactgtgccacgagacttctcgatcgagacgttcggcagcccaaaagacgtgggggaagtggtgctcagaaggatcgcgaggacgaggcgaagcccggacatcaacgctacccttatcgacgccgccgtgagagaggacgcgggcagggtgaagtactacaagctggagttccgagtcgagagcccttctttccggcggcacaacgtcgcggtctgctgcgtgagggacggcaggctctacaccatgaacg

SEQ ID NO: 18284 - DNA, 456 bp, Zea mays
  unsure at all n locations
  Clone ID: LIB189-006-Q1-E1-D2
attcaagggccgaccgacccgtccaaacccaaactcgcattctgaatgcactgctgaacaagcatatacatggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcatcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctcnccccagcgacctggtgaaatatgcagagaactgcatgtacactcccgtctaccgcaacta

SEQ ID NO: 18285 - DNA, 438 bp, Zea mays
  unsure at all n locations
  Clone ID: LIB189-006-Q1-E1-D4
gaccgacccgtccacggacgagtgggcggacgcgtgggcggacgcgtgggcttcccgtgtggctgggagtcggcgccgccttcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaagggctggtgctgcgcaacncctacnatcacaccctgaacgtgttccaggcctacacgctgaagcggataagggaccccaact

SEQ ID NO: 18286 - DNA, 392 bp, Zea mays
  unsure at all n locations
  Clone ID: LIB189-006-Q1-E1-D5
acccacgcgtccggcgaggacgtggccgtcagctgctcggcgctgcggctcgggtaccgggatgtgctccgcgcggccgaccgcgcctacgagccggggcgctacgccgcctgcagggtgaggttcgtgtgcctgagggcgccggcggaggtgctcgcggagagggtgctgcggaggtcggtggaaggggagcacttcatgccggcgagcctgctgcggagccagctcgacctgctgcgggtcgaccccgcggagggggtcgccgaggccgacgcgacggcgcgccccgacgacatcgtccgcgacaccgtcgccctgttcagggacgagctagcggtgtcgtccggcgtcnctgcttgacttgtttctggatgccaacgcggtgcagtttc

SEQ ID NO: 18287 - DNA, 425 bp, Zea mays
  unsure at all n locations
  Clone ID: LIB189-006-Q1-E1-D7
acggacgcgtgggcggacgcgtgggcggacgcgtgggcggacgcgtgggcggacgcgtgggcggacgcgtgggcggacgcgtgggcggacgcgtgggttttgaatcaaagttagctcgtccacatgcccggataagaacgggggagccagtgcgactggaggatgtcaaggattgggctactgatgtaatcgcagattcttttaccagagcagaagaagctaccaagaaaaaatgatttagaagaatctaaaacacccggtgtatctgctttatcgtttctctgaatctaaaacacccagttgtaaccgagttcttttacagatccatgaccatatgggtattacggccactatggtattctgagagtgaagccctgagtcccttggtctatgtttcggtgcnacatggtaaacaactgcttcac

SEQ ID NO: 18288 - DNA, 392 bp, Zea mays
  Clone ID: LIB189-006-Q1-E1-D9
acccacgcgtccggtggcggcgcactgccggacgtgcccgggcggcgcgtacctgtgcggggggtgcgacgcggggcacgcgcgggcggggcacgagcgggtgtgggtctgcgaggtgtgcgagtgcgcgccggccgccgtgacgtgccgcgccgacgccgccgcgctctgcgccgcgtgcgacgccgacatccacgacgccaacccgctggcgcgccgccacgagcgcgtccccgtgcagcccatcggcgccgccgctgatcccgccgcggagaaggcggcgctgctgttcggccttgccgcggaagggaaggacggcggcgacgcggccaaggtcgtcgtcgacgccagtaagctggacctcctgttcccggacgacgtggtcgaaccgt

SEQ ID NO: 18289 - DNA, 399 bp, Zea mays
  Clone ID: LIB189-006-Q1-E1-E10
acgggccgatccacgcgtcaacccacgcgtccgtgatacttatattcttgatttgttacaattatatgacatgcttccagattcaggttgcctactttttggaatcattgctgcttaaaggtactctgaataaggcatgctcattttaagttagcctagcgtgtcactatggagtttcttcatgatgtcaccaatgccatgatgttgtcatcagtaacaacatgtgtcaaatgtcttacaaacttgttcagactgaagttcaagttcaccaaccatgagaccattatggtgaaggtgttgccactaacttgcagtaggtactatacgagtttttaaaggtagacctacagatgattgttttcagcattgacacattttgtatagttaaaacatgcattc

SEQ ID NO: 18290 - DNA, 349 bp, Zea mays
  Clone ID: LIB189-006-Q1-E1-E12
ctcggcaggcattttgtccacgtacctatctacctacaactatatcaagagaggaggacgcctcacattcagtcgccttgggcaacttctactgtcctgaacacgaggttccggatttaccatccatcatcagtcaaacatattgtcgcattcaatgcaacctgggttagttgtctgtgtttgtactgataagcgctgatatcatgggaaaacatctggtatagatgattccttcactcgtctctaagactctatatgtgagccgtatgatccatcctagcgtagcacctgtacgtctgattgcgttcaattcaactgctatagggtgatttcgacagaatttcgtact

SEQ ID NO: 18291 - DNA, 173 bp, Zea mays
  Clone ID: LIB189-006-Q1-E1-E3
ttactatcagaaggtggatgagagctcagatgaggtgaggtcagtcgcgaaggcatgcttcatccgtcatcgatgcggcctcaagtagcaggtcttcattggagaagtacaaggatgtcgagatgtgtttcacacggggattcaatgaacatcatgacgatcatggtcacgat

SEQ ID NO: 18292 - DNA, 317 bp, Zea mays
  Clone ID: LIB189-006-Q1-E1-E4
cgtccacggacgcatgggtgcagcaaatatccttctaaatcccttactggagctggtcgaggacatagttggttatgcaaaacctggtggaataattgctgtttctggaatattggaggagcaggtgccaaaaatcaaagaagtttactcgaggtatttggacagaatattggtatccgaaatggatgggtgggcctgtcttcagggaaccaggagagtgtagaggaattaagtatttcaccacgttgaagaagggttttgaccttacatgttttgacgattaagagaggattaggtatatacccgtgcgttgcaac

SEQ ID NO: 18293 - DNA, 323 bp, Zea mays
  Clone ID: LIB189-006-Q1-E1-E5
gcttcatatgccacctttagctgaagatcacaagtccgtggaatttgggacgcccggtaccatcaggtggcagcaagtgcacgatacgaatgtctttgggagtaccagctgagcagtggtcagtcacgaacacattggtgatctttcgtcgttgaccccccatgtacatggtttttttggagtgggatagggatggcggttgtgtttcccatggccattctttgcacgttatgaagctcatctgcaggatgctcgtaaatatatagaaatgttagtcacaacagatcacgtgtccatactgtatagcgaaacttaagatgttg

SEQ ID NO: 18294 - DNA, 427 bp, Zea mays
  Clone ID: LIB189-006-Q1-E1-B6
aacccacgcgtccgcccacgcgtccgggagaggctccgctcccgtctcgccgcgcctcgctagtctcggggcagcggcgctggcgctgctagtggcggcggcgctgccttccccagcagctggggtcaacgcgacggcggtgctctcggcgttccccaacttcgccgacttcgcgcggctgctggcatccactcccgtggccagcgagctggccgggaggtcgtccctgacgctcctggccgtgccgaacgccaacctgccgcagtcaccttcggctttcgtagccggcgccgccgccggcgccgacatcgccgacgtgctgaggtaccacgtcctgctggagtacctctccccgtccgacctcgcccgccttcccccctcccgggaagctcgtgacgacgctgttccagaccacgggccgtgcgcc

SEQ ID NO: 18295 - DNA, 409 bp, Zea mays
  Clone ID: LIB189-006-Q1-E1-B7
agcggacgcgtgggcggacgcgtgggcgagatgcgggagaggggcgtgacccccgacgcgttctcgtactccaccctcctcgccgcgctcacccgtgcgggccacctcgaccacgcgctcaccttcctgccgctcatggaggatgacgccgtggctccggacctgatcctcttctccaacctcattcacctcgccctccgcggtggcgacgcgcccaaggcgctggcgctgttctcccggctgcgtgccgcggggatcaggcccgacctcaaggcatacaacgcggccgtcgccgcctactgcaagtccgaccttctccgcgacgccaagcggatgctgctccacgacatgccggccgacggcgtcgcgcccgacgcggagacatactcccccatcctcgcggcgctgg

SEQ ID NO: 18296 - DNA, 355 bp, Zea mays
  Clone ID: LIB189-006-Q1-E1-B8
cgtacttctttattcactatatatttgcaagccaaactgcacatgttggagctttatactcagcatttcttgcgatgcatttagcagctggtgtgccagctctaatgtcggcacttgctttggcatacaatgcaaacctctttggagcactaacacactatagtagcgggcaatctgcagtatactttggagcggggtatgttgaccttccggatgtattcaagctgggttttataacagccgcaatcaatgctgtaatttggggagttgctggtgcattatggtggaaatttttgggtccttattgagtgtcggggcagtgtaagtacgtgaaaatcgtaccatattaacaaac

SEQ ID NO: 18297 - DNA, 246 bp, Zea mays
  Clone ID: LIB189-006-Q1-E1-B9
agaaaaaaaaaaaaaaaaaaaaaaaaaaaaaaaaaaaaaaaaaaaaaaaaaaaaaaaaaaaaaaaaaaaaaaaaatgggaggcccatcaaagggaatacaaccttccttaagcgtgaaagcaacgatctttaattcttcgtcagtggcacttaattttcagttgactggccgtggttttaccctgtccttgccggggtaaaccctgttgttacccaccttacttgccttgcatcagatcccccttt

SEQ ID NO: 18298 - DNA, 102 bp, Zea mays
  Clone ID: LIB189-006-Q1-E1-C2
gaccgacccgtccacccacgcatccgcccacgcgtccgcccacgcgtccgcccacgcgtccgaaacaaagccatataaatcaaataccaataaaaatacaaa

SEQ ID NO: 18299 - DNA, 361 bp, Zea mays
  Clone ID: LIB189-006-Q1-E1-C4
accgacccgtccacccacgcgtccgggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgattata

SEQ ID NO: 18300 - DNA, 424 bp, Zea mays
  Clone ID: LIB189-006-Q1-E1-C6
agcggacgcgtgggctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgatatggagatctgcgattttgacttcgaaccctgtggctactccatgaatgcgatccatggctctgcattctccacaatccatgtgacgcccgaggacggtttcagctacgccagttacgaagttatgggcttggatgccactgctctgtcttatggtgaccttgtcaagagggtcct

SEQ ID NO: 18301 - DNA, 373 bp, Zea mays
  Clone ID: LIB189-006-Q1-E1-B3
gacccgacccgtccgaaaaaaaaaaaaaaaaaaaaaaaaaaaaaaaaaaaaaaaaaaaaaaaaaaaaaaaaaaaaaaaataaaaaaaataaataaaaaaaaaaaaaaaaataaaaaaaataaaaaagaaaaaaatttaattaaattaaaaaaaaaataattttaaaaatttaaaaaatggaaaaaaaaaaaaattaaaaaaaaagggggggccctccaaagggtttccctttttttttccggttttatgaattttaaggcccttttaaattgccccccaaattaatttcctgggcgctttttttaaaaggttttctcggggaaaccccttgtttttccccatttttatcctttttaaaaaaacccttttttcc

SEQ ID NO: 18302 - DNA, 438 bp, Zea mays
  Clone ID: LIB189-005-Q1-E1-H8
cacgcgtccgcggacgcgtgggcggacgcgtgggcggacgcgtggggcaacgggtgccgcgtgcttcgcaaggggtgcagcgacgcgtgcgtgctgcggccgtgcctgcagtggatcgacggcgccgaggcgcagggccacgccaccgtcttcgtcgccaagttcttcggccgcgccggcctcatgtccttcctcaccgccgtccccgagccgcagcgcccagcggtgttccagtcgttgatgtacgaggcggccgggcggacgatcaaccctgtgagcggcgccgtggggctgctcggcgcgggcagctggcagctgtgccaggcggcggtggagacggtgcttcggggcggcgccatcgggccgccgcccgagttcgacgggggccgcgacaacacgtttgctctggcggccacggcgaagcgggccgtggggtgc

SEQ ID NO: 18303 - DNA, 399 bp, Zea mays
  Clone ID: LIB189-006-Q1-E1-A1
acccacgcgtccggggcccgtaacatatgcccatctgtctcatcttatgaaaggagatttgccacaaggaactacatgacccagagccttttgggcccttcgatgtctgttagcggtggcatcaatgtcccagtgatgcggaccccgctctgtgctaatgctcctgctgagaaaggaggcaagaacttcatgatcgatttcatgatgggcggtgtttcagctgctgtttcgaagactgctgctgctcccatcgagcgtgtgaagctgcttattcagaaccaagatgagatgattaagtctggtaggctatcagagccgtacaagggtattgttgactgcttcaaacgtaccattaaggatgagggtttctcttccttgtggaggggtaacactgctaat

SEQ ID NO: 18304 - DNA, 413 bp, Zea mays
  Clone ID: LIB189-006-Q1-E1-A10
acccacgcgtccgcggacgcgtgggtaagaaatcttttgctcaaatgtagctaattagcacttcatacattctggatagaatcgattataccatttcgtcatctgacttgtttgaagaactttggtcttcctttacagacatagaaggtgctctcaaagacatcgaaggtcttcctttaccgtttcgtcatctgcaatgtgcttatagtatgagagttgcctgctaattcctctaaatatagcattagttcagcttgtagcttcatattacatcaggtaatggatggcatcagaactattctctgtaatgatggtataagagctcacttgctaattcttctgaacattccctgggttcagcttgtaactttagttagattaatggatatcatctaaactattcttttcttttt

SEQ ID NO: 18305 - DNA, 389 bp, Zea mays
  Clone ID: LIB189-006-Q1-E1-A12
acacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccatggctaactgagccgcccggcggccggcatccacgcccgttcgtgcttgcctgcgtgcc

SEQ ID NO: 18306 - DNA, 320 bp, Zea mays
  Clone ID: LIB189-006-Q1-E1-A2
tacccacgcgtctgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggatggggggccgcttcaatgggttcaaactttattttcccttaaaggtaatttattttcttttttattttttaacttaatttcatttcatgggctttcttttaaaaattttgggaagggaaaacccttgttttaaccaaatttattccctttgaaacaattttccttttccca

SEQ ID NO: 18307 - DNA, 403 bp, Zea mays
  Clone ID: LIB189-006-Q1-E1-A3
gacccacccgtccacccacgcatccgcccacgcgtccgcccacgcgtccgcccacgcgtccgcccacgcgtccgcccacgcgtccgcccacgcgtccgattgaatttcatattgtcacctgaggtgaggaatcaggacgcaatatttttgctaagaggggtgagttcaggggcacacgaggtagcatggcaatggctgaaggaaaactgggattacatattgggagcctactctggaactctgctcacctatttcgtcaacataactgtctcgccactggccaccgatgaacatggtgatgaggcggaggagtttttcaagagcagaaccaaggcgaacatcgcgaggactgtgaggcagagcatcgagagggtgaggatcaatgcccaatgggtcaagaaca

SEQ ID NO: 18308 - DNA, 160 bp, Zea mays
  Clone ID: LIB189-006-Q1-E1-A6
acccacgcgtccgctcgcgcagtttctggatctgggctccgcttcagctcgagatcgactgggatgggaagatcctctgctgcgttgtcttgtctgtgctcatccgtgtgtactgtgtaaatatgaagatgtaataacaaaaacacgcattttagctttc

SEQ ID NO: 18309 - DNA, 400 bp, Zea mays
  Clone ID: LIB189-006-Q1-E1-B10
agggaaccgggcaattcgtcaaacaaaagaacagctggtaaaacggaggaccttggtcacaaggatagttcatctgaagtgtcctacgagtactgtgtaagggtggtcaggtggctggagtgcgagggctacatcgagacaaacttcagggtgaagtttctcacatggtttagcctgcgtgccaccccgcaggagagaaagatagtcggtgtctatgtggatacccttattgaggaccctgtcagcctttctggccagctcgttgacagcttctcggaggcggtatatagcaaaaagcggacgccttctggtttctgcatggacctgtggcattgaagcaccacaagcacctaccgtttgctttgtacggagcacacattcgggcccattcttttgttgc

SEQ ID NO: 18310 - DNA, 326 bp, Zea mays
  Clone ID: LIB189-006-Q1-E1-B11
acccacgcgtcaagtccttgagtcagtcagacagtccgccagaagagctggtacaatggacgaccttggccacaaggatagttcatctgaagtgtcctacgagtactgtgtaggggtgggcacgtggctggagtgcgacggctagatcgagacatacttcagggtgatagtttctcacatggtttagcctgcgtgccaccccgcaggagacaaacatagtccctgtctatctggatacccttagtgcccgaccctgtcaggctttctggccagctcgttcacagcttctcggacgtcgtctataccataaacaggcacgccttctg

SEQ ID NO: 18311 - DNA, 458 bp, Zea mays
  Clone ID: LIB189-006-Q1-E1-B2
attcaaaggccgaccgacccgtccacgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcaaggcgtgcacgggcacttcacgaagcggcccgaggagatcggcgcgggcgaacagggccacatgt

SEQ ID NO: 18312 - DNA, 379 bp, Zea mays
  Clone ID: LIB189-005-Q1-E1-G3
agaaactaaagcttcagaagggtaggcgttcatatcacatagagaatatatgcaatccttgacgtagaatgtttggtagtgatttaccccgatgaagtcaatttggttcttcaatagtttcttctctccttctgtaaattttggcaaatttggacctaagatttggcgcatctggtgaggatagtcaccaaagaaaaagggatccaagatcctgttttagcatatatcatcaagtgagcattcaatcgtgaagaccaaaagttagttccaatcgtaaaagttagcatatatgatggaaggttactgaatcaattgataccatggagcatcgaaagacagagctcggcttactgccaagtggtcctctgtgatattcctg

SEQ ID NO: 18313 - DNA, 364 bp, Zea mays
  Clone ID: LIB189-005-Q1-E1-G6
ttccagggccgacacatgcgtccgcgacagaacataggatgatagaacatgtcacaggcagactactattgctctcttaataagtattatatattatagtttaggatttaacggtggtaactagtggttcattatggattttccaaataccaaactgtttttttaatgtcacgctaaagtactagcacacttataatcctaagaaacaatatataaatacaattgaattttattactctgatccacattatgtcgctttagaatcagtgacttagaggtggaacgcatatgattcagtttagcttttatgagatgaggatatacgtgacaactcacttttgagtcgtttgggatgacccgttct

SEQ ID NO: 18314 - DNA, 362 bp, Zea mays
  Clone ID: LIB189-005-Q1-E1-G7
acccacgcgtccgataaggaaaccggatctgttgttcgcctatcaaaagctgcgcagcctactgttcttcaatcaactaaacgacttgccctctatcaagcagcaggagatcaggacatcttcctcaaaagaacagccctgcttctctggtaggaacgcagaagctgttcaactgcaggatactaatcactccctgtcagatatgatcaacatccgcaaagcttagaaaaagcatacgaagttcacagatcagtttgtaacctgtaatccggtaatgatacataatgaaggttcagatattggtgatgaatacaggctgttcaacagtaaaacgaactccaatgctatcatggttcatagca

SEQ ID NO: 18315 - DNA, 396 bp, Zea mays
  Clone ID: LIB189-005-Q1-E1-G9
attcaagggccgaccgacccgtccaagctgaagttgaagctgaagctatgagctctttcaggattgatgatgacctcggggttaaccctgatttgaaccaaatctcttcaaatttgcatgggttgggatcttcaagtacccgtgttgagattggtggacatgaccgcaccccggcatcttcagaacagcgagcggagagtcatggaaggaagcgtaagcaaagtcagattgctggggttcttgaggaatatttggattacaaaaggcaacataatgataagttgcttgatgtggtaaatcagattgatcaacaagctgagggatgtaacaagaaggaagaatattgtattggaaagtgtgttcgtgtgttagagtcgatggaagatataactgaag

SEQ ID NO: 18316 - DNA, 367 bp, Zea mays
  Clone ID: LIB189-005-Q1-E1-H1
ccttccccgcccacggcctcggggaagggagctccggcacggaccactggtggaactccgggagctcccttccccgcccacggcctcggggctccactggcagggcggcccgcgccacggcgcggccaccaccaccgacgtggccgccgtgttcgtgccggacatctcgtccccggagaaccccttctggtgctacgccaccgccgctggccagccgccgacgaagcgccgcaggagatgttgaagtagggaagatcgagattgtcttgttcagtactggagtggcgtaggcttgcaagaaacaaacacagttgctgtactgtgtactcccatggtgacgtactatctatatactccatgtcgcagc

SEQ ID NO: 18317 - DNA, 434 bp, Zea mays
  Clone ID: LIB189-005-Q1-E1-H3
agagctgcaggtgcccgacgacgtgtacatcctggaccaggccgaggaggacggcatcgacctgccctactcctgccgcgcggggtcctgctcctcctgcgccggcaaggtcgtctccggctccgtggaccagtccgaccagagctacctcgacgacggccagatcgccgccggctgggtgctcacctgccacgcctaccccacctctgacgtcgtcatcgagacgcacaaggaggaggagctcaccggcgcataatcattcatgcccatccatctctatctctgtgggtcgtcgttgtgtgtaatttgagtacgcgcgtacacgtactgcttttgtttcatttgagcactgttcgtgtaagcgtcgagttgccctgccatcgtctctctccccctcaatctcaacaatttcggtgtgtgcgcgcttctatttt

SEQ ID NO: 18318 - DNA, 420 bp, Zea mays
  Clone ID: LIB189-005-Q1-E1-G11
gaccgacccgtccacggacgagtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaagttaaaaaaagggggggcccctcaaggggttttaatttttcttcccctttcttgcaattttttatttcttttaaattttccccaaatttcatttcaggggccttctttttaaaacttcttgccgggaaaacccttgggtttccccaatttaacccctttgcataaattccccttttccccattgggtttattttcaaaaaggccccccctttttgcccttcccaaaattttccccccttaattgggattttggaccccccttttt

SEQ ID NO: 18319 - DNA, 377 bp, Zea mays
  Clone ID: LIB189-005-Q1-E1-E6
acctgcaggtggcggagcccaaggcagcggcagatgatcaggagagcacgcgagacaggctgaagcggcacaggcgggagatggcggggagggtgtgggtcccggagacgtgggggcaggagaagctgctcaaggactgggtggactgcgccgtcttcgaccgccccatggtgccgatggggctgctgacggcgcgccgagcgctcatcgccgagtgctgcacacgccgcccggaccgagcggcgtcgtcgtcgtcttccaccagcagctccaacccgctccgggtgcggaacggctgctcctgatcgggtgctctcctctccttcagacctccgcctcccatcagcgagctaggctgaatcagcaagccttctttt

SEQ ID NO: 18320 - DNA, 426 bp, Zea mays
  unsure at all n locations
  Clone ID: LIB189-005-Q1-E1-E8
gtctatcatagcttgtatgatgacttcatatggatggaaaagtttggagatcccttgttccagaggcatgttgcagctgcaagcatgtgggggcttgttgctcttaggctctcagatgaggagatcctacccttcaactacagcaattatgccacagagcttgagaatggagcattgggcataagtgaaagagtacagggaatgcctgtcagcttatcacccctgcacaagtcaatcaaagagttcagaaaggcagttgcaaaagtggattctgaattgaaggctctacagacatggaaaatttggtccccatggagaaacaaccccttaaaggtcagagacatcaatgatcggttgatgatgaccgaacgggcattcacagaccgggaaagactgtttngacggccatggtacaaacacctgatt

SEQ ID NO: 18321 - DNA, 369 bp, Zea mays
  Clone ID: LIB189-005-Q1-E1-F1
gtttgcaggctgaacacgcacgcggtgatcgagccgttcgtcatcgcaacgaaccggcagctgagcgtggtgcatccagtgcacaagctgctgagcccacactaccgtgacacgctgaacatcaacgccctggcacgccagacgctcatcaacgccgacggcatcttcgagcgcaccgtgttccctgcaaagtacgcgctggggatgtcctccgacgtgtacaagagctggaatttcaacgagcaggctctcccagcagacctcgtcaagagaggtgtggctgtgccggaccagtcgagcccctacggtgtccggttgctgatcaaggactacccttacgccgtggacgggctggtcatctggtgggcg

SEQ ID NO: 18322 - DNA, 357 bp, Zea mays
  Clone ID: LIB189-005-Q1-E1-F12
atcggttcaaagctctgcgtccctgctcctgtccctcccatggacgccgcccctccctcagctcactccttctacccgcgatggagctcgcccctgtccaaattcggttgcctctgtttccccctctctctgttggtggctggtatcccatctcccctgcgttggacggctgccgcttcgttctcgtcgctggcgttcgtccctgctccagctagttctcatggccatgcctctgttccctaggtccgacctcgccgaagtccctacctatcgctgctcgcccctctctgtctccgtgcgagcagcagcacgatggggcacacctatgtcctccacgcgcaccagatgtttgatggg

SEQ ID NO: 18323 - DNA, 372 bp, Zea mays
  Clone ID: LIB189-005-Q1-E1-F3
aaagttaacccaaaaataagcgcattccagaaagcacaggattgtcttctgcccatgggaattacgtctgaaaatgttgcccatcgatatggtgtaaccaggcaagagcaagatcaggccgccgctgagtctcataggagagctgctgcagccacggcctctggaaaattcaaggatgagatcgtcccggtgccaacaaagatcgttgatcctaaaactggagaggagaaggaagttgtgatatcagttgatgatgggattaggccagggaccacagcatctggattggcgaaactgaaaccagtttttaaaaaggatggaactacaactgcaggcaattccagtcaagtgagtgatggtgctggagctgtt

SEQ ID NO: 18324 - DNA, 425 bp, Zea mays
  Clone ID: LIB189-005-Q1-E1-F7
ttcccgggcccgacacacgcgtccatgccactgctatcctgtgatctgccctgagtggctcctatcgtgttatgtttctgtcggttcttatctatctgtcgttgtgtggtttacaacttacgttgtaagactttattcccccgctttgctactgggttattaagtttggcgttattgttttcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccccaaaggtttaaaactttatttccctgtgaaggaactttaaacccctcccaaaaggtccccaaaaattaatttcagggg

SEQ ID NO: 18325 - DNA, 409 bp, Zea mays
  Clone ID: LIB189-005-Q1-E1-G10
attccagggccgaccgacccgtcaggtttcttatccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtac

SEQ ID NO: 18326 - DNA, 364 bp, Zea mays
  Clone ID: LIB189-005-Q1-E1-D1
gctgtgcttggtggaaggatgggctcaattcggtgtgtgaagttctctccagacgggcgcttccttgcaacagcagagcccgtggattttgtccacatgtacgatgcttatgcggactacagcagatctcacgagattgacttgtttggcgagattggaggtttagcattcagccctgacaccgaggccttctatgtgggccttgcggaccagacgtacggaggcatgatcgagttcagcaagaggcaccaacatcattactttaactccttgtggtgataaccacctgagcggaaatttggttgcacagctgttggaccccattgttgcattgtgtgctccagaggagtgcatggtcctacag

SEQ ID NO: 18327 - DNA, 409 bp, Zea mays
  Clone ID: LIB189-005-Q1-E1-D10
ccgaccgacccgtccacccacgcatccgtttccattggaggtgccaacatatccaaacctttggaaaggttcatactccaaatgggagcgctacaccgtggaagatgcacatgatattgtcaactacgctaagaaaagaggtatcaatgtgatggcagaaattgacgtgcctggtcatgcagaatcatggggaaatggatacccaaagctctggccttctcccatttgtacagagccattagatgtctctagtgatttcacatttgaagtaatttttggaattttgtctgatatgaggaaaatctttccattcgggctgtttcacttgggtggtgatgaagtatacacagggtgctggaacacaacgcctcacgtgcggcagtggatggacgagcgcaaaatgaccacg

SEQ ID NO: 18328 - DNA, 325 bp, Zea mays
  Clone ID: LIB189-005-Q1-E1-D11
gaccgacgcgtccacccacgcagtccgaaaaaaaaaaaaaaaaaaaaaaaaaaaaaaaaagaaaaaaaaacaaaaaagaaaaataaaaaaatataaataaaaaaaaaaatagggaggctgctctagaggttggttacttcatttctcaggcatgcaaggttataacgtgttccttcttttaagttttcttattttaattggctgtcgttttacattcatatctcttgttaaggtcctgccgttttaaacctaaggccctttgttttaaacctttttttcggtaacacccttgttttttccaaaggttagcccctttgtttcttcc

SEQ ID NO: 18329 - DNA, 437 bp, Zea mays
  Clone ID: LIB189-005-Q1-E1-D2
acaattcgcaagcccttccaacggcagtcatggcttccatcaccctcctctccctcgctcccaccgccatcttcctccacatcccggctttcacctcctcctccgtcgttggtcccggaatcctagccggccgctgggccgcgccccgcgccctcccgctccgcgcgctcccgccccgtcgcgtcaccgtcgtctgcagcagcgccgcggcggcagccgaggcctcggacgccgcagcgccagtggagaagttccggctcgacaatttggggccccagaaggggtcccgccggcggcccaagcgtaagggacgcggtattgctgcaggccaaggcgcgagctgcgggttcggtatgcgcgggcagaaatcgcgctcggggcccggggtccgggcccggttctcagggagggcagatgccgctctaccgccgtctccc

SEQ ID NO: 18330 - DNA, 434 bp, Zea mays
  Clone ID: LIB189-005-Q1-E1-D4
acccacgcgtccgcccacgcgtccgcccacgcgtccggtcccggatcccggcggtttacccctgcggcctccgccgctccgcggctctgcctcttcctccgcttctccttgccccgcgtgcgcgacgaacgccgccgcctccgccctaagagtcttcgtcggaccctccgtcaggattcttcggggcccttcgccggcgacgatctgacgtgacgatgtctggtcatacccaacctgaaggaccacgccaacttgattcaaaacatgctgtgaattcatgccgaaagaatgtacccggtacatcgttcgtctcagatttgagggatcacatccacgagttcatcaatgcatctgcagatgaacaccggacatgcttcacaaagactctcaaaaaggatgttcattatgtcaaagactgtcactgatagatcctc

SEQ ID NO: 18331 - DNA, 384 bp, Zea mays
  Clone ID: LIB189-005-Q1-E1-D7
cggacgcgtggggtttctcaatgctgctgatgacaagcggaaggaagtcctctctaaaatagaagaggatgttgctaagctcagcggttctgcagccaactaagaagctacaagtgaatgccgaggagagcagcgatgacttggctaacccaccgaaggtagaggagaagcttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgctggataag

SEQ ID NO: 18332 - DNA, 385 bp, Zea mays
  Clone ID: LIB189-005-Q1-E1-E11
acccacgcgtccgagagaacgcgatttgttctgttgttcggtccccaatcttcgcctccgctccgcccgccccgacccagatcaggagctgagagatggacgccaacaggcgccaaggtgggattcagcagttgctggctgcggagcaggaggctcagcaaattgtgaatgcggctagagctgctaagtcagcaaggcttaggcaagcgaaagaggaggcagagagggaaatagccgaataccgtgcccagatggaggctgagttccagaggaaggtcgcagagagcagtggtgactctggtgcgaacgtcaagcgtctcgaggaagagacaacggcgaaaatcgaacagctcaaccagcaggctgcaagcatctccccagatgt

SEQ ID NO: 18333 - DNA, 428 bp, Zea mays
  Clone ID: LIB189-005-Q1-E1-E2
acccacgcgtccggaggtggagtcttcagacaccattgataatgtcaaggctaagatccaggacaaggagggcatacctcctgaccagcagcggcttatcttcgctggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttaggggtggtatgc

SEQ ID NO: 18334 - DNA, 377 bp, Zea mays
  Clone ID: LIB189-005-Q1-E1-E3
accgcaggtggtgtcggtcatgcgacgaaggaaggggccgaggagcctggacaccatcgccgaggacgacagggagcagcagctggcgtgcgggtcgccatcggaccacggcctcgcgacggcgtggtcgtcgctccagaggataccgacgccaccgcagccgccgcgggagcgcgcaggtgggtccgtgacgagggacctcagcaagaacttcttggactcccacggctgccagcaggccagcggctgggagggtggacacatgctaggccaccggcgagccgtgcatgcgctggagcttcacaaggtcggagcttgttgaagagggaagagagaaaatctagcttagctgcagtgagcttgttcgggagaaatat

SEQ ID NO: 18335 - DNA, 433 bp, Zea mays
  Clone ID: LIB189-005-Q1-E1-E4
acccacgcgtacgcgagataagagcaagatgacgtcgtcgacggcgttcagccaactgttcccttccgccgctgcggtatcccccgtccctcgctgcgtctccctgcagctcttctgcgccagcggtggagttgtccctggatggaggagaagatgccgccgcatggccatggtgcgcgcggccaccgcggatgctgcggcgcccgcctacacctccgattccctcatcctctacttcaaggcggagggcaccatggaggagagggccattcccaagatcacagaatctcttgagggtatggagggagtcaaggacctggaggtgctcattgaagaaggcatcggaagtgttgtgttaacaaaggagacaactgtgcaagctactggaataacctcaaacctggtggaagctatccagggagctgggttcaag

SEQ ID NO: 18336 - DNA, 383 bp, Zea mays
  Clone ID: LIB189-005-Q1-E1-C9
gaccgacccgtccagcaaagaggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcag

SEQ ID NO: 18337 - DNA, 54 bp, Zea mays
  Clone ID: LIB189-005-Q1-E1-B3
aaaaaaaaaaaaaaaaaaaaaaaaaaaaaaaaaaaaaaaaaaaaagaaaaaaaa

SEQ ID NO: 18338 - DNA, 370 bp, Zea mays
  unsure at all n locations
  Clone ID: LIB189-005-Q1-E1-B4
atgacctgaagctccacccgccatggcattcacgcccgctacggcctgctgcnaagcttccctggcgctggcaccgcgggcgtcgccccgcagcccggcggcctgcgcgcaggcggcgctcctctgcacgccctcaacctccgtgttccgcggcctccgggcgcccgcatccgccgcgccggccccgcgccggcgccgctcggcggcgtccacgggcatagtctgcggcaaggtacgtggcctcgggaatggcgtgcgtgcgtgcgggaatccgtgttccacacatggcggtgattggtttggtagccgtggtcgtctcctcgttgcaggtcgccaagggcagcgtgccgccgaacttcaccctcaagga

SEQ ID NO: 18339 - DNA, 365 bp, Zea mays
  Clone ID: LIB189-005-Q1-E1-B5
agaccatcttcatcagtttctaatagagaatctagtgcaaataatgcttcttctctgaagtcccaagaaattacagaggttgcaggcgacgcaagaactcaacaccaaaataaacctcgtcgatactcggagatgaactttggccagtgaacatagtgatgatagtaaatcagtgagggttcattggagctttggatccaagtaagacttgtgcaagagaccctggccttaccaagtgcttccagcatttcactgtctgatgtctagcactatcttgtgacccaaacgaggtttgacaggaggtgttcaaaccatcgctgtggtcatttgctgtgattattctgacgggctggtgttgttacaat

SEQ ID NO: 18340 - DNA, 374 bp, Zea mays
  Clone ID: LIB189-005-Q1-E1-B6
acccacgcgtccgcccacgcgtccggaactgatgaatacatgccaatcgagtcccttactgatcaagatgatgttgcttgcaatccatttcccttggagggggatttatatggagattctgatgatgaggacgagcttgacaattccagtggagacaggcataatggtgtgcagagggctggtatgttgtcagagggtcatcccgaaatgtcatttatagatcatgatcaacagacgttgaagctagatgcagatgcacaagatgactcttgcacatcatttgaggctcatcaggttggttgcgatggtggggcacatactgatattggcaatcactacaggagtgacgacggcctttgtggtggtgcagaaca

SEQ ID NO: 18341 - DNA, 355 bp, Zea mays
  Clone ID: LIB189-005-Q1-E1-B8
acgcgtgggcggacgcgtgggcggacgcgtgggcggacgcgtgggatctcacgcgagccccaagagatccccaaaccctacacctgcccgccggcgcactcggggaccgtcgaatcgagcaggttgacggaggagagggagcctcgaagatgttccggaaccagtacgacaccgacgtgacgacatggagcccccaggggcggctgttccaggtggagtacgccatggaagccgtcaagcatggctcccgctgcgtcgggctccggtcgagcatccatgcccgtcttagccgccgtcaacaagcccgcctccgagccctcctcctaacagcggaaggtgttccgcgtcgctgacc

SEQ ID NO: 18342 - DNA, 366 bp, Zea mays
  Clone ID: LIB189-005-Q1-E1-C1
cggacgcgtgggcgacgacgaggaccttctgtactgcgtgccggtgttcgaccctatgctcgccgagttctacaaccccgtggccgacgagggggagcagaagccggcctgcctgatgctgcctctcgtggaaacatcgccggagttcgcctccggcggcttggcagaggcggacgggctctccggcttcgacgtcccggacatggatctcgctagcttcgcggcggacatggagagcctcctcatgggagtcgacgacgggtttgacgatctgggtttcttggacgaacagaatcctcaggtgaacgcggacgtggacttggaggccatggcggcgccggagcctgaacgagaggacaagaaaag

SEQ ID NO: 18343 - DNA, 400 bp, Zea mays
  Clone ID: LIB189-005-Q1-E1-C11
agcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagttcaacc

SEQ ID NO: 18344 - DNA, 368 bp, Zea mays
  Clone ID: LIB189-005-Q1-E1-C2
aggcgttcgcgaagcgcgagaagaactcgatcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcaggagctacctcatcgccatcagcggcgagaagaagcccgccatgagggagatcatcatcgacgtcgagctcgccacccgcctcctccccagggggttc

SEQ ID NO: 18345 - DNA, 341 bp, Zea mays
  Clone ID: LIB189-005-Q1-E1-C3
tcttttccttctccgccctcgccgccggccaacatgatgcacatgaccttctactggggcaagtccgccacgatcctattccacggctggcgcacctccacctggctcggctaacttctctcccccggtgggccgcgtccctccccgcccccttttaacaataccccgaggccttgcgggtccgcgtaaagcacatcgcgaaaagatcccccaagccagcctcctaaatccctccacccgccatctccgacccgcggacgccgctcctcgcgcccgccttcgccgggcgctggccgccgcttgtggccgtggccgcaatgttcggggtcaactccggcctc

SEQ ID NO: 18346 - DNA, 356 bp, Zea mays
  Clone ID: LIB189-005-Q1-E1-C4
agcagttaatatagttatattaactaatgcctccttcaactatgcgttgggcatgggagcattagccgaaccacctcaggacagctctgccgacggtgtgatcttgatcaaggatatggcggagtggcaaaagcactgggaccagactgctccatacaacaagctgctggtgtatgagttctacgaaaagaattcctcgctgtgcaaggccatggacaagccgttcgagaagctcgccacgcagtacaaaggcagggccgacttctgcaagctggacgtggacaactttgagcttttggcgcggatttgcggagtggagggagcgtatccgacgttcgtgctgttcaagaaatgcg

SEQ ID NO: 18347 - DNA, 442 bp, Zea mays
  unsure at all n locations
  Clone ID: LIB189-005-Q1-E1-C7
ttcccggcccgacccacgcngtcaaagcggacgcgtgggcggacgccgttgggcggttggtaaggaagccaagcacgaaaggaacccctttccttcgtttgggttctaaacgttgacgaaggaagatccngctgttgccgcaagggcacaagggcgggggcggtagcttaactgggtgcccgatgtctagcgttgtcccnnctgaagatccnacgacatcctcaatctcgccttcacatgattcacctgtacacatatcacggatanacatggataatgttgaagtctctaagtttgtaggggttcaatgttcatcctttgtactaatctgctttgtctccgnaaaacgagaaaaaaaagggcaattggacggtgtaacataatgaaatgctatcttggttgataactaaaattttctaattttgtgaatgttgtcaacaat

SEQ ID NO: 18348 - DNA, 436 bp, Zea mays
  Clone ID: LIB189-005-Q1-E1-B2
acacgcggccacgccgaagtatggcgctctccgtctcctccctcgccgccgccctctcccacctctccctcccatcgacctccacccccaagcctcacccggccccgctcctgcgcctgcgctccacctaccgccgcgctgttagcctcgcgctccgcgcctccgcagccgaagccgccgaatcgttcgaggcggacctgcccgccgaggaggtgatggctgtcgaggaggaggcggaggaggatgcgctgtcgggaatcgcgctgcgaaagtatgtgaagcagcggctgccgggcgggttcgcggcgcagcggatcaccgccacgggccgtcgcaagacggccatcgcccgcgtcgtgctccaggagggcaccggcaaggttctcatcaaccttcgcaacgctaaggagtatctgcagggaaatccaatgtggat

SEQ ID NO: 18349 - DNA, 417 bp, Zea mays
  Clone ID: LIB189-004-Q1-E1-H7
aatcatataatctctcttcgtcactagctcgtggtaataagggaagcttgatcatctttccttatggcggtgatgaagagcagcacaatcgtcgcgcttctattggctgttgccattctgtcctcactgtctccatgctacgaagccggcggctgcatcgggaaacccaagaagtcaccgccgccgccgagaaggccattcttctcgtcctattccgaggaccaccagaactgccgcttgatctgtagctcgaagggtttcaaggacggtggctggtgtgacgaaagcgtggagcacaaagtgtgctgctgctcccattagaaatataatagcgtatgttatgttgatgcatatatatgcatcatccatctacctgtgtggtgcaaaactctgaataaaacctgaataaaacctgat

SEQ ID NO: 18350 - DNA, 422 bp, Zea mays
  Clone ID: LIB189-004-Q1-E1-H9
acccacgcgtccgcccacgcgtccgggaggtaaatcctgtgagatttagatgagaagaaagctttagcgaggcgcttgccaagtgcttggtgaatcacctcaaccggatgtggttgtcgatctcgcggagtcgagtcgagtttagtcgtggtacgctagatgattatgcgagctgaaggacatggatcagagcaaaccagtattggtggattaatcttgtggatgcatcaagccagcaccagaatggaagatgctcaccaagtggtcgtcaattaacaacactaacgtagtgtttatcccaggattataagtttgttctgttgtggatggtgctaagtgccggtgggctcggccttcttatataagtatatcacatctttagcttctttattgaggactgtcacttaagctagcatgtattt

SEQ ID NO: 18351 - DNA, 110 bp, Zea mays
  Clone ID: LIB189-005-Q1-E1-A1
ccacgcgataagcggacgcgtgggcagacgcgttggctgaagtgtgggttgaggcgtggtcggtgaaggggtacatgatttggatagatttagccatgtaatcatcgatt

SEQ ID NO: 18352 - DNA, 210 bp, Zea mays
  Clone ID: LIB189-005-Q1-E1-A11
tccaggaagcagctgactttgacaaccctgtgggaagcagcaactatgaagcctcttgtgtcagtctttgtatggcggctgatgtttcttctttctgtgtcgtatgagtatgttttgtcctagtagattgtatcaggagtttttcagttcaaattgagctgcgcatgttcttttgaaaaaaaaacaaagcaaaaaggaaacaaagtaaaa

SEQ ID NO: 18353 - DNA, 421 bp, Zea mays
  Clone ID: LIB189-005-Q1-E1-A12
atttggcgattccgatgaggactgatgtaatgacatcttactgatttttcatccctgctgacggaagcttgatttctccgttggtgatgctatggatgtaatcagatcagccatttgcaagctgattgctgccacggatgagtattgtggcagcgggcaatcccaaaatatagctctcttgttataggttagtttattatgagtagcattcggcttatgtttttctggaccgtccccattatgcataagcttgggctgcttggctgtatgtaataataagcaacattctgcttattatgatttgcattctcttggaggcttagtttggaaacttaaatcctctccgatatttccaaaaaaaaaaaaaaaaaaaaaaaaaaaaaaaaaaaaaaaaaaaaaaaaaaaaaaaaaagggggggcc

SEQ ID NO: 18354 - DNA, 373 bp, Zea mays
  Clone ID: LIB189-005-Q1-E1-A4
gtgaatagcaggagagagcttccagtagacctggctgaaggaaatctcaaagctctaagcctccaagccctgggtcagggggttgacatgcagcttggtttggctattgatagtccaaaggccactttagcagtaaaacggcgcttagcctgtgagatggtcaaatattggcaacaagttcaagagagcattccagagcttcctatctctgatggatggggtaaaaagcaccggctctttataaagtggaaatatgttgaagctaaggtgtataatctatgctactaccatcattctttttaacttcaaattcttgcctaagtatcaaacatgctaaattttcttcagatggtatatttctctaatgtgtgat

SEQ ID NO: 18355 - DNA, 171 bp, Zea mays
  Clone ID: LIB189-005-Q1-E1-B1
cggacgcgtgggcaaactgacggcgtgtacagattttcatgtccggcaacgctggttgagactagaaaactcgttgcgttatgtagataaagccagggtgtcatcatgtgttcgctggtgtaatggagcagattagcttggtaattaatgagacattgcatttcttaactt

SEQ ID NO: 18356 - DNA, 403 bp, Zea mays
  Clone ID: LIB189-005-Q1-E1-B12
acccacgcatccgcaccggaccgcggtctctccacgccctcctcggcggcggtgcagttgccgacttgctgctgtggcgacggaggaatgcctcggcggcagccgtggtgggcgccaccacggtctggttcgtcttcgagcgcgcggggtacagcttcccctccgtcctctccaacgccctgctcctcctcgtcgccatcctcttcttctgggccaagtctgcgttgctgctcaacaggcctcttccacctcttcctaatcttgaggtctcagatgcgattgttgaaaaagctgcaaatcatgctcttgtatggatcaataggctgctggctgttggtcatgacatcgccatcaagagagataggaaagtttttataaaggtgatactgattttgttggtggg

SEQ ID NO: 18357 - DNA, 380 bp, Zea mays
  Clone ID: LIB189-004-Q1-E1-G12
aacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctt

SEQ ID NO: 18358 - DNA, 444 bp, Zea mays
  Clone ID: LIB189-004-Q1-E1-G2
gggtccagcccgcgtccgagagcactgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggttgccgcgccatcgcgctggcgctcatggcggccgggttcgtcacctccggcggcctccgcgtcgctgcgctgtccgtgttctcctggatgtacaagtacctgacgggcaagcaccgccgggcg

SEQ ID NO: 18359 - DNA, 437 bp, Zea mays
  Clone ID: LIB189-004-Q1-E1-G4
cgtccgaacacgcgtccgcagacgcgtggggattcttgaagagatcgagcttcttttgcaccacaaggtccaggatgtcttgcaactgcggatcaagctgcggctgcggctcaagctgcaagtgcggcaagaagtaccctgacctgaaggagacgagcaccgccgcgcaggccaccgtcgtcctcggcgtggccccggagaagaaggccgcgcccgagttcgtcgaggccgcggcggagtccggcgaggccgcccacggctgcagctgcagtggcaactgcaagtgcgacccctgcaactgctgatcacatcgatcgacgaccatggatatgattattagctatctagcttgtggtggtggttgaacaataataagcgatgccgagctggctgccatacatatgtactgtgtggtgtgtgtgacagagagagacaca

SEQ ID NO: 18360 - DNA, 318 bp, Zea mays
  Clone ID: LIB189-004-Q1-E1-G5
cccacgcgtccgcatcttcaagccagccgtctccttatccctgcgacgccgctcacctaggctcatcttccagccgccctctccacccagcagcagagcacaccatcctctccactcggatccccaagccctcgcctccatctcttgccacgacatctgttccctgctcgaatctccaaccgggcgcgttctcgccggttggcaacggcgctggaatgccctttccaacggtcggccttggaacggtttctcgaaccgcctaattcaacctcgccaatctttggctcaacccctttctcaacgccgtcgctgagctcg

SEQ ID NO: 18361 - DNA, 414 bp, Zea mays
  Clone ID: LIB189-004-Q1-E1-G9
actcgtgtccaggttccccaaggacaccagcgcgtccttcacgctacgcgaccccgccgaggtcaaggagttcctgcgcaagctcgtcggcgccaacgacgacagctgatgatccggcccgcgattcgtttccctttcccgccgtgaccagctccgatccgcctgtgtcaagccgctaactcaacctcggctaactaactggtggaccggcaaaaggcttccttggtgttgcaactggatctccaaccaacaacctgccttgggaacaggacaggccttacctattatataattaaacccctttggtacctccgttttttttggggtccacatctctcgtgtacaacatgcatgcctgctgttgtttaccatttgcctcggctgaaaaggcttgtattttcggcgcccttcccg

SEQ ID NO: 18362 - DNA, 385 bp, Zea mays
  Clone ID: LIB189-004-Q1-E1-H1
gcgtccggacgtagccgtcgccgctcggcaaaccaagcagccaagagcagagtacggcttcgtcacgcttgcatccctacgggttcggggacgcgccgtgcttcagccgcacggcgttctcacaatgatggcgatgatgaataaataaatttatacatggatcgagcttttatccttctggcagcaatgggggttttctcgctcgtggaggtggagggagagtaagaacccgtgaaagccatcgtccgccacggtcagactctgattggcagttgcaattgctttggactgcggctgcagggatgaaagaaggtgacgtgggaagatagaccacaaggggcacgtattcgcctaaaatctccacccacaaggggtgtttgtttga

SEQ ID NO: 18363 - DNA, 413 bp, Zea mays
  unsure at all n locations
  Clone ID: LIB189-004-Q1-E1-H11
ggctaacctccttttttctctctctatctttctctccatctgtggacttctccggttttgtttgacgagatgcctgcgctcgccgtcgacgccgcgacacccgtggcgcacgccttcgcgtcctgcgacgcggcgcgcttccccgccccgcccgtggtgggccccgccgccgcggccgaggccgccccctggtcggccgacctctccgcggcgctctacaacgtggacggctggggcgcgccctacttcttcgtcaacgacgacggcgacgtggccgtgcgcccgcacggcgccgcgactctcccgggccaggagatcgacctggccaaggtcgtggccaaggccgcgggcccgcgcgccggaggcgggctcggcctgccgctgccgctgctcgtgcgcttcnccgacgtcct

SEQ ID NO: 18364 - DNA, 440 bp, Zea mays
  Clone ID: LIB189-004-Q1-E1-H2
gtccgcatacgagtccgcctcacttattacgaaccccctctgtgccactgcccactgccacctgaaatccccgcgaacctatacttttccttcccccgatccaggcggttctcttcccagaagccagcccagaatggcggcatccgacgcgctgcagtccatcgtttacagccgtgggtcgctccgcctcctcgatcagaggaagctgccgctcgagatggagtacatcgacgtcaagagttccgccgatggctggaatgcaataagagacatggttgtccgtggtgctccagcaatagccatagcagcggcactagcattagccgttgaagtttctgatttagattttattggtacgcctgaagaagcagcttcttttgtttcaaagaaattggaataccttgtatccagcccgacaactgcagttgaactatctgatg

SEQ ID NO: 18365 - DNA, 65 bp, Zea mays
  Clone ID: LIB189-004-Q1-E1-H4
acgcgtcacgaaaaaaaaaaaaaaaaaaagaacaagaggaaagaacaaagggagggttcataaaa

SEQ ID NO: 18366 - DNA, 446 bp, Zea mays
  Clone ID: LIB189-004-Q1-E1-E6
ggtccacccacgcatccgaccacgcgtccgggactcgcctccacggctccaccatgtatcccaaggcggcagacgaaggtgcgcagccgctggccacgggcatccccttcagcggcggcggcggctactaccaggcgggcggcgcgatggcggcggcgttcgcggtgcaggcgcaggcgcccgtcgccgcctggtccaccgggctctgcaactgcttcgacgactgccacaactgctgcgtgacgtgcgtgtgcccgtgcatcacgttcgggcagaccgcggagatcatcgaccggggctccacgtcctgcggcaccagcggggcgctgtacgcgctcgtcatgctgctcaccggctgtcagtgcgtctactcctgcttctaccgcgccaagatgcgcgcgcagtacggcctccaggtgagcccctgctccgactgctgcgtgcac

SEQ ID NO: 18367 - DNA, 415 bp, Zea mays
  Clone ID: LIB189-004-Q1-E1-E7
cacacaagcacttcgacgtcgcacgggcgctgcacacagacacaccaagcgtcggcaccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccatggtcgaggaggacatcaacacctgcaccggcgaggtccacgagcgcagggagagcttcctcgccagggctaactgagccgcccggcggccggcatccacgcccgttcgtgcctgcctgcgtgccttacgtatgtctgtggttgact

SEQ ID NO: 18368 - DNA, 437 bp, Zea mays
  Clone ID: LIB189-004-Q1-E1-F1
acgcgtccgcatggatggtggagcgcggcgcggggcatgcgtgcaagtgcaaccaatcgcctcgtcgtgcgctcgcctttgcttccctcgttaacgtgagtaacctcgttggctgatcaaggctttgacggcggcaccaacgttcttccctcgccgcctcgttgcgtccgcccgcccagcgcccactcgtacataaccccccaccgcgtacagcgctccctctcgcgccccgcggtgagctacccccgctcgcctttagctaaccaaccaacaaggccctcccgccgtcctcctccccgtcgtcgctctccgccgcgttaacgcaacccacgcccctggcactgcaactcccgaccaaagcgcccggccgcctcccgctgctccccttctcgcgcgccgcactcccggccgcgccggcgcctcggcattgcgcgcac

SEQ ID NO: 18369 - DNA, 418 bp, Zea mays
  Clone ID: LIB189-004-Q1-E1-F11
acggacgcgtgggcgacaaggagatcctcatgatcgtgaaggagaacttcgacttcaggcccgggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggactgtcactgtggacatgaggactaccttcctctggctctgctgttacctgcaagcattgctgctgctggatgtgtgtgtttgatcagtgactggctgctgctccatagaagatgaacggagagaaggatgatgaagggctttggcaatcgccgctgcaactgcaacccatgccatgccggcttagtgattgggtaaaattgggc

SEQ ID NO: 18370 - DNA, 172 bp, Zea mays
  Clone ID: LIB189-004-Q1-E1-F2
gcgtccgaagacacgtgggttggcagtttagccacccgtggcagtagtgcttgttgctttcacaagaaattagcaaatacccccaccgattacaagcgttgagtaatagaaaaataaaagatatacaaagaagaacaaaaatacaaaaatcggaaagtaaaaataatataaa

SEQ ID NO: 18371 - DNA, 358 bp, Zea mays
  unsure at all n locations
  Clone ID: LIB189-004-Q1-E1-F4
ggtccacattacgggtccagcacgcgtccgcacacacgtccgccgaggagcccgccgcggccgaaccggccgccgaggcggaggctgctgctcctgctggtcccgaggagactcccgcggccgaacaagaagcaaccgccgaagaagaagctgctcctcctgctggtgccgaagaacccgccgccgccgagcctgtcgccgaagcagaagctgctgctctccaggagctcgccgcggacgaaccggaggctcctgctcctgctggtccccaangagccggccgccgaggcggaggctgctgctcctgaggagcccgagaaggccancgagtgaggccgtgcgcacgcagcggcggcgg

SEQ ID NO: 18372 - DNA, 429 bp, Zea mays
  Clone ID: LIB189-004-Q1-E1-F5
aagaaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaatagtctctgactatcattaaataaagggtagagcaattctttttttctagagattctagagaaagtgagacaaagtgaagcgaaagagttttctttgtataagaattaggtctatatcatatctaaatagaagggaaatcaaaaagaagggaagtggggattacattggatgaatccttaaggaagacatatcacaaaagaaataaaggctaaagtaagcggtccttgcctttgg

SEQ ID NO: 18373 - DNA, 395 bp, Zea mays
  Clone ID: LIB189-004-Q1-E1-G1
gggtccagcacgcgtccggaggcagcccttttttttttttttttttttttttgagtactgtcaaaactggtgtgatttataacagtaaagattacgagcagtgttttacggttctatctgcaaaaaaaaaaaaaattacagctagtctgtgctttacaactgctgcatcattgtcctcgccagctacccgttaccctcgccatcccaatcctaggccgcatcttcgccgtgcatgggttcggacggcgagctgacctccttcacccccgatctcttcttggccttctgtgcccagcccagcacgccctgctgcacatgctcgttgaaaatctccttcttgtagtagctccccatctgggtaacaattgcataaagcgggagcgtgctgtagctgc

SEQ ID NO: 18374 - DNA, 410 bp, Zea mays
  Clone ID: LIB189-004-Q1-E1-D11
cccacgcgtccgacgagcgacgaagcgcgcacaaagagaagaacctcggagctgagatggcacaagccatggcgtcgatgacaggcctctcgcagggcgtcctgcccagcaggcgcgccgacagcagaaccaggacggccgtcgtcgtcgtcagggcgtccgcggagggcgacgccgttgcgcaggcgggccgccgcgccgtgatcgggcttgtggccactggcatcgtcggcggcgccttgtcgcaggcggcgcgcgccgagaccgtcaagaccatcaagattggagccccgccgccgccctccggtggactccccgggactctcaactctgaccaggcgagggacttcgacctccccttgaaggagcggttctacctgcagccgctgccgccggccgaggccgcggca

SEQ ID NO: 18375 - DNA, 414 bp, Zea mays
  unsure at all n locations
  Clone ID: LIB189-004-Q1-E1-D12
acgggccaattatatcccgttgaaatacaatacagaagaagtttaaggtatcttcaacacagctcctgtactagtcatgcccataccgggcattgacgttgttccttgtcggtccattcctcgatggatttttgactaaccaaaatgtctttgctttcgactacacaactcaagttctgtttttcatcatgctgtcgtgcctgatttcagtctcggtgaacttcagcacttttctcgtgatcgggaagacgtctcctgtaacctacaaagtacttggccatctgaaaacatgcttggtcctcacctttggctatgtcctgcttcacgacctatttagctggagaaacatacttgggatcctaatcgtggtaattgggatggttctgtacttgtacttctgcactanagagactc

SEQ ID NO: 18376 - DNA, 174 bp, Zea mays
  Clone ID: LIB189-004-Q1-E1-D2
cgtccgaatccaagtttctctatttctctgatcctcattagttaacatcaagcttatcacactggttagatagtctccacctccaccttcctgtctaccttcgccagtaggtctgaggcatgcgataacctgctcatcgcgtgccgtccttccagaagatcatcatgttcttgc

SEQ ID NO: 18377 - DNA, 208 bp, Zea mays
  Clone ID: LIB189-004-Q1-E1-D3
gggtccagcacgcgtccgcacacacgtccgcttttgacgatctcccacatgacctaaaatcatgcttcctctacttttgcggcattgccaatgaaaaccccggttaaggctcccaaattggaatccagttggatggaaaaggggttcctaaaaccaaagaatgggaaaacaatggaaaaagttggaagaatcaatttgaaggatttgg

SEQ ID NO: 18378 - DNA, 475 bp, Zea mays
  Clone ID: LIB189-004-Q1-E1-D4
ggtcgacattacgggtccagcacgcgtccggctgcaccttacccatcagccaagagcccgatggagagcagtgacacgtttggcagtgggagcgccaacgacaagtcatcatgcacagacattgccctctcaagcaaccatgaggagtccctatgtttagggcagcccaggaacatcagcttcatccaagagtctcccagtacaaaactacagatctgatctgaatatctgatcatgcccaatgttcatagatttgtccaggctgactgatgcaaggaccatacgatacttttgcattcaggcaaggactcgagaggaagagattacgtatgttatcggtgccgctagctgttgtttatgatgatgttttgctgtgccagtttactgtgatgctggtggggcccccaactatactaacaagagagctgtcacttgcaaactcctgaattttttttttgcccaacgccaattcctt

SEQ ID NO: 18379 - DNA, 367 bp, Zea mays
  Clone ID: LIB189-004-Q1-E1-D8
accacgcgtccgcggacgcgtgggctggtggagttttcctagttacaatccattttcctcctgattatcctttcaaaccaccaaaggtggcatttcgcactaaggtgttccatccaaacatcaacagcaacgggagcatttgcctcgacatcttgaaggaacagttgaattcggcactaaccatctccaaagtgctgctgtccatctgttccctgctgactgattcgaaacccgacgaacctttgggcccccaaataactcaaatgttcaagaccggccggcacaagttcgaaaacaccgccaggacctggacccagaagtatgccaagtagtaatttccctacctggcctttggggtctctgctgc

SEQ ID NO: 18380 - DNA, 393 bp, Zea mays
  Clone ID: LIB189-004-Q1-E1-E1
gggtccagcccgcgtccgcacacacgtccgatctgatctactgatctattgagaggaacggggaaacacacctttgttgttgttgctatcttcataccgtcgccctgtagagaagcaacagggcattgggatccaagccgctgtaggttgtcgcgtttccaaacactccgacgcctaggcgatgggggcctctgaggactagggttttagggcgaggtactagcgttagtctttcctgcgaccccttagtcctatatatagcgtcgtgtgtctgggggctccaaccgaggttagcgtgggccctcccaatcaagggcccatttaaagagatagatagttgggtttagcccaatccggtcacagttgaccagctgtagaggacacacccaacac

SEQ ID NO: 18381 - DNA, 404 bp, Zea mays
  Clone ID: LIB189-004-Q1-E1-E10
agtcaggaatctctcccttgtctacactcttgctggagtggattgcattgattgtgcagcagatgcatctgtggtgggagcagtgaatgaaggtattgaagtagcagcatcaattgtaccaacagttcaaaggccttggctgatgattagtgttaatgatgattgcagagatcttcatttccgtaaagctgagtttgatcctgatgattgcccactggattgctcaaagccatgtgagaaagtttgcccagctgatgcaatatcactaaagcattccatggttgatggagagcgcacactatctgatcccttacgtggtaaatatgagggtggtgtaattactgagcggtgctatggatgtggtcggtgcttgccagtttgcccgtatgacagaataagagctg

SEQ ID NO: 18382 - DNA, 420 bp, Zea mays
  unsure at all n locations
  Clone ID: LIB189-004-Q1-E1-E11
cggacgcgtgggcccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcncgcaacggcgtcaagttcggcgaggccgtctggttcaaggccggctcccagatcttcagcgagggcgggctggactacctcggcaaccccagcctgatccacgcgc

SEQ ID NO: 18383 - DNA, 409 bp, Zea mays
  Clone ID: LIB189-004-Q1-E1-E12
cgatagcattatcatgaagttccccaaaatagacgagagtttcagaaaatgcaagactatcttcgaacagtttgatgaagattcaaatggcgaaatagataaagaggaactgaaacattgttttcaaaagctggaaatctcattcacagaggaggagatatgtgatctctttgaagcttgcgatataaatgaagatatgggcatgaagttcaacgagttcattgtctttctgtgccttgtctatcttctcaatgaagcagctgtcttggaagcaaagataaagatgggactaggaaatcttgaggcaaccttcgagaccttggttgatgcgtttgtcttcttggataagaataaagatgggtatgtgagcaaggatgaaatgatccaagcaataaacgagaacacgaca

SEQ ID NO: 18384 - DNA, 435 bp, Zea mays
  Clone ID: LIB189-004-Q1-E1-E3
ggggccagcacgcgtccgaacacacgtccgctcacaccagcacgggttagaagcactctccaccgcccttagatcaaaaacaatgcccgagtcggttggtgcttactgaaattcaaaaaaacgaaaaactccgatggagctcaaaaacgaaaaattccgaccacaattttcctcgaggacataaccgcaaaaggacgaaaaatggaccaatcaggaagaagaaagaaaaaaggacatttcaggacatcaggacttctgggaacttcaaaaaatttagggaaattcaaattgagatttattaagatttcggtctcccctgcagaagaccattaataacgccttctgagggccccgcaccctcgaaaacgctttttgcctccgcccctacaagaaaattacctcccagacgtcatttattaaaagccagccggtgta

SEQ ID NO: 18385 - DNA, 432 bp, Zea mays
  unsure at all n locations
  Clone ID: LIB189-004-Q1-E1-E4
gcgtccgatctgacgtcggcataacataatcgtcgtcgcgtgcagtccccattcccttttccagtggtctgttgctcgcgcttcgtccagcttccccggaagaggtagcacggcaagggcagaggatgagtgaccccaagtacgcctacccctaacccgcgcaaggttactaccaagggccgtatcacgggccgccggtgatggcgccgccgcagtacgccgcgccgccgcncagaagggagccgagcttcctgaaaggctgcctggccgcgctgtgctgctgctgcttgatcgacgagtgctgctgcgacccgtccatcatcttcgtcagctagactagacgaggaagaacctattggtatatataatatgtatgtatccagttgtactcttagctttattcctgcaaccttcaagctccagatgatctgt

SEQ ID NO: 18386 - DNA, 290 bp, Zea mays
  Clone ID: LIB189-004-Q1-E1-B5
accacgcgtccgcgttgttatactgctgtgtactgttagtctgctgctgatttccgttgttatactgctggtacatgtgtcgtgtgatagatgtgtcaactatatatcaatctcgtcgccggcagctctggcatgtttgagtatgtgttgcttctctgtggtgccggcgacgatggctgctagtactgttaatgtgatcgggtctccttgaacaatggcataaatatgttgcttgtttaaaaaaaaacatgatggcaaactcagtggtaaaagccggactaaggaacaag

SEQ ID NO: 18387 - DNA, 321 bp, Zea mays
  Clone ID: LIB189-004-Q1-E1-B7
cccacgcgtccgcccacgcgtccgtccttcacttccaaagtctgatcgtaagaagaaaaaggaaaagcctaaacttggcatgaaagagagtctgaaggttctgctctcctcgaggtatgtgagggatctagctaccctagtggttgcttatggcattagtatcaatcttgtcgaagtcacatggaaatcaaaactcaaggcacagttccctaatccaaatgaatactcatctttcatgggtgatttctcaaccgcaactggaattgcaactttcacgatgatgctgttaggacgtattatactacggaaatttggctgggg

SEQ ID NO: 18388 - DNA, 396 bp, Zea mays
  Clone ID: LIB189-004-Q1-E1-C10
cccacgcgtccggtggagcgtgaggcggcggaggtcggagagaaggttgcgcgcgaggcggaggcgctgcgcggggacgcgagggcgcggatcgccgtcggggagacgctgatgaagatgctgctgcggctcgatgcggtgcgaggcgcgcgggaataccggaagagggtcaccaagcgggtcctcgcgctgcaggatgctgttgacgccctcgaaccaaagccggcgccggattcggaggtcgtggcggaggagaacgagtctgaggtgacgtccgagatggtggacgacagcgcggaggcgacggaaatgccggtcgccgctgagcacagcggccggggttggggtgaatgcggcggctgaaacggttgccgatatggaggtggacgggggcaa

SEQ ID NO: 18389 - DNA, 382 bp, Zea mays
  Clone ID: LIB189-004-Q1-E1-C12
ccagacagacccctttcccctccctcctcggcctcctcgaccactccgacgcccacagcgcctccggcgagctccacctctccaccggcggcagcgaggggcgagggggctgatactgtaggcggaggaggagccgagccgagccgatggggcagcagtcgctgatctacgcgttcgtggcgcggggcaccgtggtgctggccgagtacaccgagttcaccggcaacttcaccaccatcgccgcccagtgcctgcagaagctccccgccagcaacaacaagttcacctacaactgcgacggccacaccttcaactacctcgtcgaggacggattcacgtactgtgtagttgctgttgaatcagtcgggcgacaaatccccat

SEQ ID NO: 18390 - DNA, 294 bp, Zea mays
  Clone ID: LIB189-004-Q1-E1-C3
gggtccagcacgcgtccgcagacacgtgggcttcggtactccacttcataatcaggatggttgatcaagtcagattcactcagatgtttccagactgaaaaggaatttttgctctgtgtactattagggaattcttgagagattagcacttaaattctttgaaacatcccttttctcgatgtacctcctatatatatcgtatgcttgattcatctacatgtttgtgttgctttttgaagtatctagacctgcagttatgattcaggatttcaaatagaagctttttatccatct

SEQ ID NO: 18391 - DNA, 421 bp, Zea mays
  unsure at all n locations
  Clone ID: LIB189-004-Q1-E1-C4
ggggccagcacgcgtccggcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccaaaggggggaaggtanggccgaaccggtgcagcgcctgcaggaagagggttggacttacgggattcaactgccggtgtgggaacttgtactgcgcactccaccgctactccgacaagcacgactgcaagttcgactaacggactgctgccaaggacgccattgccaagggctaatccggtggtgaaggcagacaagctcgacaagatctaaggggg

SEQ ID NO: 18392 - DNA, 238 bp, Zea mays
  Clone ID: LIB189-004-Q1-E1-C7
cccacgcatccgaaaaaaaaaaaaaaaaaaaaaaaaaaaaaaaaaaaaaaagaaagaaaataaaaaagatcaaaaaaataaaataaacttcgggaagcagtcctagactgcttcaatactatactctacgtttttcttaactcgttatccttctatattgtcacgactattcaaatcctggactatcattacataacctccttactgcaaaacccgcttcctcacactattttatcgc

SEQ ID NO: 18393 - DNA, 392 bp, Zea mays
  Clone ID: LIB189-004-Q1-E1-C8
attcccgggaccggagcacttcggaagccggacccggcgagaagcgaccgaccgcagccagctcacgtctccctcttcatccaccatgctgagggtcgcgggcaggcgcctctcgtccgctctcgcctggcgccccgccgccgccgcctcaggctcccggggccctctcgccggtacactacccggccgcgacgacgacgacacacgcgactgcagggcgcgtttcgccatcgaatctcccttcttcgccgctgccagagggttttcagcagagactcttgctccaagaaaccaggatgtgggcttatctgagctcccagcaactgtggcagctgtgaagaatccaagtggaaaaatcgtgtatgatgagtataaccatgagcgctacccac

SEQ ID NO: 18394 - DNA, 333 bp, Zea mays
  Clone ID: LIB189-004-Q1-E1-D1
gggtcgagcccgcgtccgcatccacccttctctagttctctgatcctcagcacttagcatcaagcttagcacaccggcgagatggcctccacctccaccttcctgtccaccctcgccagcaggtccgcggcagccgatagcctgcgcagcgccgtgccgtccttcgccaagatcgtcaggttcttgcccgcgcaggcgcagatcagccgcaggcggcgcgcggcggtgctgcccacgccgagggcggcggtgtcgggcaccgagaaggcgccgtcgagcaagcacgagcgcgtggtcagggtgcacagcacccaaggagttcgacgacgcgct

SEQ ID NO: 18395 - DNA, 315 bp, Zea mays
  Clone ID: LIB189-004-Q1-E1-B3
gggtccagccacgcgtccgaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcttgtaccatttcgtcaacaattacgg

SEQ ID NO: 18396 - DNA, 387 bp, Zea mays
  Clone ID: LIB189-003-Q1-E1-H9
ctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtgaagctgttcaacgccgtggccgtggaagacctcatcgtcaggggagggcgcgtcggcggcgtcgtcaccaactgggcgctcgtgtccatgaaccacgacacgcagtcctgcatggaccccaacgtcatggaggccaaggtcgtggtcagctcctg

SEQ ID NO: 18397 - DNA, 406 bp, Zea mays
  Clone ID: LIB189-004-Q1-E1-A1
gatactttggttatgtcaactgtggttaagaatggtggacttgcacctggtggcttcaactttgacgccaaattgcggagggaaagcactgatgttgaggacttgtttcttgctcatatctccggaatggacaccctggcccgtggcctccgcaacgccgccaagctgatcgaggatggttccctagatgctctcgtccgcaagcggtaccggagctttgatagtgagatgggtgccttgatcgaggctgggaaaggagactttgaggcgctggagaagaaggtccttgagtggggtgagcccactgttccgtccggcaagcatgaactggcggagattctgttccactctgctctataaatggcgccatgtccgtaccggtagctcctggaataagcaagcactg

SEQ ID NO: 18398 - DNA, 381 bp, Zea mays
  Clone ID: LIB189-004-Q1-E1-A10
cccacgcgtccgcccacgcgtccggagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtga

SEQ ID NO: 18399 - DNA, 425 bp, Zea mays
  Clone ID: LIB189-004-Q1-E1-A3
gaggtacacccacgcatcacgagtgggtgggaattctctgaccgagtgtgtggccaatctctcggccataaagctggagactggtaagttgctgcttgaacccctagaccgactgaagaatgtagacgcccaggtcaattttactcaaggaatccttgaagggattgtatgagaggagcttggagttttacctggaatggattcgatctgtttagtcttagctcttcagaagctccttaatttcttttcatctggaaggagtaattcacattcagaatttgatgtgatcgtgtatgattgcaacaatacagaggaaattccaccgctgatacgtgctgctgaccgggcaagatcttacttgatgtatctgagggaccttgctgataagactgacatctgaagacttgcttcaccttcattactga

SEQ ID NO: 18400 - DNA, 441 bp, Zea mays
  Clone ID: LIB189-004-Q1-E1-A5
acgcgtccgaccacgcgtccggaggacgtccgggtcggacggcgactcggcggcggacacgcacaggcgcgagaagcgccggctgtcgaaccgcgagtcggcgcggcggtcccggctccggaagcagcagcacctggacgagctggtgcaggaggtggcgcgcctgcaggccgacaacgcgcgcgtggcggcccgcgccgccgacatcgcgtcccagtacacccgcgtcgagcaggagaacaccgtgctccgggcccgcgccgccgagctcggcgaccgcctccgctccgtcaacgaggtgctccgcctcgtcgaggagttcagcggcgtcgccatggacatccaggaggagatgccggcggacgacccgctgctgcgtccctggcagctgccctacccggctgccgccatgcccatcggcgccccgcacatgctccacta

SEQ ID NO: 18401 - DNA, 447 bp, Zea mays
  unsure at all n locations
  Clone ID: LIB189-004-Q1-E1-A6
accacgcgtccgcccacgcgtccgcccacgcgtccggatggccagaaggatctccagccagtctagcaagcacgacgactaccgcggcgagtatcctcaagaggaggaggagcacaaggaggagttccggcctccgtctcctgccccgtcctacacggagaaggacgtgctctcgtcgatgctgagacggctcggtgagctggagggcagggtgcaggtgctcgagacgaagccgtccgagatgccgtttgagaaggaggagctgctcaacgcagccgtccgccgcgtggacgcgctggaagccgagctgatctccacgaagaaggccctttacgatgctctgatgcgacaggatgagctgctcgcgtacattgacaggcaggagctgatcaagttccgtaaaaagaagttctgcttctaagatctgnacatggagcagctggtcat

SEQ ID NO: 18402 - DNA, 430 bp, Zea mays
  Clone ID: LIB189-004-Q1-E1-A8
cggacgcgtgggcggacgcgtgggtatctttgagattgaagccgaagtggaggcagtaaaaggtgtcaccaagaatttgtgtccgcttaaaattgtattggacagagtggttttgacctcaaccggtgtgcttcttggcctgtggcaggttgaatctggtactgatcctgcagaaatccgctcaagattgagagaagctcttcctcgtgcacctcaaaagcaactgtatgaccctgttctgcttcacacctcgtttgcacgaattctgcgacatcccaggctccctaaagagcaaagtgcatcatcgtttgataatgtcaagttcttccatgagctagttgctcaaattaatgagaagatctgtggctttcaggcgacgatatcagagctatggtatgtcgaagagtacgatgttcttgcattggcactg

SEQ ID NO: 18403 - DNA, 71 bp, Zea mays
  Clone ID: LIB189-004-Q1-E1-B1
acgcgtgggccgccgcggaccgtctcggtcgccgaccacgtgtatgtagccgtccgcagcaggggctccag

SEQ ID NO: 18404 - DNA, 461 bp, Zea mays
  Clone ID: LIB189-004-Q1-E1-B2
ggtcgacattaccggggccacgcacgcgtccgcgccgaggaagacgaggaagagaactccgagcccttgccaccgccttcgctgttccagggggcagctcagcgtccttccatcacagcggcctcttagatgatcgtgaactcgatctagatctcaccaccgcctgtgaacgaagctgaatctggaaccctggagagtggagagtgactgggtgataaccgtgcagaaacccccgacgagtgacccacatcgccggcaggctcctcgccgcttgtgaactgaatcacggcacatgtaaaactgaatctggcagagcacacacgcgcctaagcctattagcgtctatagactttgcagggctatgtatagtagatatgtagattgagaccctgctgaacttgtacgtgcagtatgttcctagtcacttgtgtaacattactagtaatgcagtatccctcgtg

SEQ ID NO: 18405 - DNA, 312 bp, Zea mays
  Clone ID: LIB189-003-Q1-E1-H8
tagccggcggatccgatccgtgcgcgtgctgctgtgtgtgtgtcggtggagatggccacagcttacgctcccatggcgagccaggtgatgaagagcagcctcgtcgtgcactcgaggccgaggggcctgtcaggcgctgctgcgctcacaaggcggcccggcgggttcaacgttcaaggcaatcaaccccaaaaaggaacgttacaagttgttcaacccaacaaccgggaaccctttcatcggcagcctgaaaacgccggtcacttcaagcccgctcgtggcttggtacctctccaacctcccggcctaccg

SEQ ID NO: 18406 - DNA, 395 bp, Zea mays
  Clone ID: LIB189-003-Q1-E1-G11
acggacgcgtgagtgccaaggttgatagaaagaggacaccctggctcattgtgttgttgcacgtaccatggtacaatagcaattgggctcatcagggtgaaggcgacagtatgatggcttcaatggagcctttgctgtacactgctcatgtggatatggtaatagcaggtcatgtccatgcttatgaacgtgcggagcgagtctacaattccagacctgatccttgtggcgctgtccacataactatcggcgacggtgggaaccgtgaaggcttggcccgcaggttacgttaaccgaagccagcgtggtcggtcttcagggaagcgagctttgggcacggcgagctaaagatcgtgaactccaaccatgcccactggacctggcacagaaacgac

SEQ ID NO: 18407 - DNA, 366 bp, Zea mays
  Clone ID: LIB189-003-Q1-E1-G12
acccacgcgtccacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaacgatgaggggatgccaatttaccagaggcctttcatgaaggggaagctgtacatccatttcacggtggagttccccgactcgctggcaccagagc

SEQ ID NO: 18408 - DNA, 382 bp, Zea mays
  Clone ID: LIB189-003-Q1-E1-G3
acccacgcgtccggttccacctgcataccttgatgagctctcactacttcaggaccgcatagcaccattttcaaacgatgttgcttttaatattatagagaaagagcttgggcttccactggatatggttttctctgagataacaccagagcctgttgctgctgcatctcttgggcaggtttaccaggctaggctccgctccagtgggaagattgttgctgtcaaagtacaaagacctggagttcaagcagcaatttcattagacatatatatcttgaggttcctagctaatcttgcaaggaaggctgccaagttgaacacagaccttccagctgtgcttgacgaatgggcatcaagcctattccgggagatggattataga

SEQ ID NO: 18409 - DNA, 338 bp, Zea mays
  Clone ID: LIB189-003-Q1-E1-G4
acgcgtccactttactcctatccactgcggcctggacgcgtgcgagagacttgacaaagcagcagcagggatggcgcctctgaagctgtacgggatgccgctgtcccccaacgtggtgcgcgtggccaccgtgctcaacgagaagggcctccacttcgagatcgtccccgtcgacctcaccaccggcgcccacaagcagcccgacttcctcaccctcaaccctttcggccagatcccggctctcgtcgacggagacgaagtcctcttcgagtcccgcgcgatcaaccggtacatcgccagcaagtacgcgtcggatggcacggacctgctccccgcga

SEQ ID NO: 18410 - DNA, 405 bp, Zea mays
  Clone ID: LIB189-003-Q1-E1-H1
gggccgagccacgcgtccagctgacgcgtcacctggctgctctgggcctacctcctcgccatgttcgtcctcatcctcgtcctcttctgcttcaccgtcttcgccttcgtcgtcaccaacaggggcgccggcgaggccgtctccggccgcggatacaaggagtaccgcctcggggactactccaactggctgcagaagcgcgtcgagaacaccaggaactgggaccggatcaggagctgcctccaggactccaaggtctgcaagagcctgcaggacaagaacgagaccgtcgcccagttcatgagttccagcctctcccccatcgagtctggctgctgcaagccccccaccagctgcggctacacctacgtcggcggcacggactggaccccggtgaccaacaac

SEQ ID NO: 18411 - DNA, 383 bp, Zea mays
  Clone ID: LIB189-003-Q1-E1-H10
attcacgggtccacaaaccttcctatgatagcttgttgaggtatacaaacaagtccgaattggggatccgttggagaaaggcaccttactgggaccactgcacactcctgcttcaaaagagaactttttgaaaggcattcagactatcaaatctcagggagggaaaatcctttttggaggatctgccattgaatcagaaagaaactttgtgcaccaacaattgtgggaattacaccttctgcaccagttgtgaaagaagaactctttggtcctgtcctttatgctgtgaaatttcagaccttgaaggaagcaattgaaatcaataactctgttcctcaaggattgagcagttctatatttacaaagaggccaagatatatttt

SEQ ID NO: 18412 - DNA, 83 bp, Zea mays
  Clone ID: LIB189-003-Q1-E1-H11
aggaacccttaggtccggaattcacaaaacaaaaaaaaaaaacctaccttcaacaaaaggaaaaaccaaaaaacctgacaaaa

SEQ ID NO: 18413 - DNA, 269 bp, Zea mays
  Clone ID: LIB189-003-Q1-E1-H12
cccactcgtccggtgaaacatgagaatcttgtcaagtttattggagcttgcaaagaaccattgatggtgatcgttagtgagctactaccagggatgtcactgaaaagttacctgcatagcatacggcctagccaactagatacacacactgcaataagctatgcactggacatagctcatgcaatggactgtttacatgccaatggcataatacatagagacctgaaacctgataatttattgcttacagcaaatcgcaagaagctgaa

SEQ ID NO: 18414 - DNA, 363 bp, Zea mays
  Clone ID: LIB189-003-Q1-E1-H2
gcgtccgcccaagcgtccgcccacgcgtccgcacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaag

SEQ ID NO: 18415 - DNA, 399 bp, Zea mays
  Clone ID: LIB189-003-Q1-E1-H3
cgggccggcccacgcgtccaccaccacttcctgcgcttcgctctccccagggaccacctagacttaatgtactcgtttgtggaatatatttgttattggtgccttcgtcacttgctgttttgcttccgcactggtaacttggggggatctagggtttcaggaggagagtggagatcatcccgatgatgatgcgaggtggaaggctcacgggtttgacctctcaggttctgaggtgcttcagcacggagatatttgtcagcagattatcattctatacgacagaggaagaattcaaagatattttttcaccatttggcaccgtagaggaagctcgacttatgagagaccaccaaactggaaggatgaagggatttggttttgtcaaatattcatcgcaag

SEQ ID NO: 18416 - DNA, 432 bp, Zea mays
  unsure at all n locations
  Clone ID: LIB189-003-Q1-E1-H4
gtccagcagctcggacttacccggccggttcgatggctccggcggcaaggccaaggggcccctgctgatccctttcgggatggggcggcccaattgccccggggaaacgctcgcgctgcggaccgtcgggctggtgctcgcaacgctgctcaattgcttcgactgggacacggttgatggagctcaggtttgacatgaagctancggcgggctgaccatgccccgggccgtcccgttggaggccatgtgcangccgcgtacagctatgcgtggtgttcttaagaggctctgaaaacctcatggatcgaattgctggcatcgtctgaagggtgtatgacgtagcttccgagttccgagcatatatattcacttgccttgtaacaatttaattttcgccgattgtatggaatggattttctttttttttcttgg

SEQ ID NO: 18417 - DNA, 299 bp, Zea mays
  Clone ID: LIB189-003-Q1-E1-H5
aggttgtgctttcaagttgataaattgtggcaacaggagattttgctttacctaggcaatatattgagaagctactcttactcatccaccatgaataatctttgctgcagtggagcttcatgtcggcgaacaatgcaaacgttgtacttctttcatgcgattgagtagttgatgttttacttctgttgccaccaacagttgaacgctgtacttgcatattgataagatctccgtgcttcctttctagtttgcgttgttactgatgaatttagcaaacgttttattggtggttttatttg

SEQ ID NO: 18418 - DNA, 433 bp, Zea mays
  Clone ID: LIB189-003-Q1-E1-H6
cccacgcgtccgccttactgagctttcattcaactggactggcttcatcaatgccatgatatcaaacatctcattcacttacaggagcatttattccaagaaagctatgactgacatggatagcaccaacgtgtatgcttacatctcaataatcgctctaattgtttgcattccacctgcattgatctttgaagggcccaagctaatgcagcatggatttagtgatgccattgcaaaagtaggtttgacaaagtttgtcagtgacctattcttggttggactgttctaccatctgtataaccagattgctacaaacaccttggagcgagtggctcctctgacacatgctgtcggcaatgtgttgaaacgtgtttttggcaaccgtttccccaatcattgtttttggcaacaaaattagcacacaaactggaat

SEQ ID NO: 18419 - DNA, 380 bp, Zea mays
  Clone ID: LIB189-003-Q1-E1-H7
gacttctcgcttgcctgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgact

SEQ ID NO: 18420 - DNA, 378 bp, Zea mays
  Clone ID: LIB189-003-Q1-E1-G10
cccacgcgtccgcccacgcgtccgcggacgcgtgggaccgtatccgagcaggacagcaggttgttcagcgatcactcgagcggtcgagccctcgcgccgcggagagtgtctccagtctcaagtacagcggaggatggagagcggcttgcttgacaccgccgcggctgccggtctctgcccggtggcgggccggggccgccgcgtccggagcacgggcacggcgaggtgcttcctcagctgctcctgcgcttccagagactgcagggtgaaccgcgtcctactcccaatctcatcagcccggatgctgagcgggggtgcggtcggcggcgcgcaagaggctcttcaggagcgacccggccgagctgctgggcgtcgcca

SEQ ID NO: 18421 - DNA, 381 bp, Zea mays
  Clone ID: LIB189-003-Q1-E1-F1
acccacgcgtccgcggcgtccgtggacttcagcgccggtgggagcccgctgctgcccccgaccgtgaacgccgcgccgctgcacgcgcacttcgaggccgtcgccgccgacacggtcggcgtgggcgccgtccgtggcgccatggagccctgcatgggcagcgaggacttcgcgtccttctcggcggccgtccccgcctcgcacttctacttcgtcggcatagggaacgaggcgatcggggccgtgcacgccgcgcactcgccgcacttcctcgtcgacgatggtgcgctcccgtacggcgccgcgatgcacgccaacctcgccatcgagtacttgcggaaccacgcgatagccaataggtccgttggtccccacgacgag

SEQ ID NO: 18422 - DNA, 402 bp, Zea mays
  Clone ID: LIB189-003-Q1-E1-F11
accacgcgtccgcccacgcgtccgcccacgcgtccggcaatcgcgctgcactcgcaggtcatcaccgagttctgcaagaccatcggcgccgactccaagcagcggcagggcctcatccgcctcgccaagaagaacggagagaagctcggattccttgcctgagacgaccatgttctacgcacatatataagtatataatctataagtactacatcatcaagtagtggcggacaatgataattatattgataccttcttccttgctcccatcgagtcctctatcaagtggtagccagtacatgtcatgtgatgatgcttcaattcagcttccgatgctcggctgtccatcatcagctagctgcatgcttttgttttgcttcattcctgcagagattactattg

SEQ ID NO: 18423 - DNA, 431 bp, Zea mays
  Clone ID: LIB189-003-Q1-E1-F2
acccacgcgtccgattgtactgaatactctgaatacggcaaggttcactgtggctgtggattctttcatcaggactgggtatgtaccctcattgaaggatggaaactcacaagagacaatatttaatccaccttggcgacattcgcccgtcgcaataggatcaagatttggggaggcgtttcaagaacctgcttcgtttattgctataaaacctttgttcgaggatgagaggtatattgttacatataacccgacaaaggacaaggtctatgctttgctcaaggaccaagcaaagcctgatgacattctcaaggccgcttttcatgcacatgtgctactgcattttatcaatgctacacatgctaaccggaatgcaccggaaccccccaacttcaatccggtcacaccagtataacccactgaacatggac

SEQ ID NO: 18424 - DNA, 345 bp, Zea mays
  Clone ID: LIB189-003-Q1-E1-F4
acccaagcgtccgcggatgcgtaggactctgcgtacgtcaacgtgcagtgtgagtttgggttctttgatcaggaccgggtatgtaccctcattgatggatggacactcacagtatacaatatttaatcgaccttggcgacattcgcccgtcgcaatatgatcaagatttgaggacgcgtttcaagaacgtgcttcgtttactgctataaaacctttgttctcggatcagaggtatattgttacatataacccgacaaacgacaacgtctatgctttgctcacggaccactcagtgcttgatgacattcgcaagtgtacttttcatgcacatgtgctactgcattt

SEQ ID NO: 18425 - DNA, 436 bp, Zea mays
  Clone ID: LIB189-003-Q1-E1-F6
agcggacgcgtgggcggacgcgtgggtgcagtacgtgctggaccaccccgccgcgctgtggttcgtcggccccacgttcgccgcgctcactggcctcgtcttcaaagaaggtctctgctatgggaaactggaagctggcatcttgacgtttcttatccctgggcttcttcttgggcatttgtctggtttaatggataacagcacaaaggcaggtcttttaggactgtggatgcttcttttcacaatctttgccgctagaaaattccagcagcccatcaaggatgacgtcggagacaaatctgttttcatgttcaacgctctccctgaagaggaaaagaaggcgtggatccagaaactcgagaggcaaaaggggcaagaattgtttgagtatgaaaagattaccttgtcttggtgcagccaatagttcgtccgtgaa

SEQ ID NO: 18426 - DNA, 376 bp, Zea mays
  Clone ID: LIB189-003-Q1-E1-F7
acccacgcgtccgaaaaaaaaaaaaaaaaaaaaaaaaaaaaaaaaaaaaaaaaaaaaaaaaaaaaaaaaaagaaaaaaaaaaaaaaagataaaaaaaaaaaaaaaaaaagaaagaaaaaaaaaaaaaacaaaaaaaaaaaaaaaaaaaaaaaagggggggccccccaaagggttcaagccttatttcccgttgcaggcgattttaaaccccttcaaaggtttccccaaatttcatttcaggggccttctttttaaaagttcttaaggggaaaaacctgggctttacccaatttatcccctttgcaacaaatccccttttccccagtgggcttaatcctaaaaaggccccaacgttttgcctttccaaaaatttgcc

SEQ ID NO: 18427 - DNA, 380 bp, Zea mays
  Clone ID: LIB189-003-Q1-E1-D12
cccacgcgtccgcccacgcgtccgcccacgcgtccgcccacgcgtccgcacgaacgcaggctcccgagaacagcagcccccattggatttggaagcttctccatgggacaccgagcctcgtagacgaagcagaggggaccagagaaaccgaggagcaagaagcagggagccatggcgttcctcctacccaagctcacaacgccgtcctgcaagttgcccccgagccccctcctcaagccccagctcgtcccgccgggccacggcggcggcaagattcaaggctcctccgtctccggctctggcgcggcgcaggtcgcgggcccgggccacctcagcctcctgctcctgctcagcgcctcgcagcaggcggccggccccgc

SEQ ID NO: 18428 - DNA, 361 bp, Zea mays
  Clone ID: LIB189-003-Q1-E1-D2
aaggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttgggtgct

SEQ ID NO: 18429 - DNA, 450 bp, Zea mays
  Clone ID: LIB189-003-Q1-E1-D4
ccggtcggccacgcgtccacccacgcgtccgcggacgcgtgggcggacgcgtgggcgactgcgagcgcgtgcgcgtcgacggcctcttcgtcagctcgccggcgtccagccccaacacggacggcgtccacgtcgagaacaccaagtccgtccagatcctcaactctaggatctacaacggcgacgactgcgtctccatcggcgccggatgctccgatgtccacgtcgagaacataacatgcggccacggccatggaattaggtacctgtcagtctgtcactcactcactcaccaacgtgcttccatggcgcgcggtaccgtttgtagtgaacctgacgcggcgagctgctgctgtcaccctcgcagcatcggcagcctgggtgtccacaacacccacgcctgcgtgttcaaagttcacggtccggaacgtgcggatactcgactccgac

SEQ ID NO: 18430 - DNA, 297 bp, Zea mays
  Clone ID: LIB189-003-Q1-E1-D8
acccacgagtcaacccttccgtcagctcttttctgctactgcctctggtccaaacctttctacaccgccttaacgccgtctatcgaatccgtaccgctgggaaggatcactggggagcggagccaggctgccgacccactgttttgtcgacccgatggcagcggaccagggagactggcggcggttgaggcccggttttgggatgtagaagatctgcgatgtctgcgagatcgtaccggcggttctcttcagtgcggtggatcaggctgtgttttgccggctttgcgaccattaggt

SEQ ID NO: 18431 - DNA, 417 bp, Zea mays
  Clone ID: LIB189-003-Q1-E1-E10
gggagcgtaagctttttggcagtggtggttctggaatgcagcagcaacacctgatgcagatgaaccagaacatgatggggggctacacctctcctgccgccgtgaccaccgatctcatccagcagtacctggacgagaacaagcagctgatcctggccatcctcgacaaccagaacaatggcaaggcggaggagtgcgaacggcaccaagctaagctccagcacaacctcatgtacctggccgccatcgctgacagccagccgccacagaccgcgccactatcacagtacccgtccaacctgatgatgcaaccgggccctcggtacatgccaccgcagtccgggcagatgatgaacccgcagtcgctgatggccgcgccgtcctccatgatgtacgcgcaaccgttcctgtcgccgc

SEQ ID NO: 18432 - DNA, 422 bp, Zea mays
  Clone ID: LIB189-003-Q1-E1-E11
tcgacgactaagttttcggtgtaacataatttagtccccttttttcatccgtgacatcacgtctacggattttaattgaattgttctctagtcgagtgttcgactagcgaacggaattcgtctaaattcaactaaatcaaacgtcgactaaaatatcgaatccgatatcgtctagtttaatccgtctacatctcgctcccgtgacgatgctgacatcgtctccggggggattccgattgcgatgccgcatccggttagcacagtttaaaatttacttatttctaaaagtgtcgggcctagtgccaatttaaaaataaacgattaaggacagactgaaattgtcacctaaatattttgcttggtttgagcactctctataaattcggtaaatacactacttggggtaagctattagataaacg

SEQ ID NO: 18433 - DNA, 363 bp, Zea mays
  Clone ID: LIB189-003-Q1-E1-E12
cccacgcgtccgcccacgcgtccgcgttgatcgagcccacgtcggggaacatgggcatcgggctggcgttcatggcggcgctcaaggggtacgagctcgtgctcaccatgccgtcctacaccagcctggagaggagggtgacgatgcgggcgttcggcgccaacctggtgctgaccgacccggccaaagggatgggcgggacggtgaggaaggcgacggagctgtacgagagacatcccagcgcgcacatgctccagcagttccagaaccctgccaacgtcaaggtgcactacgacacgaccggaacgggaaatctggaaggacacgcttgggcaggtcgatatcttcgtcatggggatcggg

SEQ ID NO: 18434 - DNA, 378 bp, Zea mays
  Clone ID: LIB189-003-Q1-E1-E2
gggccggcccacgcgtccacgtaaagatagtggaggtggggcctcgggacggcctgcagaacgagaagggcaacgtcccggcgtccgtgaagatccagctgatacacaagctggtcggcgcgggcctgtcggttgtcgaggccaccagcttcgtctccccaaagtgggtgccgcagctagccgacgcagaggaggtgctgaagggtataaagcaggagccaagcgtgcggtacccggtgctaacacctaacctcagagggttcgaggctgccatcgcagccggcgcgaaggaaatcgcggtcttcgcgtccgcgtctgaatccttctccagttccaacatcaactgcaccatcgaggaaagccttgctcggtaccgcg

SEQ ID NO: 18435 - DNA, 384 bp, Zea mays
  Clone ID: LIB189-003-Q1-E1-E3
aggccagtgctgcagcaaaaaggtggaatgacttcgagtatgcgtttcgtgagatgttattgaatgggtaccatttcgatgagcgaagacaccttcggatggtacttgacgcttttaggcatgggaaggaacagctgttggatgatctatggcactacctgtgccgtcacagccgtgtcccgccctcccctgtcataatggaaagattctgcctaaaactgatgcagggagatacactggcggcgatctcctgcgtcagcagcttccatgagggcaagatatgcaacgtctcctccatgtcatggctcaatctgctgagccgcaatgcagataggctgaaggaggagcatgttaccaagttagctcatgaactcaacagcctca

SEQ ID NO: 18436 - DNA, 131 bp, Zea mays
  Clone ID: LIB189-003-Q1-E1-E4
cacgcgtccagaaaaaaaaaaaaaaaaaaaagaaaaaaaaaaataaaaataaaagtatcaaaagaatatatataaatgggtaaaatttacaatgagcgaagaaaccttaaaaatggtaattggagcgttta

SEQ ID NO: 18437 - DNA, 414 bp, Zea mays
  Clone ID: LIB189-003-Q1-E1-E5
acccacgcgtccgcccatgccgtgacagcacccagtacagcccctccctggcgatcgcccccgcccccagccatggacaccgtcggcctcgacttcctctggctgcggcatccgtcctgctccccgctccatcccttgctcctctccatagacgcccagaccgatgcctagctctcccatggccgccctggatctccatggtcgagtttttcccctgcaggatcccccccaatggcgcctggtctttttcccttggttgaaaacacctctgcacttaaccccctctgttgatggtcgacgtctctccatccatggtacctaggtctccatcctcatgcccctgcagcttgttctcaagccgccaaccatggtgcgtcgtccgcctcggtgaagacttgtcatttcctttgccaa

SEQ ID NO: 18438 - DNA, 388 bp, Zea mays
  Clone ID: LIB189-003-Q1-E1-B5
aaaaaaaaaaaaaaaaaaaaaaaaaaaaaaaaaaaaaaaaaaaaaaaaaaaaaggaaaaaaaacaaaaagaataaaaacttacatacacctacaagctaaaatccttcctcttccaaaatggggcggccgctcaaatggttgcaccctcatttacccttgtttcgaaggtgaaaccccttcaagtttgccacctaaatccatttccagggcactcccttttacaccatctggcctgggaaccccttggctttcaccaatttaacccccttgcagtaaacccccctttccccagatggggaaacaccaaataggcccgcactattcccccttccaatcattgtcacacccaaaatggcaactggaactccccctgtactagcgcattaa

SEQ ID NO: 18439 - DNA, 357 bp, Zea mays
  Clone ID: LIB189-003-Q1-E1-B6
gttccccatgtcgctcgtggcaaaaacacacctcagagaccgtgagctcaggtgctgctacaaggccaccgtggacggcttcagtgctacggacttccaccggcggtgcgacttcaagggcccctgcgtcgtcgttggctacaccgacggtggcttccgtttcggcgggttcagcccggaggggtaccgaagcacggacgactactacgacacgctggacgcgttcctcttctactgggcggaatctacggaggtctcggcgccgcccgtggtgctgcccaaggtgggcgggagctgcgcggcgctgttcgactactcccgcggcgggccacagttcggcgccgacagcctgctcat

SEQ ID NO: 18440 - DNA, 193 bp, Zea mays
  Clone ID: LIB189-003-Q1-E1-B7
cgacccacgcgtcagcccacgcgtccgaaaaaaaaaaaaaaaaaaaaaaaaaaaaaaataaaaaaaaaaaaaaaaaaaaaaaaaaaaataaaaagaaaaaagtgaaaaaagacttccaacggcagtgactacttcaagggccacagcgtcttaagttggctacgccggcggtgccttccgtttcggctggttc

SEQ ID NO: 18441 - DNA, 391 bp, Zea mays
  unsure at all n locations
  Clone ID: LIB189-003-Q1-E1-B8
ctgctacctgtgctgatgttactttccggaacatgtgggcagaatttgaatgggaaaataaggtggcagtgaatactgtgattcaggatgagaaggaattcttgaatcacattatcaaatcaacaaacatgaagtgtctgacaccaccgtctgcactagacggagaatgtggtttccttgctgctaatctttatgcaaagagtgtgtttggtgaggatgctttggtgaacatcagcattgagaagcaacatgatggcaagctcagtggttacatccgaataaggagcaagacccagggaattgcactcagcttaggtgacaagatttacctcaagcagaagggtggcagttaactgtgacaagtgctgcagttgtancaacaattttcccc

SEQ ID NO: 18442 - DNA, 427 bp, Zea mays
  Clone ID: LIB189-003-Q1-E1-C1
agcaggtgtcttggcctcttgatctaattattaatacagaggcactgaagaagtataatcaggtaatgggattcttactgaaggtcaaacgagcaaagttcgttttggatgaaacacgaaagtggatgtggaaggccagaggcaggaccacgcacaatttcaaacaacacctaatagtggcacagaagctcctccattttgtcgatgcatttcatcagtatgtcatggaccgagtttatcatagtgcatggactgagctttgtgatggcatgacggctgctaccacactggatgaggtcatggaagttcacgaggcatatctctcttctattcaacgacaatgctttgtggcctctgataagctgtgggccctcattggcagtcgagttaagactattcttggattggcactggacttccacaatgt

SEQ ID NO: 18443 - DNA, 396 bp, Zea mays
  Clone ID: LIB189-003-Q1-E1-C10
ctgcacaagctgtgcagtccgaataaaatcaggacagataaggcagcctgaagcacttgggatatctgcagaactaaaagataagggctatgctttgttgtgtgttggtttcccatctggcgatgttgaagtcgagactcaagatgaagatgaggtatattggctccaatcaggacagataaggcagcctgaagcacttgggatatctgcagaactaaaagataagggctatgctttgttgtgtgttggtttcccatctggcgatgttgaagtcgagactcaagatgaagatgaggtatattggctccaattcgggagatactttgcacgagggccagtggaaagagatgattacgcgctagaacttgcaatgggagacgaatgagctgtgcctaa

SEQ ID NO: 18444 - DNA, 336 bp, Zea mays
  Clone ID: LIB189-003-Q1-E1-C11
atcccgggcacgacccacgccgtccgcgtgacgcgttgggaacaaataaaaaaaaaaaaaaaaataaaataaaaaaaaaaaaaaaaaaataaaaaaaaaaaaaaaaaaaaacaaaaaagcaaaaaaaattataaaaattttggattcaaaacagaacaaaaaaaagggcgccactcataaatggttttaactttatttaaggtggcggcccccttaagggttcaccccttatttccccttgatttccatctccgggcccctcttttggttccccccaacttgtgtatacggggctttttttaaaattttccccttgggaaaaccctctccttttcc

SEQ ID NO: 18445 - DNA, 398 bp, Zea mays
  unsure at all n locations
  Clone ID: LIB189-003-Q1-E1-C12
ccgcattggcacacccgtacttcaaccgtgaagggctccttggcctctccgtcatgcaaaacgtacggctgcaactgttccgcgcaacccagaaggactacagtgaagcagcgcggtgggttatcggcctcatggcaaggtcaggaactgaagatgtgggaggctttacagaagcacagcttcaagagcttagggaaataaaaccaaagaaaagcagcacccagcggaacgcgcttgcctccgtgctgcgcctgcagaggaagatcatgagaacgatcaaggagagcatggacgagctcaacagccagcgcaaaagcatctggtggagccggtggatacccagggaggagtangccggccgcaggcgcacatgtacatcgtccacttctgtatgaaac

SEQ ID NO: 18446 - DNA, 324 bp, Zea mays
  Clone ID: LIB189-003-Q1-E1-C2
acggacgcgtgggcggacgcgtgggtcagaagagtaaaacataatgctggagtgagcttccaacaaggactaatcaccatgcgcatgctgcgagcaatgaagggtttttcctaccatacatgtttaaatgcaatgcactgcaacttgctggcagcaaagagtatgtgctcggttagcttcttgctcatctgactgagggtactgctgattggaatggcttttggatctataactagagtatccaggtcatttgtacttaggcaagtgtgtatactactctatgctggattatcgaaatgggggatggtttcttccctacgttgt

SEQ ID NO: 18447 - DNA, 365 bp, Zea mays
  Clone ID: LIB189-003-Q1-E1-C3
gcactgcagaacagtctgcagaaatattgagaagtcctgtacgagctccactgggaattccattttgttcagcaagtgtgggtggtgcaaggaaatttccacctccactaattgttgcaggtgaggatcacttcaacagctgttctgagcatgatgggctgttcagcactgaactgctgcatagacggatggagaaaacagcagaaacgctgggtttagctggtatcacaatggatagtgctgagcttctgaatattgctctggacaagtacatgaaaaacctgattaggtcatctgttgagttagtaggaggtagtgttcagagggatgcaaggaaagggacaccaacctacaagcagcaagcc

SEQ ID NO: 18448 - DNA, 372 bp, Zea mays
  Clone ID: LIB189-003-Q1-E1-C4
agagatttgaaaaggaggataagaaaggtatgtttggtgtttagtgctcatagctcaggacatgcttctaatatcgcaaaagctttttcatgcatgcttgtaccatgggcatttccccaatcttgcaggttcctggtgttccaatcatgtacatcacaagacataggtattcgatagaacggctccctgaggccacaattggtggagcaccaagaatctgatcggtgcagacatgagatgttctgggatgtaatactatggcggtacttgtccatctgaccaagtcactatttcatgtttcagtccacgacaaggactaagataagaacgctgctttctaggttgagcttactgtaactactaagaaatttt

SEQ ID NO: 18449 - DNA, 254 bp, Zea mays
  Clone ID: LIB189-003-Q1-E1-C5
attaaatccggcacgagacggacaggatcgacggaggcggcatcgccgtcgtgaagccgccaggatgttcacacgaatcccaggacgatgagacgcaggctaggatcgagcgattatggagaatggctggtgctgtctacatgatcctacttactggatcccggtattacgtttatatgccttgtccttgtcctcctcagctcgactctcttgctttagcgccaggcctggtaggcttagttgtacctgcttca

SEQ ID NO: 18450 - DNA, 348 bp, Zea mays
  Clone ID: LIB189-003-Q1-E1-C6
aggagctggagcgcggcaccggggggttcgacgacgcgcacctcgtcaacggcagcgtgtacaaggccaacatcgacggcctggtgttcgccgtgaagaagatgaagtgggacgcctgcgaagagctcaagatcctgcaaaaggttaaccacagcaacctggtgaagctggaggggttctgcatcgactcggcgacgggcgactgctacctggtgtacgaatacgtggagaacggatcgcttgacctgtggctgctggaccgcgaccacgcgcggcgcctgaactggcgcgcgcgcctccacatcgcgctggacctcgcccacggcctgcagtacatccacgagcaca

SEQ ID NO: 18451 - DNA, 390 bp, Zea mays
  Clone ID: LIB189-003-Q1-E1-C7
agagtttttagtacagaccacagttgttccttatggcacatctgatgaagaactcgttcctgccgttttctccaaagaaactggcagatacatcgaggaaagcaaattgagagttgttcttgttagttcataccaatccctcgaagagcaacccactaatggaattcatgacactgagccagctgttgaagttcctttactgaaagagatgccaaatttagggagcgaagtaccagatgttgcaaaagaaattcctgcccctctggtacaaggtccagcaattgtgaccggaataccttcacctgtcaaagaggttccaggcctgagagaaattcctgtgccactgaacgaagcaccaactttattggcagaatttccttcccctcaaaa

SEQ ID NO: 18452 - DNA, 136 bp, Zea mays
  Clone ID: LIB189-003-Q1-E1-C8
cagggagcgctcagcttgatctgcgaggtgtgtcgtcctaggtggttataagatatgcgctgtatttgcatctatcagaacttgtgtacttcgtatattacgaacttgagaactgtatggatgtgtgcattgtgcc

SEQ ID NO: 18453 - DNA, 408 bp, Zea mays
  Clone ID: LIB189-003-Q1-E1-C9
accacgcgtccagacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaacaagatctgtgatggcatcctcaagcctctcgaatctc

SEQ ID NO: 18454 - DNA, 437 bp, Zea mays
  Clone ID: LIB189-003-Q1-E1-B4
acggacgcgtgggcggacgcgtgggcggacgcgtgggccgccgcggagcgtcccggtcgccgacgacgtgtacgtggcggtcggcagcggcggctccagcatggcggctctgtcctgggcgctgcgccgcctcgccaagccgcgcagcttcgtctacctcgtccacgtcttccccgtcgtcaccagcatacccaccccatgaatgatgcctaagagccaagcaagcccggagcagatcgaaacgtacctgaaccaagagagatcgaagaggcgagacatgctgcagaaaatcttggaccagtgccgcgagattcaggttaccgttgacgtctacctcatcgaaagtgatcagattgctaacgcgatcatcgagcttgttcctgttcctccgcataagtcaacgggtactaggcgtctcaaagtcaaatgtgcggaag

SEQ ID NO: 18455 - DNA, 409 bp, Zea mays
  Clone ID: LIB189-003-Q1-E1-D1
acggacgcgtgggttttttttgaatcgaaagcatacatcacgttatatatatatcacggcttatgaagcaggcgcgagcgccctactcggcctcctcgacggcggcctccacccggagcagcacgaagccgacggcgacgccgacgagcacgaggccgctcatggtggcggcgatcctgaagatctcggcggcggcgttcatctgggcgccgaacgccccgccgcgccgcttcctgcccgcggggctgagcgacgccacgaccttggcgaaggagtagtcggcggtcttgcgcaccccgagcatggtcaccttgttgagccccttgaggccgctgtaggcgttcatgccctccacgtacgtgacgccggcggcgggcctcctcttggctgccggggccgctaacgacgg

SEQ ID NO: 18456 - DNA, 365 bp, Zea mays
  unsure at all n locations
  Clone ID: LIB189-003-Q1-E1-D10
gaaaagagctagatataagaagatgattcgccggcatatggacttccgaatgcttcactctaagatcaagagtggcgcaatctcttgcaccaaggagcttctgagagatgtgctcattttcatcaataatgtaataacattctatccgaaggctacattggagcacatggctgcggttgagcttcgtgagtctgcatgcaaaactgtgaagcagagtgcaagcttgttcttgaaaagccatggagagaccggaacagctggtgcccctgtagtaaagaatactcgagtcctgcagcctcgatgcnctggccccggtgatgcaaggccaagcaaggttttcttcaaggacgctactgccaaggaaa

SEQ ID NO: 18457 - DNA, 340 bp, Zea mays
  Clone ID: LIB189-002-Q1-E1-H8
agcccacgcgtccgggccccttgaacatgcgagtgccatagatctggcgaagcaaacccagacagagggaaggacacagtaagatcagtcaagcacgaccatcgatatactaccatggtattgttgtgaagtaaagcgaggcaccagttttgctggtggattttttttctctctcacgtgaataaagctcaaaacagtaaacagagcagtgctttcatatcagcccatattttttttctaatattgttgagtggtattgatggcaattgggaattgtatgatttacttgccttatgaataaagcttgaaagaaacaaaataaagattagtattttttttc

SEQ ID NO: 18458 - DNA, 418 bp, Zea mays
  Clone ID: LIB189-003-Q1-E1-A1
tggacagcgctgcgccgcggccagctcaaggcgcaccagtgggaggaggtggctgccaaggttgcctcacgatgcaccgccacccctggggtcctcgcccaccgcagcacgggcacccagtgccgctacacgctcgaaaagctccgcaagcgctatcgcaccgagggcgcccgtcccgtcacctcgctctggccctacttccgccgcatggatctcctcgaactgaggccactcgccgtcgcgtcttccgcttacccggccgcgactggttcaccgcctgacgccgacggcgaccaacaaggataggaggaatactacgaggtggaggaacacgaagcggaataataagacatgcacgacgcaaacgagcaggatgaaaaactcccccaacccaagaacaacacccggagcatcaacg

SEQ ID NO: 18459 - DNA, 357 bp, Zea mays
  Clone ID: LIB189-003-Q1-E1-A10
gaccgtgcgtgaggcgtgagtccgtgaccattcccgtcggccgtcccaaaagaagcggaaatttacaacccagtccaccacgggccacacaatccccaaatctaacccctccgacggcgatggggatctcgagcatgccggagccgcgggacagcctgctggggtacctggtgtacaacacggtgatctcgatcgcggcgctggcggggctgggtgcgggcggcgctggtgttcctggacctgcatgccgcgctgccgcccggggacgacggcggggaccgactggcggcgtcggcgcccggcctggcggagcggttcctcagggccttccggccggcgctgtacgacgtgctggcg

SEQ ID NO: 18460 - DNA, 397 bp, Zea mays
  Clone ID: LIB189-003-Q1-E1-A12
ggctgcagaggtcggcgcagacattcaggaggtcgggctcgtcggggctggtctgggacgagcgcttcatcaccgagggcgccggcgcggcggcgccacgccagcagccggagctgcggcactcgaggagcgtcggcagcgtcgccatgctgctgctcggccgcgaggcagatcgcgacgacaagaggaagctgacgctggccaagccgaacctgaaagggccaccacaagaagcaggaggagctggtgcctggcaggaaggcgtttcggaccagggacgtagccccggccgccgagccaccgtcgccgagggtgctcgccatctgctgcgcgccctgctccatcttccgggatgccggcgccggtggctcgtcgtctctggcgcggcgggccaaga

SEQ ID NO: 18461 - DNA, 270 bp, Zea mays
  Clone ID: LIB189-003-Q1-E1-A2
acgcatgtaatcttgtagtaatcatgtatacggaaaatatgcatttcaattcaaccatagggtaggcctagatccggaaattttgcaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaacaaaaaaaaaaaaaaaacaaaaaaaaaaaaaaaaaggacgacaacaaaaaggagtataaacaaaaagaaccctcgaaaaaagaccagaaaga

SEQ ID NO: 18462 - DNA, 383 bp, Zea mays
  Clone ID: LIB189-003-Q1-E1-A3
tggtggccacagtttcctgtcttggtttacttcaaggagacccaaacgaagcccgaaggacagatccacttcttccctgtgatattcgatggtcgacaattgtacgatgtgatggtggagcgtgctgggccctcgaagacgagtggccctaaatagttgcagctgatcttcctaccgtcgttttgctccctcgggctccctcacatttaaattgtaaaaatggtaaaattatatacaaacggggttcgattccaaccacggttcttagctttaaacccatcttcatacgtacctaaccaacaaaaacacacatctatgtgttttatattttatattttgtatttaaacataaatataaatataaatcgtaacaatatatatat

SEQ ID NO: 18463 - DNA, 380 bp, Zea mays
  unsure at all n locations
  Clone ID: LIB189-003-Q1-E1-A4
ggaacttgatgcatgtgtgaacagagagggggttctcgtgaaatgtgaagcatacggtgaagtccaagtaaactgcagcctcccaggtgtgccagagctgaccatgtcctttgctaaccctgcaattatcaatgatgttaccttccacccctgcgtccgattcaggccttgggaatcaaatcagatcctatcatttgttcctcccgacgggcagttcaagctcatgagttacagggttcagaaactgaagaagacaccgatctatgtgaaaccacaattaacatcagattccgggaactgccgtgttagcgtgatggtcgggattcgaaatgatcctgngaaacctattgattcgataacagtgcagttccagttgcccc

SEQ ID NO: 18464 - DNA, 368 bp, Zea mays
  Clone ID: LIB189-003-Q1-E1-A5
cccacgcgtccgcgcgtcatcccaatcccaacccaattacgacacgcctgccgccgccacgccgcccgaaatccggaggggaagctcctcgacgacgtagcggccagtggcagctcggacgatggcctcgtccaactccgccgccccggctcccgccgacgggggcgacgacctcgaccagctcctcgacagcgcgctcgacgacttcaccaacctcgatctctctgcctctgccgcccccaaaagctccggcgaggcatcggggtcaggatcgggaggcaaggggccagtgaaggggctggggctggggcttccggaccccaaggcgccgaagcggcgcgcggggaagcagccgccgccgaagggcg

SEQ ID NO: 18465 - DNA, 360 bp, Zea mays
  Clone ID: LIB189-003-Q1-E1-A6
cccacgcgtccgcccacgcgtccgcccacgcgtccggcggggcctacgtcgcgaggcaggctgccaagagcatcgtcgccgccggcctcgcccgccgcgccattgtccaggtctcctacgccatcggcgtgcccgagcccctttcggtgttcgtggacacgtacggcaccggcgcgatccccgacaaggagatcctgaagatcgtgaaggagaacttcgacttcaggcccggcatgatcatcatcaacctcgacctcaagaaaggcggcaacgggcgctacctcaagacggcggcctacgggcactttgggagggacgaccccgacttcacctgggaggtggtgaagcccctcaaggcgg

SEQ ID NO: 18466 - DNA, 419 bp, Zea mays
  Clone ID: LIB189-003-Q1-E1-A7
caccacctcgccggccacactcgtctttctcacgagccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcggggaggaagcggcgcggcggcgcgttcggcgcccagatgaacgccgccgccgagatcttcaggatcgccgccaccatgaacggcctcgtgctcgtcggcctccccgttcggttccgtgctgcctccgggtggaggccg

SEQ ID NO: 18467 - DNA, 431 bp, Zea mays
  Clone ID: LIB189-003-Q1-E1-A8
gactagttctagatccccgacgagaccgtgagcacggcgaaccaccgggaccggatcctgaggctggtgaagggcctgtcgcccaaggtgctcacgctggtggagcaggagtccaacaccaacacggcccccttcgcgcagcggttcgcagagacgctggactactacacggccatcttcgagtccatcgacctggcgctgccgagggacgacagggagcggatcaacatcgagcagcactgcctggcccgggagatcgtgaacctggtggcctgcgagggcgaggagcgggtggagcggcacgaggtgttcggcaagtggaaggcgcggctgatgatggccggcttcagcccgtccccgctcagcgccctggttaacggcaacaatcagaaagctgctgcaaagctactcgccggactacaagctcgccg

SEQ ID NO: 18468 - DNA, 377 bp, Zea mays
  Clone ID: LIB189-003-Q1-E1-B10
gcagaactacgatggtggtgacctccacggagaccctaccagcggccttcccatcaccaacctcaccctcaagaacatcaagggcaagaacgccgttgacgccaagggaaagaatgctgctatcgtctgtggcaagggagcttgcactaactggacttggtccaacgttcaagtttctggtggaaagaagtacgacagctgccagaaactttcccagcgttgcttcttgctaagggatatccatttattaattttccaactccacttggaggatttacaacgtgtaatatggaaagatagacttcattcttgtatataacataaccattggggccagctcgacaagttcttgctgtggttcctaacaatataactct

SEQ ID NO: 18469 - DNA, 392 bp, Zea mays
  Clone ID: LIB189-003-Q1-E1-B11
taccggtcgagaattacgcggtccgattcttcctttttataatctgatctcatgtattttctctgcaacaagacagttttaccccttataaatctctcctctggccaacgtcccagcaacgagtgagcatccacccgacttagattagcagattcgtttcctctggttccttcatgaactcatgctgaaatggattgctaattaatgctattgtgggttgttcattactgattgatgagtactatacattacctgacatgccgtcacgacacaaatttccttgctttactcaattactcagtgtacaattggtgcatcaaaattcaaaatggacttgctgctgtgatttattcatgcttggatcgattcaggtggcataagtactaactttt

SEQ ID NO: 18470 - DNA, 237 bp, Zea mays
  Clone ID: LIB189-003-Q1-E1-B12
tcgacttttataaaagcggatgccatgtattttctctgcagcacgagagttttatccctctagacatctctcctctggacgacttcgcagcaactagtgaccatggaccccacttagattaccacagtcgtttcgtccggttccttcagcagctcacgccgaaatggtttgctcatgaatgctattgtcggttgtgcattcatgattgcctattactataccttgccttggatgccg

SEQ ID NO: 18471 - DNA, 400 bp, Zea mays
  Clone ID: LIB189-002-Q1-E1-H7
agggcaagaggcgaggacatcggaagcggctctcctcggagtcaacggcttgattgggcctactggatcccaaacaacatgggcctttgctcttggaaccatcagtagcgactagcgatagcgagtgcgaggcttccaccaccaccagtagcgagtgcgaggccgaccgtcaccgcgagcggcgccgaacgcggcaatcccccctcgatgacggtggctccaggccggggcgtcaactccaacggcagcggcgtgctcccaatcaggtcagccgtcagaaaacgcgtgaccgccgctgtgtcctggaatttctcgcgtatttcgtcctgtgttttttcttccattttgtgtacacaatttcctttttggtgataggtttggtcatttacttaggtaaagt

SEQ ID NO: 18472 - DNA, 368 bp, Zea mays
  Clone ID: LIB189-002-Q1-E1-G2
agcaataaccatggttcgaaatcccatttgttcataatttcaacctttttaaaatgtgggagcgcacgacaacggtggaaatcatggacccatagaaattggttttttgtatagtagagatagagattagtcatcaccatgataaattcgaccaaatttgaagatgatttggtatttggcaacaacaacttttactactatttgagaaaccccaagtaaaattgaagctaaactacactaatgattattttaggcaaataaatcgagacaatgtatttcaatcataaattgaaggcaatagtagtgaatctaacctagaacattgttggagtcatgagcttcatcacattctataaaatttttaaaaa

SEQ ID NO: 18473 - DNA, 405 bp, Zea mays
  Clone ID: LIB189-002-Q1-E1-G3
agctgatgatgaagggggagtgcgtaaggcaggaggtgatctggcagcacaagctattgccaatgctcatgcagctgctgctttggttgcaaacaaggctgctaataatgcaaatcagcaaataccaggatctgcaacagcccccttgattcctttactcacagcatcaaaccaacaaaatgatgaggccactgctcgggcacttcaggctgcaatgaacttgcaacaaaatctggcaaggatacaggcccatgcagttccagaacactatgaggctgaacttgagattaatgatttcccacagaatgcccgttggagaatcactcacaaagagacactggcccctattcatgactggactggtgctgctatcactacaaggggaacatatattcctcaaggaaa

SEQ ID NO: 18474 - DNA, 404 bp, Zea mays
  Clone ID: LIB189-002-Q1-E1-G5
agcgtcatcgtcgagtacgtcgacgagaccttccaccatggcgcggcgccggggatcctcccggccgacccctacgaccgcgccaccgcccgcttctgggctgacttcatcgacaacaagtgcttgaagccgatgtggctgtcgatgtggacggacggcgaggcgcaggcgcggttcgtcagggagacgaaggagagcctgggggtgctggacgcgcaactccaggggaagaggttcttcgccggcgacgcgctcggcttcgtcgacctcgccgcctgcacgctggctcactggctaggcgtgctggaggaagtggccggagtgcacctgatagcggcggacggcgagtaccccgctctgcgccgctgggccaaagagtacgtctccgatgaggtcgtgagccg

SEQ ID NO: 18475 - DNA, 381 bp, Zea mays
  Clone ID: LIB189-002-Q1-E1-G6
cttctcccggcaactcctcatcccagaggccacaactgccaacaagccaatggctctcgtgcgccagcgccgccagctgccgcaccttaccctcccgctggaccacttcgccctgcgcgtgccaccgcagcctcagcccaccgccgcgccgtccacctccacgtccgacgcccgcctctccgactacgagaggctctccgttctcggccacggcaacggcggcaccgtgtacaaggcgcggcaccgccggtccgcgcagccggtcgcactcaagctattcgcggacggggacacctcggcggcgcgcgaggccgagatactgatgctcgccgcggacgcgccccacgtcgtgcgcctacacgcggtgattccgtcggccgc

SEQ ID NO: 18476 - DNA, 323 bp, Zea mays
  Clone ID: LIB189-002-Q1-E1-G7
agcggcggcgggacctacgccaaggacaagctgggcaacgacatcacggtggaggagtggctcaacacgcacggtcccaacgaccgcacgctcgcgcaggggctcaagggtgaccccacgtacctggtggtggagcaggacaagacgctggccacctacgggatcaacgccgtgtgcacccacctcggctgcgtcgtgccttggaacggcgccgagaacaagttcatctgcccctgccatggatcccagtacaacaaccagggcaaggtggtccgcggaccggcgcctctgtcgctggccctggttcacgccgacgtcgacga

SEQ ID NO: 18477 - DNA, 387 bp, Zea mays
  unsure at all n locations
  Clone ID: LIB189-002-Q1-E1-G8
agcccacgcgtccgggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctncctactctcag

SEQ ID NO: 18478 - DNA, 332 bp, Zea mays
  Clone ID: LIB189-002-Q1-E1-G9
aggttgggaactggaatgagcatactaatctcaaagagcaatccatcactggtaacttcatttgccttcttgtcgtgtggatatcttctcagttcatatcatgaggtgagatctgttgtactaaacaccctgaatagggcaaggttcactgtggctgtggattctttcatcaggactgggtatgtaccctcgctgaaggatggaaactcacaagagacaatatttaatccaccttggcgacatgagccagttgcaataggtttgcgctcttagtaatcttatatattcctgtatgctggtgcaatgtagaacctctactcatcagttttgtt

SEQ ID NO: 18479 - DNA, 394 bp, Zea mays
  Clone ID: LIB189-002-Q1-E1-H1
agatcaggtcttcggggtcgtggaggtgcaggttttccttctggtctcaaatggtcctttatgcccaaggtttcagatggacgcccttcttatcttgtcgttaatgctgatgagagtgagcctggaacttgcaaagatagagaaatcatgcgccatgacccccacaagcttctggaaggatgccttattgctggagttggaatgagggcatcagctgcttacatctacattagaggtgaatacgtgaatgagcgtctcaaccttgagaaagctcggcaggaagcgtatgcagctggacttctgggtaagaatgcttgtggctctggttatgattttgatgtgcatattcattttggtgctggtgcgtacatctgtggtgaatagaccgccctac

SEQ ID NO: 18480 - DNA, 344 bp, Zea mays
  Clone ID: LIB189-002-Q1-E1-H10
agcggacgcgtgggatctccctcggctgccatgccgtctggggcgccctcaaatacatccccgacaggatcgccggcgcggcgatgatggcgccggtggtgaactactggtggccagcgttcccacggcgatctggttgtgagacgtgtacgcaacccaggaggtgggcgatcactgggcgctgcgcgtgtcgcaccacgcgccgggcatcctccactggtggatggagcagagctggctgcccacctccacggtggtggccggcaccacgccgctgcccaacgagcgcgacgccgagatccggagcaagatgaaggcggacggcacgttccagcagaagcggg

SEQ ID NO: 18481 - DNA, 329 bp, Zea mays
  unsure at all n locations
  Clone ID: LIB189-002-Q1-E1-H11
agcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcanggagagcttcctcgccagggctaactgagccg

SEQ ID NO: 18482 - DNA, 348 bp, Zea mays
  Clone ID: LIB189-002-Q1-E1-H12
agggattgggaagggcaacattagcctatattacagttgcctcttttctccttggagcgttatgttctggaatagctggttttgttggaatgtgggtgtccgtacgtgcaaatgtacgagtttcaagtgctgctcgtcgctctgcaagggaatcattgcagattgccgtccgtgctggtggtttctcagccattgtggttgtttgcatggctgtatttggcgtggcaatactgtactcaacattttatgtttggcttggagtagattcacctgggtcaatgaaggttaccgacttgcctcttctccttgtgggatatggttttggtgcctcttttggtgcccattttg

SEQ ID NO: 18483 - DNA, 373 bp, Zea mays
  Clone ID: LIB189-002-Q1-E1-H3
agcccacgcgtccgcagagacagagatcgcgatcgccaccacagggaccatcgagagcgcagcgagaaaagggaacaccgtgatcgttctgatgatcgtgaccgtcaccgtgatggtcgtgaccgccaccgtgatgatcgtgattctgagaggagaagagatcgtgacagagatggtcatcgtaggcatcgctcccgctccccttctaagagtcgtgaccgtgaccgcagatctagatctcgttcacgctctcgatcaaagagcaagcgcgtgagtggttttgaccaagcacctccacaacatgcacttcctattgttgctgctggtgctatccctggtcagcttcctggtatcactgctcctattcccgggg

SEQ ID NO: 18484 - DNA, 380 bp, Zea mays
  Clone ID: LIB189-002-Q1-E1-H4
gaattcccggctcacgcgtcagggtggcgattgatctgtgtacaggatctgacccggagagcctgcggtggaacgtgcaggcggagctggtgcactgccggtgggcgatgctcggcgcggcgggcatcttcatcccggagttcctgaccaagatcggcgtcctcaacacgccctcctggtacaccgccggcgagcagcagtacttcaccgacaccaccaccctcttcatcatcgagctcatcctcatcggctgggccgagggccgccgctgggctgacatcatcaagcccggaagcgtcaacaccgatcccatcttccccagcaacaagctcaccggcaccgacgtcgggtatgtacatctctctctatctctccttttg

SEQ ID NO: 18485 - DNA, 165 bp, Zea mays
  Clone ID: LIB189-002-Q1-E1-H5
agcccacgcgtccgcaaaaaaaaaaaaaaaaaaaaaaaaaaaaaagaaaaaaaaacaaaaaaaaaaaaaaaataggtggacgtacatgaggattcatacttctttgagggtgcaaactaaggttcaatttattcgagagtcgtattataaatgtaattaatggga

SEQ ID NO: 18486 - DNA, 331 bp, Zea mays
  Clone ID: LIB189-002-Q1-E1-G11
agcccacgcgtccgcccacgcgtccgcgatgcagatcctgagagtttacgttcctagctacgagagctacggacgaatgtggccacacatgcacacgaggatcatcgcggctctgatggtttaccagaccaccatgatcggcttcatctccctgaagaagttcgcctacgcgtccgttctcgtgcccctgcttccagccagcataatcttcgcctacgtctgccacatgcgcttctacccggcgttcgccaagactcccctggaggtggtggtgcggcacgacctgaaggagactccgaacatggaggccatctacaccgcgtacataccg

SEQ ID NO: 18487 - DNA, 375 bp, Zea mays
  Clone ID: LIB189-002-Q1-E1-H6
aggatccagtctcgcggtcgcggccacgctgagggacagcgagaagagacagacacagatcgcgcgcggagatgtcgtcggactcgtcgtcgtgggcgcgcgccctggtgcagatctcgccctacaccttctccgcaatcggtatcgccgtctccatcggcgtctccgtcctcggcgcggcatggggtatcttcatcacggggagcagcctcatcggggccgccatcaaggcgcccaggatcacttctaagaacctcatcagtgtcatcttctgtgaggctgtcgcaatttatggcgtaattgtggcaatcatcctccagacaaagcttgaaagtgtgccaacatctcaaatgtatgatccggagtctcttcgag

SEQ ID NO: 18488 - DNA, 388 bp, Zea mays
  Clone ID: LIB189-002-Q1-E1-E4
agcccacgcgtccgcggacgcgtgggaggaggccgagggcgagggcggcgcaggggcactcacggggacgctggtcgcaggagcgctactggttggtttcgtaggggggtttggggcggccggatacgtgtacaaggaccagatcaacaccttcctcacgcagttctcagggttcattgacggctatggtccagccggatatgctctgttcgtacttgtatatgcaggattggaggttctcgctattcccgcaatacctttaaccatgtcagctggtctattatttggtagtgtgaccggtacaattattgtttcaatcagtggaacactagctgcagcggtggccttccttatcgctagatacttcgccagagatagaattcctaaa

SEQ ID NO: 18489 - DNA, 392 bp, Zea mays
  Clone ID: LIB189-002-Q1-E1-E5
agcccacgcgtccgggaggccctcaaagctaacccggttctagccaagatgatgatcagtggtgtcgtctactcccttggtgactggattgcacagtgctacgaaggcaagccaatctttgatttcgaccgtgctcggatgttccggtctggtcttgttgggttcacgcttcatgggtcactttcacattactactaccatatctgtgaggcactattcccattcaaggattggtgggttgtccctgcaaaggttgcattcgatcagaccgtttggtctgcaatctggaacagtatctacttcgtggtcttaagtttccttcggttggaatcacctaccactatctacagtgaactcaagtctacattctggcccatgcttaccgctggatg

SEQ ID NO: 18490 - DNA, 331 bp, Zea mays
  Clone ID: LIB189-002-Q1-E1-E6
atgacaccacgctagtccctggtgtcgccgtggaatcatctcgcgccaagcctctggccgcgtggatgaacggtctggagatctgcgcgatggaggcggacacgggcagggcgagcctgatcctgtcggcgggggtgtcgacgcggtacgtctactctgggtaccagaaaaccgccgcgtcgacgcaggaggcggaggcctgggaggcggcgaagaaggcctgcggcgggctccacttcctggccatccaggagaacctcaactccgacggctgcgtcggcttctggctcctgctggacctgcccccgccgcctgtatgatggatggtcta

SEQ ID NO: 18491 - DNA, 399 bp, Zea mays
  Clone ID: LIB189-002-Q1-E1-E7
agcgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggcctgcagacgggtgaccccgccgggttcaacctcgccgacacgctggcctgcggcg

SEQ ID NO: 18492 - DNA, 342 bp, Zea mays
  Clone ID: LIB189-002-Q1-E1-E9
aggatgttacatgtgtttccaccacattatttgagccagtaatattgtttttgcaggctatatgattgttctatttcttgcttattttgtataccataatagtgctgctatatacaatgatgattttgtttaataaaaaaaacatatatagaagtgacagatgtaaagatatatgttctcttcctcaactagttcagtctgccagctaaatttcttttttgattcatgatttgtagagtaaaatctttatttttaattgatttcagttcaaggagctcgcacaagcctatgaggttttgagtgatccagagaaacgtgagatttatgatcagtatggtgaag

SEQ ID NO: 18493 - DNA, 408 bp, Zea mays
  unsure at all n locations
  Clone ID: LIB189-002-Q1-E1-F1
agatccaattgtcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactcgtacgtagtcctccgatcgatccgatcctccttgagtagtatatacatacatgaacgcgantacgaataatatattaatcgaacgaactg

SEQ ID NO: 18494 - DNA, 332 bp, Zea mays
  Clone ID: LIB189-002-Q1-E1-F10
agccagcatgtgacagtgggcgtggttggcggatccgatctggtgaagattaccgagcagctcggcagtacagttattactgattatgattacgtcttctccgaaaacggcctggttgcacacaaaaatggccaactaattggaacccaaagtttgaaatcatttatcggagaagacaagctgaaggaatttattaacttcactcttcattatattgctgacttggatatcccaattaaaaggggtacattcatagagttccgaagtggaatgattaatgtatctcctataggaagaaactgtagccaagaagaacgtgatgaatttgagaa

SEQ ID NO: 18495 - DNA, 323 bp, Zea mays
  Clone ID: LIB189-002-Q1-E1-F11
agcccagcctcggccagccacctccccgtcgctctcacgctcttcgtgcccgccgcctcccctcttcccctccacctcactcctcccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgaccacactgaagtttgt

SEQ ID NO: 18496 - DNA, 351 bp, Zea mays
  Clone ID: LIB189-002-Q1-E1-F12
agctcctagccgccgccgccgccgccgcccaaaaccctacctaccctcttctccccctcactctcctttcatctccattctaatggcggcccaacccgtccggcgaagctgctagtgcttgtatctactatcttcatcaggtacttcgcgatcctactgaagtattccccgccgccgctgccatggccaccctcaaccctttcgaactcctcggcgccgacgacaacgacgacccgtcgctgttgattgcggcggcggcggctgctgctcagaaagccgaggcgaagaagtccgccgtggcgcctgctgggaaggctgcccagcctgcggcgaccaccaagtttccgaaca

SEQ ID NO: 18497 - DNA, 386 bp, Zea mays
  Clone ID: LIB189-002-Q1-E1-F2
gtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccgtcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctgtcgatggacgagtcgaacgcgacgtgcgggaagccgctggcgtccatcggg

SEQ ID NO: 18498 - DNA, 356 bp, Zea mays
  Clone ID: LIB189-002-Q1-E1-F4
agggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcagtccttcctgcagcagcag

SEQ ID NO: 18499 - DNA, 337 bp, Zea mays
  Clone ID: LIB189-002-Q1-E1-F6
agaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacac

SEQ ID NO: 18500 - DNA, 405 bp, Zea mays
  Clone ID: LIB189-002-Q1-E1-F7
aggcagagcaccaccaccatacgccgccaccgcaagcagacgtccccatggccatggcttccaccgccaccgctgctgcttctctccgcctcgccttccctctcctctcctcgccggcttcctcctcctcgtcctctaatacccttcgcttccctctccgccgccgcagcgccgcccgccccatcgccgtcaccgccttcaagaagctctccgaggcgtcccccgtgcccatccctcaggagcccaccgagcccctcctggtcgacgaggacgctctgcccccaaaggccggggtctacggcgtctacgaccccgccggcgagctgcagttcgtcgggatttcgcgcaacgtcagggccagcatcgagggccaccgccggaaagtccccgccaacctctgcgcct

SEQ ID NO: 18501 - DNA, 362 bp, Zea mays
  Clone ID: LIB189-002-Q1-E1-F8
agcccacgcgtccgattaccattgtcaactgtcactcaagtgcaaaccattaccgtcgtcgtcccaatccccgtcgctgcacacgccttcaggacaaacccaagggaaagcagattataaatcactgagtgaagaggagtggaagaagcgcctgactgaagagcagtattatgttactcggcagaagggcactgaaagagcattcactggggaatactggaatactaaaacgccaggcatttatcagtgtgtctgctgcgacacccctctgtttcagtcatcaaccaaatttgatagtggtactgggtggccatcctattataaaccaattggtgaaaatgtcaagagcaagcttgatatgt

SEQ ID NO: 18502 - DNA, 326 bp, Zea mays
  Clone ID: LIB189-002-Q1-E1-F9
agagatcttgaagggcacgctagctgttggttttgatgctgatgccaatggtgatgtcactgcagttaagctaaaggatggcacagtacttgaagccgatattgttgttgtcggtgttggaggcagaccattgactactctcttcaagggtcaagttgctgaggagaagggtggaatcaagactgacgcttcctttgaaacaagcgttcctggagtatatgccattggtgatgtggctaccttccctttgaagatgtacaatgagttgaggagagtggaacatgttgaccattctagaaagtctgcagagcaagctgtaaaggcga

SEQ ID NO: 18503 - DNA, 384 bp, Zea mays
  Clone ID: LIB189-002-Q1-E1-G1
agagctcgaacaaatcgtcgatcgtcatcctcgtctacgccaaagatccgagaagattaggcacagaagaaaataaatcagtacgcagtcggagaattctcgatgtggatgaagatgaagcgcgattcgacacagcagtcaccctattttcggtgaaatgctgagctgaaaggcgtcgtcgatttcgtgatttcaagtcggatttaattgacggtacgtgaattaaccacgtgatgcggaagacgagccaagtcgaccccaagcgcgggctactccgcatggtgatgctgatggacgaacctgcctgatcatgtgctaggacaaggatgatcgtctaacaacactaacctagtgttacccaggcaagccccgggtaagagtcac

SEQ ID NO: 18504 - DNA, 295 bp, Zea mays
  Clone ID: LIB189-002-Q1-E1-G10
acacgcttcatgtatatgaactggaatccacatacttctctcatacatcagtctatctctggctaccttcctttgccttcatgtcctgtggctatcatctgacttcaaaccatgaggggggatatgttgtactatacactctgatcggggcatggttcactgtctccgtagattctttcattcagactgggcacttcttctccccgcatgatgttatctccccatcattcttctctacaccatcttcgggaccagaaccagttgcacctcgtgtgcccactaactaatcttacac

SEQ ID NO: 18505 - DNA, 411 bp, Zea mays
  Clone ID: LIB189-002-Q1-E1-E3
agcaaaagcatagagatccatcttctctgctcaatcaattacacaacaagagcattctagatttgagttcatcctagcgataccaatacacccatcccaacactccaaaccaaccaacacttcaaccaaaccaccacaacaatgccttcagtaacccaggcccgtctcatgtggcgtagcgtcgcccgcggcatggtagagccccaccccttcgctcgcaatcccatcaccatgacccctcacgcctggcgcgccgccgacctctccaagaaagtcgtgaagacaagcactgtcttcttccccttctatgcaggtatccttggatggccagtcgcagccgcctggtggttcaacggaaacatgtgactcttccaaatggaagtgccaaggcaggagaagaggaagggaccg

SEQ ID NO: 18506 - DNA, 407 bp, Zea mays
  Clone ID: LIB189-002-Q1-E1-C8
agtagttctttgggaaatctaacctacctatccctcctacaactagaacagaacaacctcaaagcaaatgataatgagggatgggaattcatagatgcattgcgcaaatgtcagttcctggaaaaactcttattatcttacaatcagctaggaggagccataccaaattcagttgggaagttatccaacaacagccttcagtacctacgattcggcagaaacaacttgtcgggagctgttccggagagcatggggaaccttattgccttaaatacgttagatctagaacaaaacaatttgaacggtctgattggatcatgggttggaaagttgaacaacttggtaagattatctctttcagacaataacttcagtgggcccattccatagtccattagttggtaata

SEQ ID NO: 18507 - DNA, 271 bp, Zea mays
  Clone ID: LIB189-002-Q1-E1-C9
ttgttcttcagatcaagtccctcaatgaggactttcgcaacgaccattgtcaatcgcacacatccgggtgggactcagtccctccttacccatcttagtcattcctttcatgctacctgcatcaaccttcgtgagtttgttgccatcgacatctagttcattaaggcaaggaggaataccttctcggatggtacttatatttgtgtcatcatcacggatctactagaccttcttcattccctgaacagctcccatttttaatacctcacct

SEQ ID NO: 18508 - DNA, 402 bp, Zea mays
  unsure at all n locations
  Clone ID: LIB189-002-Q1-E1-D11
agcgccgccgccagcgtgagagtgagcaatgagctcggcgccggccaccccaagtccgcgtatttctcggtgtgggtagtgaccgcgctgtcgacgctcatatctatcatgctcggcgttctggtcctctgcctgcgcaactacatcagctacttgttcacggagggcgaggtggtgtccaacgcggtggccgatctctgcccgctgcttgccgtcacgctcgttctcaacggcatccagcctgtgctgtcaggtgtcgccgttgggtgcgggtggcagcagttcgtggcctacgtgaacattggctgctactacatagtcggcgttcccctcggcgccctgctcgggttcttcttcangctccgtgttaagggcatttgggctgggatgatcggagggacc

SEQ ID NO: 18509 - DNA, 339 bp, Zea mays
  Clone ID: LIB189-002-Q1-E1-D12
agcccacgcgtccgcccacgcgtccgtcctctctcatggtcacaatgcttgcagctagttctctagtgaacagcaacctcgcttgctcatcaaggatatcatcctgttcagacttcacatatagccactcctggcgtcccatacatgctatgaaactccatcagatgcgtgctgtgagctcaatacgtataagttgtgctgccactaaacctgcaaagactcctgctgaagaagaatggaaagttaagcggcaactgctatcagaaaagcgggtacgaagtgtcgatgtgaaggaagcactgcgccttcaaaaggaaaacaactttgtcattcctgatg

SEQ ID NO: 18510 - DNA, 369 bp, Zea mays
  Clone ID: LIB189-002-Q1-E1-D2
agcgaacgcgtgggcggacgcgtgggcagaaattggggatgataagaaaatccttaagaaggttctcaaggagggagaaggttatgagcgtcccaacgagggtgctgttgttgaagtcaaaattatcggaaagcttcaggatggcgcggtgtttacaaagaaggggcatgacgaagagccatttaaattcaagaccgatgaagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttaattc

SEQ ID NO: 18511 - DNA, 378 bp, Zea mays
  Clone ID: LIB189-002-Q1-E1-D3
agctcaagctgctttatatactcatcaccaatacattgcagggttcatcatgacaggggcttttgctcatggagctatttttttcattagggattacaatccggaacagaatgaagataatgtattggcaagaatgttagaccataaggaagctatcatatctcatttaagttgggctagcctcttcctaggattccataccttgggcctttatgttcataacgacgttatgcttgcttttggtactccagaaaagcaaatcttgattgaacctatatttgcccaatggatacaatctgctcatggtaagacgacatatgggttcgatatactcttatcttcaacgaatggccccgctttcaatgcaggtcgaaacat

SEQ ID NO: 18512 - DNA, 360 bp, Zea mays
  Clone ID: LIB189-002-Q1-E1-D4
aggagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggagtcggagcgagcgaggatgggcggcggcaacggtgaaaccacccagctgggggagccactgctggcgaagaaggcgaaggcgtatcgccctaggtgccccggctgccgggtggaccgcctcaacgcggagcgggagggtgtcttccctctcaaggacctcttcctcatctggctcgtcaccatcacct

SEQ ID NO: 18513 - DNA, 404 bp, Zea mays
  Clone ID: LIB189-002-Q1-E1-D5
agggcacttgcagctcagggtgcatttcgtggatttctggatacgaggacaccattgtatgctgtgggtgctggcaacctattaaatgcattacttgatgtggtacttatttttccacttggtctaggagtaagtggtgctgcactggccaccgtgacctctgagtacttgacagcaatcatcctcctttggaagttgaatgatgaagtagatctattgtcatggaatataattgaggatggagtcatccgctacctgaaatctggtggtctactaattggcaggacaattgcagtattcttgacactgacactagctacatccctggctgcaagggaagggcctgttccaatggcgggctatgagatatgcttgcaagtgtggttaacaattcccctgctcaa

SEQ ID NO: 18514 - DNA, 300 bp, Zea mays
  Clone ID: LIB189-002-Q1-E1-D6
agccagcctgtcctccagctccatctccccctcgtggccatggtgagctcccctgcgacgcgcctccacgtcacaggccagctcggcctcctccctagcaccgtcccatttcctccctgcaccggatcccctttcccctgcgtgccggactttcctccactcctccatccatggctctctgctgcttttactccctcccctgttcgcccatggtagtcgcgcccttgccaagctccctccgcgccgtggtgctccagctcggcctgcttcccagctcgctcggccgaagcgccctgctcg

SEQ ID NO: 18515 - DNA, 408 bp, Zea mays
  Clone ID: LIB189-002-Q1-E1-D7
agaaagaagctgctcagcgcaaagactcgagtgaaaatcaagggcagaatgatgctctagagctagacaacctccggatggagatgcaagctgacgaacgtccgttagaaccaggaaacaagagggacaggaagtggcagaaaaatgtatatggactcggatcagcttcgggacagaaggaaaccttgtccaggagagaaaatccacggtcagatagagggatggtccacagtaacgacagcaaaacaatttattacaggaagggtgggacggaagtcgataatgttgatgaccaccctttagaaaagcaagaccaccaggatacatcaagtgacggatctaaaaagagaagccgaccagtggacaacgcatctggtggcaacagaccatacttggatgagaacaaga

SEQ ID NO: 18516 - DNA, 355 bp, Zea mays
  Clone ID: LIB189-002-Q1-E1-D9
agggtacatggacttcaaaaatccaggatcgcaagcagaggaagggacattcatagggttagaggctgcactcgcaggtcaacagccaggctaccccgggggcccactgttcaatccactaggactcgcaaaggatatagagaatgctcatgacgagaagctcaaagaaatcaagaacgggaggttggcaatggtagccatgcttggcttcatggtgcaagcatccgtaactcatgccggccccatcgacaatctcttgacacacctttcggacccgttcaacaaaaatattattcacacattctcctcttcctaagtactcgtcccaatgcccggatgccatggcgggcacaaa

SEQ ID NO: 18517 - DNA, 178 bp, Zea mays
  Clone ID: LIB189-002-Q1-E1-E1
agtgtagatgatgacacatgtaaaactgccacggcaccatcatacagcaacttgaaggagatttaaatttgttaggccggtggattgtgtaaaataagtgacacggtacagtagacgatactgcataatattgtttgtaacgtaaagtctgaaagaggagataagatatataagatgg

SEQ ID NO: 18518 - DNA, 350 bp, Zea mays
  Clone ID: LIB189-002-Q1-E1-E10
agcccacgcgtccgcccacgcgtccgcggacgcgtgggcttccgttctcaaaccaacctaggcaattcgccgcagcctctcaccctcgcgagtcccgacctcccgcagccgccgcacagatggcacccaaggcggagaagaagccggcggccaagaagcccgcggaggaggagcccgcgacagagaaggtggagaaggctccggcggggaagaagcccaaggccgagaagcgcctcccggcgggcaagtccaaggagggcggcgagggcaagaaggggaaaaagaaggcgaagaagtccgtggagacctacaagatctacatcttcaaggtgctgaagcaagtgcacccc

SEQ ID NO: 18519 - DNA, 346 bp, Zea mays
  Clone ID: LIB189-002-Q1-E1-E11
agagaacagcaggcgaagcatcgccagattggtatatcgatcgattgatcggtggcggagggaggggaggagggcggcagatggcggcgtgccggggcttcttcgagtgcctgctcaggctgctcaacttcatcctcaccgtcgccggcctcgccatggtcggctacgggatctacctgctcgtcgagtggatgaagatatctgaggacggcagcagcggggggttgacggcggaggtgctggtctccggccggccgttgttgggggctgtcgctctcggtgacagcttcctcgacatgctacccaaagcatggtttatttacttgttcaatggtgttggtgctac

SEQ ID NO: 18520 - DNA, 318 bp, Zea mays
  Clone ID: LIB189-002-Q1-E1-E12
agcccacgcgtccgcctcgccagtccccaactcgaacctcagtcaggcagcgtgaggagggagagttcaaggaccgaggcggcgtcgggcgagatgaagcttaacgtcaagaccctcaagggcaccaacttcgagatcgaggcgagccccgatgcgtcggttgctgacgtgaagaggatcattgagaccactcagggtcagagtacctaccgggcggaccagcaaatgcttatataccaagggaaaattctcaaggatgagaccactttggaaagcaacggagttgctgagaacagcttccttgttataatgttgtcc

SEQ ID NO: 18521 - DNA, 371 bp, Zea mays
  Clone ID: LIB189-002-Q1-E1-E2
agcggacgcgtgggctccgacctcacgccggcagagttccgccggacctacctcggcctccgcaagtcccggcgcgctctcctcatataactcggggagtcggcgcacgaggcgcccgtgctccccaccgatggtctccccgacgatttcgactggagggaccacggcgccgtcggccccgtcaagaaccagggttcgtgcgggtcgtgctggtcgttcagcgcgtctggagcgctggagggtgcgcactacctcgcaactggcaagctggaggtgctttcggagcagcagttcgtcgactgtgaccacgagtgtgattcatcggagcctgattcatgtgattcgggttgcaatggtgggctaatgacgac

SEQ ID NO: 18522 - DNA, 405 bp, Zea mays
  Clone ID: LIB189-002-Q1-E1-C7
aggtcgcggcgtgagcgagcgagaggggaaaacccaaaaccctagcaccccccgccccgtcgccgacggccgccggagtagagagatggcggtggacgaggtgaactcggtctacgtcggcggccttccctacgaggccaacgaggagatgcttcgcgacgccttcgggtactacggcaccatcgtctccgtcaaggtgattaatgatcatgctgtcaaaggcaagtgttatggttttgttactttcactcaccccagagctgctgagcaagcaattgcgggcatggacggcaagaaattaggcaaccgtattgttcgagtaaatgaagtgcgtacaagaggcccccgcgattttggccgagatggtttcagacgagatccaagaaggtatggtagagatccata

SEQ ID NO: 18523 - DNA, 371 bp, Zea mays
  Clone ID: LIB189-002-Q1-E1-B1
aggtcatgtagagtatttctgtcactatattgtgtgttgcagctcgagaactatttcatattcaatgatcggcatagaggaatgaggatggatatcgacggcatgtcctacgaagtatgtctggatctctaccccttactctgacgacgccattttctgatttccttcgttacttcatcctcctctctctctctctctctctctctctctctctctctccagtcagcaagcagttcttgtttgtcatgcttttgtaagtgtagttatataatttgtgacactctgctttaaaggagttgcttgctttgggggagcgaattggtaccgtaaacacaggtctttcagacgacgcgttatccgcgtgcctgaac

SEQ ID NO: 18524 - DNA, 330 bp, Zea mays
  Clone ID: LIB189-002-Q1-E1-B10
agcccacgcgtccgcccacgcgtccgcccacgcgtccggtatgtagaagtacctagtgacagtggtattacattcaatgttgcacccaatatgaaggcgcttgaaattgctgagaaagccagggatgctctcctaagtggaaagtttgaccaggtacgtgtcaacctgccaaatggtgacatggttggtcacactggtgatattgaggccaccgtagttgcttgcaaggcagctgatgaagctgttaagattattttggatgctgtcgagcaagttggtggtatttaccttgttaccgccgatcatggcaatgctgaggatatggtgaaa

SEQ ID NO: 18525 - DNA, 319 bp, Zea mays
  Clone ID: LIB189-002-Q1-E1-B11
agcccacgcgtccgctcaagcctgatatccatcgcacaagccctgcgtggtgcagcccggtctaatcagaaacccctgctctctcttcgcgttgagggtccagtttccttgtcctcgactccttccatgtctcccaaggacaagctcaagctcaaacggttggccccaggccaagtggagctctcctcacaggcgggggcaatccctgctatcaccgaagacgaggatgaaccacataaccctggattgtggcctcttttgtctctgaatggttcagatggcagcctgcatgggtttgaggagctattggcctcagtac

SEQ ID NO: 18526 - DNA, 357 bp, Zea mays
  Clone ID: LIB189-002-Q1-E1-B12
aggacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtcaagctgttcaacgccgtgggcgtggag

SEQ ID NO: 18527 - DNA, 398 bp, Zea mays
  Clone ID: LIB189-002-Q1-E1-B2
agggactcttcagtagtagaaagaagggggagaaccgaaaagcaagtcatctttgaagattcggaacactcttcaacatattgtcttgcatttaaagtgattaatccaagtcatttgcctcctttgaaggagctgcaaaaattgatgagaatccagtcactgcgttgtcatgcactgtataaccatggcgccaccaggttatctgtaattccaattcatgcatcgcgatctcaggctctaaggtatttgtctatttgctggggcatagagttgccagatgctgtggtcattgttggtgaaactggtgattctgattacgaagaactgtttggaggtcttcacaagacagtcatccttaagggtggattcaacactcctgccaataggattcatacggt

SEQ ID NO: 18528 - DNA, 386 bp, Zea mays
  Clone ID: LIB189-002-Q1-E1-B3
aggaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagca

SEQ ID NO: 18529 - DNA, 406 bp, Zea mays
  Clone ID: LIB189-002-Q1-E1-B4
agctcccaaactcgcgagcgagtcgaggctccaaccccggcacatcacaggaggaggaggacgacgcgcccaccatggccatggcgacggccctccgcaagctctccgccaacgctctgcgccgccagccgctctcccgcatcacgccgctctactacatggcgtcccttccggcgacggaggagagatccggaatcacctggactaagcagttgaacgcgccgctggaagaggtcgaccccgagattgctgacatcatcgagcacgagaaggcccgccaatggaagggtctggagctcatcccgtcggagaatttcacgtcggtgtcagtgatgcaggcagtgggttccgtcatgaccaacaagtacagccaggggtaccctggcgcaagatactacgggggaaa

SEQ ID NO: 18530 - DNA, 401 bp, Zea mays
  Clone ID: LIB189-002-Q1-E1-B6
aggcgcgccacgctgagcgtcccggaccgcccactgttcggcctggggatgttcctcggtgccgtcgccgtgcggcacggcttcgacgccgggtgcaagcgcgccgagctgctcgccatcaacgacacgccgctgtaccacgacaagctcgttagattttacatgaggatgggtttcaaagcagttcatgaggttgatggatcatcaatcagtgatcttggtcacatgttggtgtggggaggtaggggtactagaatggatgctgatattgaagagcttcttattaagtggggaaacagattcagactacaagactaaaaggtggatggtaatactgatatgttttgtcgagacatgcagtttttgcagcatgccgcatacaaatcttgtttggatgcaat

SEQ ID NO: 18531 - DNA, 408 bp, Zea mays
  Clone ID: LIB189-002-Q1-E1-B9
agcggacgcgtgggtgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaattattagccaaggcccacctggctgccatacataggtattgtgtggtgtgtgta

SEQ ID NO: 18532 - DNA, 344 bp, Zea mays
  unsure at all n locations
  Clone ID: LIB189-002-Q1-E1-C10
agcaagcccttccaacggcagtcatggcttccatcaccctcctctccctcgctcccaccgccatcttcctccacatcccggctttcacctcctcctccgtcgttggtcccggaatcctagccggccgctgggccgcgccccgcgccctcccgctccgcgcgctcccgccccgtcgcgtcaccgtcgtctgcagcagcgccgcggcggcagccgaggcctcggacgccgcagcgccagtggagaagttccggctcgacaatttggggccccagaaggggtcccgccggcggcccaagcgtaagggacgcggtattgctgcanggccaggcgcgagctgcgggttc

SEQ ID NO: 18533 - DNA, 326 bp, Zea mays
  Clone ID: LIB189-002-Q1-E1-C12
agcccacgcgtccgcggacgcgtgggcggacgcgtgggaacgctcgaaaggcgaacgggcatgctaacatgcaagaaatggacaaggagctggacacacacagggcggagcatggtccgaagactcggcgagttcctgaggagggcggtaatgatgacgacgaagacgcagaggacatggctgcggaagacgaggtgatggatgaagttctgggcatcaacgatgggatcaacgaggacccatccaagccgtccgaagaagctactactgaaggtggtgagcctgcacccgaggaagcacaataggattctttgttcacacaagct

SEQ ID NO: 18534 - DNA, 386 bp, Zea mays
  Clone ID: LIB189-002-Q1-E1-C2
acgcgtcagccagaccaaggctaggaagtacaccttcttcaagcccaagttcatcttctacgccacctacctgtccgataagatcgggtactggaggtacatcaccatcttcaggcagctcaaggcgaacccggagtaccaggtgtaccccatcttcaagtatttcgagaactggtgccaggacgagaacaggcacggcgacttcttctctgccctgctcaaggctcagccgcagttcctcaatgactggaaggccaagctctggtcacggttcttctgcctctcggtgtatatgaccatgtacctgaatgactgccaacgcactgcattctatgagggaattggtctggacaccatagaattcgacatgcatgtgatcaatggga

SEQ ID NO: 18535 - DNA, 406 bp, Zea mays
  unsure at all n locations
  Clone ID: LIB189-002-Q1-E1-C3
aggtcctgcccacgcgcccctcttccgcgccactgtcgtcgtgaatggcgagaggttcagttcccgggatgaaggggagaagtcactcaaggaggcgtacaacctcgcggcgatggccgccttcgacaacctcatcgcgctcccggccgcggcccttgcccctgccccggctgctccagcgccgccctcatccgagacccagcttccttacaagagtcagttacaaatttatgctcagaagcgaggcaaactcctgccttcatatcgtcccattcatggaggttctcttcatgcacctctatttaagtcagaagtaaccatagatggtcaaacatttgagagcccagagtactgtcacacaatgaaggaagctganacagttgctgcaaaagttgctctgatgtcc

SEQ ID NO: 18536 - DNA, 309 bp, Zea mays
  Clone ID: LIB189-002-Q1-E1-C4
agcggacgcgtgggtggagttcgtaggaagctgttttgtctgtgttcttgtacttctgagttttgtaccagtagcgaacgtttcattgtgattgaagtcttcctgccaaatattataagatctaagaaagttctatccgtgttggtggttcagcagtgcattatctgcatttggttccttaggtagtccatggtatcttgaggtcccattttgtttgaattgctgactgtcaggtgtttttgctgttggtttggaataaacttggcatgtagcttgccgaaactggaataaacttgacatgcatcgtac

SEQ ID NO: 18537 - DNA, 397 bp, Zea mays
  Clone ID: LIB189-002-Q1-E1-C5
agaaaacccttactggcaagaccatcactcttgaggtggagtcttcagataccattgacaatgtcaaggccaagatccaggacaaggagggcatcccgccggaccagcagcgtcttatctttgccggcaagcagctggaggatggacgcacccttgcggattacaacattcagaaggagagcaccctccacctggtgctgcgcctcaggggaggaatgcagatcttcgtgaagacattgactggcaagaccatcaccttggaggttgagagctccgacaccattgataatgtgaaggccaagatccaggacaaggagggtatccccccggaccagcagcggctgatcttcgccggcaagcagctggaggatggtcgcaccttggctgactacaacat

SEQ ID NO: 18538 - DNA, 398 bp, Zea mays
  Clone ID: LIB189-002-Q1-E1-C6
agcggacgcgtgggttccggtttccctgcagtgaaggaagaggaagcccaaccccaaggacagcagcgtacaatcaggctgatgcttgttggaactcagctgttgatgcttgtaagcctcgctgcctggctgcgtcctgtgctgtagatacgagatcccgcagcgttcgtttgttgcacttgcaccggcttgctgctagcttgcgacaggactaggaggagctagccgaggaggaggtgtgtgactccatggacgcgggccagcaggatgcgtgggactgggactgggaggtcctgctgccataccacaggagctcctcctccgtgcgccaccacggcagcaagaataaccttgacgattaagaagaaacagacgagcacgaactgctgcctccgcca

SEQ ID NO: 18539 - DNA, 312 bp, Zea mays
  Clone ID: LIB189-002-Q1-E1-A9
ggagtcttcgacgacgtcaatagcatgatgcagcaacaacagcagcaggcaccacccgtggtgcagcagcagcagcagcagcagttcttcatccgcgacgacacgccattcatgagccagatgggcgacatcaccagcacggcggagttcaggttcggctctggtttcaacatgtctagcaccgccgccgctgattacccaggcgcggcgcagaagaacgacggggccaattggttctactgaagaataaaacttgtagggctcctcgttataagcttcggattcctccatggctctcccaagttgtcaagt

SEQ ID NO: 18540 - DNA, 411 bp, Zea mays
  Clone ID: LIB189-001-Q1-E1-H12
ccgcgatgcgacgcgggcttcagacggacgcgtgggcggacgcgtgggcggacgcgtgggcggcgccggcgaggccacacgcccaccatcagtcagccgccccgccacagccatgcgcctccccgccggcgcacgcctcgcgctcctgctcgcccgccgctccctctcctcctccccccgcatcccgcgggcgcacacagggatatggagcgaggcgccctcccggagctctcccttctctccgccgagcagcgcccgcaggtccttccacgggaccaggccggtggcggcaagggactactacgatgtgctcggcgtcagcaagagcgccagccaggcggagataaaaaaggcctattatgggcttgcaaagaagctccatccagacacaaataaaggtgatgcggatgc

SEQ ID NO: 18541 - DNA, 422 bp, Zea mays
  Clone ID: LIB189-001-Q1-E1-H4
agcgagaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcaccaagccggagtacacggtggacgtgtggtccggaaaccacccctactatgtcggcgacacctcggcgctcgtggtcatggacagccagatcgagaagttccgcaagaagtggggccacatcaaggagtactggcccgaggaccattggagggagatgcacccagacggcgacccggagttcgagcccgagggggacaactgattg

SEQ ID NO: 18542 - DNA, 408 bp, Zea mays
  Clone ID: LIB189-001-Q1-E1-H5
agctttcttcccctgctcgattcgcgcagctgcatcaccggcgacggcggcgatggcacggaggagaaagacggacgccccgccgcggctggacgaggcagatcgcacgctctactccaccttctgcggcgccgccaactccctctcccagctctacgcgcaggccatggcccagcagaagctcaacttccatgccggcgagcgccacgccttagaaaagctctaccagtggatcttgaggaagcacgatgaagaggctaggctcactgtggctgaaataatgtctcatatccagcatgagatagactatgtaggtactgatgcacatgtctccccaagagtacctcagcatcctcagattgcaaatccattcgccaattcagttgtcccacctggaactggtttgta

SEQ ID NO: 18543 - DNA, 354 bp, Zea mays
  Clone ID: LIB189-001-Q1-E1-H6
agcgtacgcatgcgccgagacatcagcacacgcgtccacgtacacagtcaactggacacgacaagcttgcataagtaccagtgatgactgcgctcgtcaaggttgctgatctagccgtgatgatcaccggcgccgccgtcaccgtgatctccgtggggataatcggtctcgccaggaggtccatctgctgaatgaagatggccgtcgcaacggcgttggtgggcacgatccgcaagcacagcgtagacgttgtggtggacaactacggcaacacgagcgtctagtttgacctcgacgagatcggaacgaccatcggatagtgggagctctagagctcggacgtccacacgttct

SEQ ID NO: 18544 - DNA, 340 bp, Zea mays
  Clone ID: LIB189-001-Q1-E1-H7
agagctggacagcaagggcatcctcaaggggggcgtcaagttcaggaagagcgactagctgatttcctcccatctacgactacgatttgattcatcctgggagtcttgatcgatcgacacttgttctgttctgtacagcgagtaacaaccgctgctgctagctacattctttactgtactgtacttgtgtgatgacatcatatcttcgcgtcgcgtgtactgaagaactacacattgcactaaggttgctttcgtacgtgtacgtgctcatctttcttccttggaaatcactcggatgtgccgccctttgcaaaatgaagcgatcccttgtttttcttct

SEQ ID NO: 18545 - DNA, 412 bp, Zea mays
  unsure at all n locations
  Clone ID: LIB189-001-Q1-E1-H8
ggcgcgacctgaacatcgtccgcgaccagctgtccggcgagcggcgctggagctggaacgtggagtggagcaacggcaccgccttcctgttcgactccgcgtcctgccgcacattccagttcgccgtgggcctcctgccgcccgactggaaggcccgcggcgccgcttacctgnggcgcgaccgcgtcgacggcttcgactgccacgtctggtacaacttcgtcttcgcccgctactacgaggacgtcgccaccggacgccccgtcagctggaacttcaatgggctgcagcggcatgtgctgagcttcgaggcgggggcagtgctgctggactcctccaagtggcaggcgccggcttactgctttcacanncacaatggcagcagtgccaacgccgccgcttcgtcctcctg

SEQ ID NO: 18546 - DNA, 352 bp, Zea mays
  Clone ID: LIB189-002-Q1-E1-A1
agcccacgcgtccgctcccaccccaccccaccccacccgcaagcgaggcagcctaggacgcagcagcgcacccccgatcctcgcctgtcgcctccatctccattcgcaggcctgagaccctcgcccgcaccgcgctgccgccagccatgggaatggggcctctcgagaacgccgcgtcggccgctgagtccgcggccttgccggaggccggcgccgcctcggcagcgggctcgtacgcggtgctgcagtgcggcgaggactcggagtacgtgcggcagaagtacggcggctacttcgccgtcttccgcgcgctgctggaggaggacggcgagagctggcgcgtgttacgcgc

SEQ ID NO: 18547 - DNA, 421 bp, Zea mays
  Clone ID: LIB189-002-Q1-E1-A11
ccgcgatggacgcaggcatacatgtggaacactggttcctcaaacttcaatcaacaaggaacctaattcagaggttttgaacatcatcaataccctttgctcagatagtagaaacatcgtttttcttgtcagtggtagagacaaagatatgttaggaaagtggttctcctcatgtccaaaattggggattgcagctgaacatggttacttcttgaggtggtctagcgaagaagagtggcaaacatgcactcaggccatggactttggatggatgcaaatggcaaagccagtgatgaatttgtatacagaagcaactgatggatcctacattgagacaaaagaaagtgccttggtgtggcaccatcaagaagctgaaccaaggctttggatcctcacaggcaaaggagctgcttgatcacct

SEQ ID NO: 18548 - DNA, 346 bp, Zea mays
  Clone ID: LIB189-002-Q1-E1-A12
agggctggactacctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcccaacaacgcctgggcat

SEQ ID NO: 18549 - DNA, 373 bp, Zea mays
  Clone ID: LIB189-002-Q1-E1-A2
aaatcagcacatcctatcttgtccgctgcccccgccgccccgcggttgggtcgtgtcgtgtccccacctcgtcttcgttctgctcctaccaattccagtcccagccatccgcccgcccaactatggcggcaacggctctgctactccccagcctcgcggtgctcacggacacgccgcgccgcgcccacaggttgctgcagccgcagctccagctccagcgcggctcccttgtctctcggtccctccggcctccgcggcgtcggcggctcgcggtctcggccgtgcaagagacgaacgacggggaggccaagacggccgacgagataaccgagaagtacgggctcgagttcggcctctggaaagtgttcagctc

SEQ ID NO: 18550 - DNA, 410 bp, Zea mays
  Clone ID: LIB189-002-Q1-E1-A3
agcccacgcgtccgcccacgcgtccgaacctcacaagtggaaggcatggttatcgctggctgaattctggtacaatacatcataccatacttccctggattgttctccattcaaggccttgtacggctatgatccaccatttgctgctgcccctattattccatctgatactgatcattcagtggcccaggtgttggctgagcgtgctcactttactgagatgttgaaagaccagttggctgttgctcagaacaggatgaaactcaaagcggatcgcttgcggtctgagcggcagttccaggtgggggatttggttttgctcaagttgcaaccatatgctcagcattcggtggtgaaccgaccctgtcccaagctcgcgttcacaatttttggggccatacaaagtgctg

SEQ ID NO: 18551 - DNA, 370 bp, Zea mays
  Clone ID: LIB189-002-Q1-E1-A8
agtgtacagattttgagcgtagtggccttctgtcatcttcagggagtagtgcatcgtgatttgaagccagagaattttctcttcacaacaagagatgaaagcgctcctatgaagttgattgactttggtctgtcagattttattagaccagatgaaaggctcaatgatattgttggaagtgcttattatgttgctccagaggttctacacagatcatacagtatggaagcagacatttggagtataggtgttataacatacattctgctctgtggcagtcggccattctgggcaaggacagaatctgggatcttccggtccgtattgagggctgatcccaattttgacgattcaccatggccttcagtat

SEQ ID NO: 18552 - DNA, 410 bp, Zea mays
  Clone ID: LIB189-001-Q1-E1-H1
agcccacgcgtccgcccacgcgtccggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaggacctcttcctcatctggctcgtcaccatcacctgcaccctgccgatccagtctctgttccccttcttgta

SEQ ID NO: 18553 - DNA, 404 bp, Zea mays
  Clone ID: LIB189-001-Q1-E1-F5
agatcgcccgccccatctagtcggtgtcggtgtggtgtgggggcggtgctgcgcgtgtgcgctcctctgttcggcaggactccttcaagcagaaggggcggagcagcatggcggggcgctacgacggcaaccccttcgaggaggaggacgtgaaccctttctcggaacaagcgcgcggcaaggctggcgggcagtccaacttcggcggtggtgcgttttacatgcctaacaccagaaacatgcctcctgcatccaattcgcgcctttcgccgcttcctcctgaaccagcagacttcagtgctacagtggacatacccctggactcgtcaaaggacctgaagagaagggagaaggagctgcaagcaagggaagcggaattgaacaagagggagaaggaactaaaa

SEQ ID NO: 18554 - DNA, 414 bp, Zea mays
  Clone ID: LIB189-001-Q1-E1-G1
agtgctgaccctgaaatcaaggaggaggtggtcgacagctcccttgaattcctcatccttgctagcgacggactctgggatgttgtcactaatgaggaagctgttgccatggtcaagcctatccaggacccccaggaagcagcaaacaagcttctcgaagaagcttcccgaaggggaagctccgataacatcacagttatcatcgtccgcttcatagacggaactaccggtgagaaatcaggcgacgacaaagagaccaccaacgaccaacactcctagctgtctcgtgtagggatccatcgtgctgtgtgttcttctggctgttgtacctgatgctcagagtagacgctggctgctgctccgcaaggaaactgactcccccgaccgccgttcatgctcctgcctggctggctc

SEQ ID NO: 18555 - DNA, 171 bp, Zea mays
  Clone ID: LIB189-001-Q1-E1-G10
aaaaaaaaaaaaaaaaaaaaaaaaaaaaaaaaaaaaaaaaggaaaaaaaacaaaaagataataaaaagacatacacgtaaaagcaaatatactggaacatcgtcaacgtgcattaaagttaaagtcaacggacgttcgttttacaacgtttttcaatggcaataccctggc

SEQ ID NO: 18556 - DNA, 412 bp, Zea mays
  Clone ID: LIB189-001-Q1-E1-G11
acccacgcgtccgctagaaggtaacttgtggaaggaactgtgggaggctgcaaaacctatacctgctgttgaacagactcctatatatgatgaagatttagctgtggagagcatctttgatgcgttggaggttattgagccatcaaaactgtttgagcagctacttggcgtcattctttctgtatgctttgtggcagctgaatcagttttagcagcagatagcaatctgtcaaaattattctacgattgcaaggactacataattggcgtttaccacaatgacatgtcaaaagatgagctagatgagatgtacaaggtgtacgagacgatggaagccatagtaacccaccctgaagaagctctccagatcatggagcaacctgatgagaagtctgttgacaataaaaaccgc

SEQ ID NO: 18557 - DNA, 405 bp, Zea mays
  Clone ID: LIB189-001-Q1-E1-G12
tgattgctgaagcaattgacaaagtggggcctgatggtgttctatcaattgaatcctcctcgtcttttgagaccactgttgaagttgaagaaggaatggagattgaccgcggttatatttccccacaatttgtgacaaaccttgagaaatcaattgtggagtttgagaattgtaaggttcttattactgatcagaagatcacaagcataaaggaaatccttccgattttggagaagaccacacagctgagagcccctctgttcattattgctgaggacattactggtgaagctttggcaactcttgttgttaacaagcttcgaggaattctcaatgttgcagcgattaaggctccaagttttggtgagcggcggaaggctgtacttcaggacattgccatcgtca

SEQ ID NO: 18558 - DNA, 421 bp, Zea mays
  Clone ID: LIB189-001-Q1-E1-G2
agcacatcacacttcaactcaattcccattttatataccccaaacttctttactcttcataaacccacataatcgccacaatgcccatcaccgttccccaagctaccgagctcaaggacctcttcagccttaagggcaaggtcgtcatcgtcaccggtgcctccggccccaccggtattggcacagaggctgcccgaggatgcgctgagtacggtgccgacctcgccatcacctacaactctcgcgccgagggtgccgagaagaacgcaaaggagatgagcgagaagtacggcgtcaaggtcaaggcctacaagtgccaggtcaacgagtacgctcagtgcgagaagctcgtcaaggacgtcatcaaaggactttcggaaaggtccatgtcttcatcgccaacgccggaaagactgccgac

SEQ ID NO: 18559 - DNA, 408 bp, Zea mays
  Clone ID: LIB189-001-Q1-E1-G3
agcgaccacctcgacggccggccaatatagcaacctatacagggcattctcatctcatggcgacgacggagacgatggagatgggcgtcgtcgtcgacggcgtcagtagcaacgtatcaggcggctgcggcgggctggtggtgacggagctgagccacatcaaggagctggtgaggcagctggaggtgcacctcggcggctccccggacctgtgcaagcacctggcctcgcagatcttctccctcaccgagcgctccatcggcctcatcaactcctcctccagcggcctcgacggcgcccgccggaagcgctccgcgggcgacgccggcctcgcctcgccgctctcggccacgcccaccagcggcgtcaccgacgggccgttcaagaacaccaagaagaggaaagcga

SEQ ID NO: 18560 - DNA, 391 bp, Zea mays
  Clone ID: LIB189-001-Q1-E1-G4
aagttcctcaagcaaccggagacgaagctgctggacatgctggccaagcagattcaaggcatcaaggtcatgacgaagctggacatcctctcgtcgcactcgcccgacgaggagtacatgggggagttcgcggagccgtcgtggctggcggagcccatggtgaaggcggcgttcgagaagttcggcggcaggatgaaggagatcgaggggttcatcgacgagtgcaacaacaacctggacctcaagaaccgctgcggcgccgggatcgtgccgtacgagctgctcaagcccttctccaagccgggagtcaccgggaggggcatccccaacagcatctccatctgatccatcctcagcatgcattagtccaattaattaaatcgggggttgt

SEQ ID NO: 18561 - DNA, 413 bp, Zea mays
  Clone ID: LIB189-001-Q1-E1-G5
agggccgtggagaaggtggccaagcgcatcatgggcaaggaggtgaacaccgcggctgcctccggggagaagacgccgtgggtgccggacccggtcaccggctactaccgcccggcgggtggcgccaaggaggtggacgcggcggagcttcgcgccaggctgctcaccaagaggatcgccaactaaatcaatctagcagcagagcagtgcggctgagattatttagcgccagttgatctcttgggcctagagcatgacggtgctgtaacttttgaggcataatatatatagatagatagatgggaagagctcgaacgtatctccgtttctagaaagaatggcgcaattcttgctttgctttttaacgagtcaatttgtcttgactttaccatattgtatacgaaaatgtacta

SEQ ID NO: 18562 - DNA, 412 bp, Zea mays
  Clone ID: LIB189-001-Q1-E1-G6
agcccacgcgtccgcccacgcgtccgcccacgcgtccgggcgtccccagccgttcatgaaccccataaatggcctatattctcagccgtctatttgcacctctgtcagttaaggtcattgcgttatcgaagacctgcaatattttgggagatggacctttgcctttgcctttgcttagaggattggtatttggtagcagagattttctctatccaagtgagttgtgagcagcgagcatttagtcaaactgtacaaaagttttccgggataccctttttgtaataaaagaaactgatgtattccgcagtagctgtagcgctggatataatgttcctttgtatgttatatatgacagaatcatagggaaataacagatgtaaagttaatccaaaaaacaaagaaagaaagtggg

SEQ ID NO: 18563 - DNA, 412 bp, Zea mays
  Clone ID: LIB189-001-Q1-E1-G7
aggccgccggcggcacggcgaagcacacccgcacggtaaccaacgtcgggcagcccgggacgtacaaggtggccgcgagcgccgccgccgccggcaccccggtgacggtgaccgtggagccgtcgacgctgagcttcagcagggccggcgagaagcagagctacacggtgagcttcacggcgggcgggatgccgtcgggcaccaacgggttcgggcggctcgtctggtccagcgaccaccacgtggtcgccagcccgatcgcggcgacgtggacctaatggctagcggcggccgtaccgtagcaatagcgagataaaatcccgattgggggacggcaatggcgagcgcgcgccattctcgaatgcgagagagatggcggatatcgtcgaggatgtgctgttgtattgtgtgc

SEQ ID NO: 18564 - DNA, 344 bp, Zea mays
  Clone ID: LIB189-001-Q1-E1-G9
aagttatctgtccgccaagataatttgaatgattcaggggatggtggaagagccccagtattcaaatggttctccgtattagaatttggtgggttaatcatctcttgcttctatggattaagtcaccactatgatctttcgtctgttgggtgtgacaacgatctcctaacccatctatatctgagactactcagagcactatatattctcacatttgagaatgccgatcaatatctgagacagtacacacattcatgtatacatgtgtcatatccacattagaaatatatattatgtttccattagtcacctcagagagtcttgcccaggagcttgttcagatg

SEQ ID NO: 18565 - DNA, 385 bp, Zea mays
  Clone ID: LIB189-001-Q1-E1-F4
ccgggctcaaccaacgcgtcaggatgttttgaaccaaccaacccaatcaacggaaattgataacttcctggaggtggttgacctgtggcggataaggtcggtaaacccggggttggggggcaaaaccttaaccaaaagtcaattaaagaaaattgcaaaactgaaaaggtaatgtgcaaaaaagggagtgaaccccgggattgaggttgatggtggtgttggtccgaaaaatgcctacaaggttattgaagctggcgcaaatgccattgtcgcaagttctgcagtttttggggctccagactacgctgaagctatcaaaggaataaagaccagccaaagacctctagctgtagccgcataaagagctggacgtgtaatcatttac

SEQ ID NO: 18566 - DNA, 413 bp, Zea mays
  Clone ID: LIB189-001-Q1-E1-E1
gcggcagtgggaaaataccgcaccgcacgcaccaatggagaacgccaacgcctcctcttgccgcaacggcgacggcacccagacgccaccgccgcacgtggcgatgcttgcgacgcccgggatgggccacctgatcccgctggcggagctggcgaagcgcctggcccagcgccacggcgtcacgtccacgctcatcacgttcgcgtccacggcgtccgccacgcagcgcgcgttcctcgcctcgatgccgcccgccgtcgcgtccatggcgctgccgccggtggacatgtccgacctcccgcgcgacgccgccatcgagacgctcatgtccgaagagtgcgtgcgcgccgtgccggcgctcaccgaagcgctcctgagcctcaagcagcggcccaccacgaccggccgtctcg

SEQ ID NO: 18567 - DNA, 219 bp, Zea mays
  Clone ID: LIB189-001-Q1-E1-E10
cgggtcgaccacgcgtccacccaagcgtccgctgacgcgtgggcggacgcgtgggcagagccagtgcctacaccgaggcctgaacctaagaccgaacctatgccagagcctaagcctgaatctaagataagttcagagctaaagcctgaacgaaaaccagagcctatgccatagcatagacctgaggcagtgccagagcccaaagctagaccgttccca

SEQ ID NO: 18568 - DNA, 387 bp, Zea mays
  unsure at all n locations
  Clone ID: LIB189-001-Q1-E1-E11
acgcaaccctgatgtatgggacgaccctcttcgcttcgaccccgaacgccacatccctttgagccccgagatggaggtctcactcgttgagcgtgatctacggtttatctccttcagcactggtcgtcgcggctgcatcgctgcagctcttggcactgatatgaccatcatgctcttcgctaggctcctgcaggggttctcttggagcaagatgaccggggtggcggccatcgaccttagcgagtccaggcacaacactttcatggcacgggcactcgtgctacaggctaagccacggcttccagcgcacctctaccccgggatcttgctttgtaagtagtcncaaataacggctgagcatgtagaaaatttcaccacttatacatg

SEQ ID NO: 18569 - DNA, 413 bp, Zea mays
  unsure at all n locations
  Clone ID: LIB189-001-Q1-E1-E2
cggacgcgtggggtgggccacgccctggtcccgcactgccgagaacttcgctaacttcaccggcgagcagggctacccgggcggcaagttcttcgacccgctcggcctcgccggcaccgtcaaggacggcgtctacatccccgacgtcgacaagctcgagcggctcaagctggccgagatcaagcacgcccgcatcgccatgcttgccatgctcgccttctacttcgaggccgggcagggcaagacgccgctcggcgcgctcggcctatgatttgcatgctgccggcgaacgagtcagttctcgattgcgtggggtgggtgagctcctagggacgtacggctgcagcggatcagacgccttgcctcgcagattggaggcganagaagagcgtagcagcaatctactgtctgtg

SEQ ID NO: 18570 - DNA, 413 bp, Zea mays
  unsure at all n locations
  Clone ID: LIB189-001-Q1-E1-E3
agcgaacgcgtgggcggacgcgtgggttgaagaactcatcacatgtcttaaataatgcactagtagtattttaattaactattgtgcggttggagctaaacaagagaaaagctaccagcatggtggccaaaggaacagatatgttgtcatctacaacttcggtcacaggaacgcactccactactgtcgctgctagtgcaacaaacgccagcttaccaagtgcctcttcccagataacatcaatgtaacccaggcttgagaagtagagcatcatcatcgcggacagcaggaaaccagaaatgaacatcgagatgctcccggcccagctcttcttccgattgaatggcagcttcgctgagccatacctcctcccaacaatgtcagcanaaccatcgccaccgctcatcatcgac

SEQ ID NO: 18571 - DNA, 349 bp, Zea mays
  Clone ID: LIB189-001-Q1-E1-E4
tgcggtcaagcaatcaaccccgtatgatacaaccgtgctgccgaaggtgtaattacccagttgtttttgacatgccaattgctgagttctgacttggcaaggttgagcataagtctttcttcatttgggagttatcacagagccagtttggcagtgctgtagttttggttttacctactctttgtagaagaaaagtgaagagtggatattatggaacaaaatatatacctacggcagcacgcagcatgatgaaacatatttaaaaaatttgggtgctctaccacatgcccgtggaataaaacggatgtaaactcagtgcaaaaaaaaaaaaaaaaaaaaaaaacaaaaa

SEQ ID NO: 18572 - DNA, 411 bp, Zea mays
  unsure at all n locations
  Clone ID: LIB189-001-Q1-E1-E5
aggctcccgcaacgacagcgcgcacttggattcggcgaccaccggagcgcggaggaggcacaggcgccgatctaaagacgatggccgccgcgggctcctcgccgtccttctcctcctcgagtaagcgactggaagggaaggtggccctcgtcactggtggcgccaccggcatcggcgaggccatcgttcgcctcttcatggagcacggcgccaaggtctgcatcgcggacatccaggatgaggccgggcagcagctgcgcgacgccctgngaggtgacgcgcagggcgccatgttcgtccactgcgacgtgacgtcggaggaggacgtgagccgcgccgtggacgctgcggcggagcggttcggcgcactggacgtgatggtgaacaacgccggcgtgacgggcgccaagg

SEQ ID NO: 18573 - DNA, 410 bp, Zea mays
  Clone ID: LIB189-001-Q1-E1-E6
aaggaagtttggtttgctagcgaactggcagcgggactacacgatggagaacatcctcacccagctcaagaaagagatggctgcctcgcagaatcgaaagttagtgcagcctccagaagggacattcttctaacgaagtgttcacttggcccgtcatgggatccaacagtaattgaaagttttatgggctaaaaaacagcgtctacatctggtgcccctgcctgtctttgtgattttttatgacttttatgttcttgtatcgtgaaccgcagtgaacaacggttgttgcaagttccagggatatctttggaagtggtaaacaaatgcgtcttatttctatgtaatattagaccccgtgcgtgtgtggtttcgaggtacagctccctatcaactgttgccgtgcattccgt

SEQ ID NO: 18574 - DNA, 400 bp, Zea mays
  Clone ID: LIB189-001-Q1-E1-E7
agcacctctcggtttcgggaaacctctcccccgttcccctcgaagcctacgggctcggggggcttcgatcgaatcgaatcggatcggatcggaagcatggagatctcgctcgaggcgtcgtgggtgggcgtgcagcggcacgggcaggacctggcggaccgcctcgcgcagggcttctcggggctcctcctccacgcgcagccgccgcagctgcccccatggtcgccggcggcgctgttgccgcccaagctcgtcatccccttcgacctcgacctccccgttgtccccttcgtcgccgggatgcgccgcggggtcgggaccgtggacctccccgccgtggccgtctcgtcgctcgtcgagatcggcggcaggctcgggcaagcggggtccgagctcggtg

SEQ ID NO: 18575 - DNA, 388 bp, Zea mays
  Clone ID: LIB189-001-Q1-E1-E8
ctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcggagcctcaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaagtgctgaccaaggccgggctgatcaacgcg

SEQ ID NO: 18576 - DNA, 411 bp, Zea mays
  unsure at all n locations
  Clone ID: LIB189-001-Q1-E1-F1
cgccgcggcccgtgcgcttcggtatcctgggctgcgccgccatcgcgcgaaagctggcacgcgccatgctgctcgcgcccggcgcagccgtcgccgccgtcgggagccgctccgaagtgaaggcccgcctcttcgccgccgacaacggcctcgacgtcgccaccacccgcctccacggctcgtacgatgcgctcctcgacgacccggacatcgacgccgtctacatgccgctccccaccagcctccacgtgcgctgggctaccgcagccgccgcacgtggcaagcacgtgctcctagagaagcccacggcgctgtgcgccgccgacctcgacaccatcctcgcggcttgcgacaccgcgggggtccagttcatggactccaccatgtggatgcnacacccgcgcaccgcca

SEQ ID NO: 18577 - DNA, 222 bp, Zea mays
  Clone ID: LIB189-001-Q1-E1-F10
ccacgcgtcaacggacgcgtgggtgcggactggttccaattatcaggtcagcgacagtgcacagtttacataattgctgactcaaggtgagctaacaggtcaatcatgggcgaaagatgtacaagtgacgaatgaacgcgtcagtcagatcataatgcatatgagtcctgaccacacggcgatccagttcatgtgggtttgggaagagttcttctacatcat

SEQ ID NO: 18578 - DNA, 400 bp, Zea mays
  Clone ID: LIB189-001-Q1-E1-F11
acttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcatgcgacggcgggctcgtcttcgagcccagccagttcaccgtcaaggccggcgacaccatcaccttcaagaacaacgccggcttcccgcacaacgtcgtgttcgacgaagacgaggtgccgagcggcgtccacgcctccaaga

SEQ ID NO: 18579 - DNA, 418 bp, Zea mays
  Clone ID: LIB189-001-Q1-E1-F2
cccacgcgtccgcggacgcgtgggtgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgccgagaacaagttcatctgcccatgccacggatcccagtacaacaaccagggcaaggtggtccgtggaccggcgcctctgtcgctggccctggttcacgccgacgtcgacgacggcaaagtcctcttcgtcccgtgggtggagaccgacttcaggaccggcgaggac

SEQ ID NO: 18580 - DNA, 391 bp, Zea mays
  unsure at all n locations
  Clone ID: LIB189-001-Q1-E1-D9
acccacgcgtccgaaagcgcgcgcgcgcacgcggagaggctcggagagctgagtgagatggcacaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctcnccttgaaggagcggttctacctgcagccgctgccgc

SEQ ID NO: 18581 - DNA, 410 bp, Zea mays
  Clone ID: LIB189-001-Q1-E1-C3
agagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtcctcctttctgttcgatgcaaggacaacaatgctgcacatgccagtgaagctctgcgtcgcgccaagttcaagttccctggccgccaaaagattattgagagcagaaagtggggcttcaccaagttcagccgtgccgactacctgaagtacaagagtgagggtagaattgttcctgatg

SEQ ID NO: 18582 - DNA, 405 bp, Zea mays
  Clone ID: LIB189-001-Q1-E1-C5
aggtccaagctctcccgccctgacctcaagcaggtctgggctatcgcggacaccagaaggcaggggtatctgggtttctctgaattcgtcacggcgatgcagctagtctctctggcacaagcaggcaacgagattactcaagatagccttaagcgagatgatttgagcagtttgaatccacctgtgatggaaggtttggatgccctacttgcgaaatctaagcatttggtgaagcgtgttgatccagaaatggatggatatcctcaggaacaatctcctttaacaaacaaatggtttagctcaaagtcatcaaagaagatacctctgactgccgtcacttctgttatcgatggcttgaaaaaactttatatcgaaaagttgaagcctttggaagttacatacaag

SEQ ID NO: 18583 - DNA, 411 bp, Zea mays
  unsure at all n locations
  Clone ID: LIB189-001-Q1-E1-C6
agacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcngcggccgtcggcgccggcggctacgtattcgacgag

SEQ ID NO: 18584 - DNA, 410 bp, Zea mays
  Clone ID: LIB189-001-Q1-E1-C7
agcccacgcgtccgcccacgcgtccgcggacgcgtgggcgcgcccccgctccggaactacttcctcggtgatcgccacaaccggttcctctgcccgcgccgcacgcccgtcaggcaccgcgcctcggacgccgacagggtcgcgtgcctcgcgtgtgatctcgacgagatctactccgcggccttcaacggggaccgcacgccatacagccccgccaagtttctatatagttggtggcagcatgcatcaaaccttgcaagttacgagcaacaggatgctcatgaattctttatttccatccttgatcatatccatgaaaatataaaggatgatcaacaaaagtcatatgcccaaggccatggggattgttgcattgctcacagagtgttttctggtatcctgaggtcaga

SEQ ID NO: 18585 - DNA, 418 bp, Zea mays
  Clone ID: LIB189-001-Q1-E1-C8
agcccacgcgtccgcccacgcgtccggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccatt

SEQ ID NO: 18586 - DNA, 382 bp, Zea mays
  Clone ID: LIB189-001-Q1-E1-C9
aggatagtggtcgacagcactatctgtgatgcggcgatattggggtccactctcatcggagagttcgaggatgtcaagcagctgaacgaccgtcgtacagagaagaacaaggaaactgagtgggacgtgcgtatcgacgtggaggccgctagcggtcggttcagagcacttttcctctagcctgagctccagtgggacttcatgctgcctctggtgaagaggatcaatgtcagcgggcacaagtacggcctcgtctagcctggtgttggctgggtcatctggcggagcaaggatgatctgcctgaggagctcatcttccatatcaactacctggggacggaccagcctacgttcacgctcaacttctccaaaggttcctgtc

SEQ ID NO: 18587 - DNA, 413 bp, Zea mays
  unsure at all n locations
  Clone ID: LIB189-001-Q1-E1-D10
acccacgcgtccgctgtttgctttcggatttcagcattttctggggtcgtatgacttcaaaagcaagacacatcaagatgcgtgctgccctgagggtatgtgcagggctgcagtgtttgcgctgcatgtaaaggaagagctgaactcatggcctgagcagagcacccggcagaggacctgactcacggttcctgaagctgcatccacgtgccggtaccagtggatggaagaggccttgctcacaggcttctctgactggcacgacaagtggagcataggtgacggcggtggcggcggtgccaactgtgtgacccggcctaactgctgatgaacccatctgcagtcgtccaatttgtccatcctcncccatttcccctaagctccgacattgcgtaacgcaataaatacagtgt

SEQ ID NO: 18588 - DNA, 411 bp, Zea mays
  Clone ID: LIB189-001-Q1-E1-D12
cgccgctgcctactccccatggcctcagcgaacaacgacgaccgcgaggcggcgggcatcctgcggctgctgatggggatggcagcggcggcggcgcccgcctcggcattgcctcggggcggcggcggcggcctgatgatggtgcagcacgtcatcctcgacgtcaacggggaactgttctcgggcggggtcggcggcggcggcgtgccgccggcgtcgaaggccgcgatcgccgcgctgaaggaggtgaaggccggggagggcgaggacgcgcttggcgagtgcgccatctgcctggacgcggtggagggcaccggcaaggagatgccgtgcgggcactgcttccacgggcgctgcctggagcggtggctcggcgtgcacggcaactgccccgtctgccgccgcgagctg

SEQ ID NO: 18589 - DNA, 415 bp, Zea mays
  Clone ID: LIB189-001-Q1-E1-D2
agggttgcattcgatcagaccgtttggtctgcaatctggaacagtatctacttcgtggtcttaggtttccttcggttggaatcacctaccactatctacagtgaactcaagtctacattctggcccatgcttaccgctggatggaagttgtggccttttgcacacttaattacatatggtgtggttcctgttgagcaaagacttctatgggtcgactgtgtggagcttgtctgggtcacaatattgtcgacgtactcaaacgaaaagtcagaggcaaggaattctgatagcacctccacaccagatgcttcaaaggacaactccagatagcagccctagagaccttggagagctgattcgtccttccatcgcttcagtttatgtaaattgtacaattagctgcagcaactctgca

SEQ ID NO: 18590 - DNA, 448 bp, Zea mays
  unsure at all n locations
  Clone ID: LIB189-001-Q1-E1-D4
cggtctagtaatccggctcgccncacgcgtcaggctgaagtggtggcacaagatgagaaggaaagtggccttcgagcaacactaaacctgggtcacacatttggccatgctattgagactgggacaggatatggagcatggctccatggggaggctgtcgcagctggaacagttatggcaactgacatgtctcaccgcctggggtggatagatgactccatcagaaaacgtgtggttgacatactaaagcaagccaaacttcccattgcacctcctgagaccatgaccgtagagaagtttaaaaacatcatggctgttgacaagaaggttgctgatggtctgttgagactcatccttctgaaaggaccgctanggtgctgtgtatttacgggggattatgacgggaatgcactcgatgaaacctacatgcattctgcgacaactgaga

SEQ ID NO: 18591 - DNA, 405 bp, Zea mays
  Clone ID: LIB189-001-Q1-E1-D5
gctcgatctccatctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgc

SEQ ID NO: 18592 - DNA, 395 bp, Zea mays
  unsure at all n locations
  Clone ID: LIB189-001-Q1-E1-D6
agtgaaggtggaactttgactgaagcagtccggagaacaccattcactgtagtcttgcttgatgaaatagagaaagctcatccagatattttcaacattcttctccaagtatttgaagatggacacctgacagactcacaaggacgcagagtttccttcaaaaatacgttgattgtcatgacatcaaatgttggttcaacatcaatctcaagcggaaggaggagtataggtttctcaacacaaagggatacagaggagaccacctatgctgcgatgaaatcacttgtgatggaagagctgaaggcattttttcggcctgaattgctcaatagattggatgaagtggttgtattccaccctcttgaaaaganccagatgatggctattctcaacct

SEQ ID NO: 18593 - DNA, 405 bp, Zea mays
  unsure at all n locations
  Clone ID: LIB189-001-Q1-E1-D7
agtttatttccttgctagattgagacatgtagaaaagttgagaatgcgctgaggcgggtggacaggaaggcctcgcagatcaaagttctccccttccatgctgcgctggatcaggcccagcgcatcgcaaacatcaaggagttcctgaacaagcaaacggctgactccatgttccttgtgtgcacagatagggcgtcgcggggcatcgactttgcgaacgtgaaccacgtggtgctcttcgactacccccgcgacccgagcgagtacgtgcggcgcgtcgggcggactgcccgcggcgcgtccggcaacggcaaggcgttcgtgttcgcggtgggcaagcaagtgtcnctggccaggagggtgatggagaggaacatgaaggggcaaccgctgcacgacgtgccg

SEQ ID NO: 18594 - DNA, 417 bp, Zea mays
  unsure at all n locations
  Clone ID: LIB189-001-Q1-E1-C2
gccacagggctgggccaaccagtcccgatcgatcagccagcatggcgtcctcctccaaacggtcgctgccatgcgtgctcctcctcctcctcctcgctgtcttccaccacggctgctcgtcggcgagggcccacagacgtgccggcgacatggaggggagcatgagcaccgacgacagctcgatgatagagcggttccagcggtggaaggcggcgtacaacaagtcctacgccacggtcgccgaggagcggcggcggttccgggtgtacgcgcgcaacatggcgtacatcgaggccaccaacgccgaggccgaggcggcggggctcacgtacgagctcggcgagacggcctacaccgaccttcacaaccangagtttcatggcatgtacacggcgcccgcgccggcgcagctgcccg

SEQ ID NO: 18595 - DNA, 408 bp, Zea mays
  Clone ID: LIB189-001-Q1-E1-B10
agcaatctctagcagcagatcctcgtgcgaagcaaagcgctagcccccttcgtactgtcccgatggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgtcgggctcttcgagggacacaacctctgcgccattcacgcca

SEQ ID NO: 18596 - DNA, 417 bp, Zea mays
  Clone ID: LIB189-001-Q1-E1-B12
acgaattgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagag

SEQ ID NO: 18597 - DNA, 417 bp, Zea mays
  unsure at all n locations
  Clone ID: LIB189-001-Q1-E1-B2
agtcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacagcggccacggcttcgtggtgcgcgagaccagggtcgaagaggacatcaacacctgcaccggcgaggtccacgagcgcagggagagcttcctcgccagggctaactgagccgcncggcggccggcatccacgcccgttcgtgcttgcctgcgtgccttatgtatgtct

SEQ ID NO: 18598 - DNA, 407 bp, Zea mays
  Clone ID: LIB189-001-Q1-E1-B3
agcaggcccaagggatacacgtcccggtgcccccaccaccaccacctctcgttcattatccttggtcttcacctccaccaacacctacatctccacctaccgaacatcagacccctccagctaccttgccaacgcatgaacgagaagacgggttagactttgttgaaaccctcttcactagtggaggtatcgaccatcactcgtcactgtaacctgatggtgatcggcgaccgtgagctttcatgttattgtgttttgatacttgagacatttattatgactatgtatgtgatattgtctcttattagtactggatgagatgtgtcttattatgactatggatgagacttttatgatgtaattgatgagactatggatttaaatattgttatgtgattgtgtgtgag

SEQ ID NO: 18599 - DNA, 415 bp, Zea mays
  Clone ID: LIB189-001-Q1-E1-B4
cagccaagaggcaagaggcaagaggtccctcagtcgctaggcgctagctcccggcttaactagtaggcagccatgaatttcggtgggaatagcaacgcgacgatccggtgcaagtactgcagggcgagcctgagcgtgatccccggcgagcgcgccatccagtgcgcgcaatgcaactgcgtgacgcgcatccggcgggccgaccgcatcccgctggcgcggccggcgcacgtgccgccggcgttccagcgcgcccggggcaagaagcgcgccgtcctggtcggcatcacgtacgccggcatgcgccaaggctgtggcgacctgaggggccccgtcaacgacgtcaagtgcatgaggaacctcctctgccagcgcttcggcttccccggcgaatgcatcatcatgctcactgacg

SEQ ID NO: 18600 - DNA, 396 bp, Zea mays
  Clone ID: LIB189-001-Q1-E1-B5
atacccgtggaagatgcgtacgagtttgcaaggcttataccaaaccacaagctgcgtgtcatcgagggagcaaatcactgctacactgctcaccgtagagaactttctgatgccgtagtagaagccatcacatccagtgaggcaggggagaccacaacctagatctgatgcagaacggcagcctgcctttccaatcctgcaatgccgctcttccatctcagtcacattgccttatcacaatttttaaaagaaaacgagttctttgaaaatatcgtttgaatctagacgttgttaactcgttgtatcatgacatccttaatgctacgtttggacgttgatattggagagtatgaaattgaattgggttgaatatcaaatcagacatgatagtgaaaa

SEQ ID NO: 18601 - DNA, 404 bp, Zea mays
  Clone ID: LIB189-001-Q1-E1-B6
gaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacac

SEQ ID NO: 18602 - DNA, 415 bp, Zea mays
  Clone ID: LIB189-001-Q1-E1-B8
agaactttttatgctggaaaagcgggtgtgccagttactgaggtgaatgttcctgttgttggaggccatgcgggtattactattctgccactcttctcgcaggccactcctgcaagcaattcgttgtcccaagaagacattgaggccctcaccaagaggacacaagatggtgggacagaggtggttgaagcaaaggcgggaaaaggctctgcaacgttgtccatggcatatgctggtgctgtttttgcagatgcatgtttgaagggtctgaatggagttccagacattgtagagtgctcttttgtgcaatcaactgtgacagagttgccattctttgcctccaaggttcggctcggcaagaatggagtggaggaagtgcttggtctgggtgagctcaacgagttcgagaagaagg

SEQ ID NO: 18603 - DNA, 396 bp, Zea mays
  Clone ID: LIB189-001-Q1-E1-B9
acggaagcgtgggcggacgcgtgggcggtgcgttgcgttggtggccgccggcgacgatgtcgtcgtccgcgggcgacaagaggaagaagacggcgtgcgtgaccggagggaacgggtacatcggctccgcgctcatcaagatgctgctggaggacggatacgccgtcaagacgacggtcaggaaccccgacgacatggacaagaactcccacctcaagggcctgcagcagctcgggccgctgacggttctccgcgccgacatggacgaggagggcagcttcgacgacgccgtcgccggctgcgactacgccttcctcgtcgccgccccggtgaacctctcggcacaggatccagagaaagagcagatcgagccgtccgtccgaggcacgctgaacg

SEQ ID NO: 18604 - DNA, 410 bp, Zea mays
  Clone ID: LIB189-001-Q1-E1-C1
agcggacgcgtgggcgcgccaccaccaccacctcctagctagcatgagtacacggatacacccttcgtcctcggacgcggccggccgtgcccgtcttcgggctgcggaggaacgggaacgggaacgccggccggcggtgtacacggtgtggaagaggtccagcatgggattccagggcaccgacggcttctgcgtgtacgacgacgccggcgggctcgcgttccgcgtcgacaactactcccgccgccgcaagctctgcgccggcgagctgctgctcatggatggcacgggcacgcctctcctctccctcaggccacagcttctcagcctgcacgaccgatggaactgctacacagcgacggaagacgccgccgtcgacaagaaggccacgtcgccggcgcagcagcaag

SEQ ID NO: 18605 - DNA, 391 bp, Zea mays
  Clone ID: LIB189-001-Q1-E1-C11
aacggacgcgtgggcggacgcgtgggagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggccgtggcggctacggcggtggcggcggctacggtggcggcggcggctacggtggtggtggcggcggctacggcggtggcaaccgtggccggcgctacggcaactccgacgggaactggaggaactgagcggtgggg

SEQ ID NO: 18606 - DNA, 411 bp, Zea mays
  unsure at all n locations
  Clone ID: LIB189-001-Q1-E1-C12
gaatgatttgagaaaccacaatatggatgttgtctcatgcgattccttcacagagaaccagctcctgcttgcagagatgttgctgaaggatccctacctactcgaaaccacgaaggcgatcaccgggttccacgtcccagccagcgcagctcaggttaacacggggaaatggctagacgaaggcaacagggttctttcagacatcgggcgcgaagtgatcagaaggaaaggcaagcgaatggaggcgatggtggatgtcagcgcgacacgtgccgctaacctgaagctgcggactctggacgatctggtcagggaactggacagcgacatccagtctctccacgtcncgaggaaaattcagcaacggggggatgaccacagcacagctgagaacctgaggatggtcctccg

SEQ ID NO: 18607 - DNA, 372 bp, Zea mays
  Clone ID: LIB189-001-Q1-E1-A9
acccacgcgtccgcccacgcgtccgatatcacgtacgccggcaccgggtccgccatcgagtacgccgtgtgcgcgctcaaggtgcaggtcatcgtggtcattggccacagctgctgcagtggcatcagggcgctcctctccctcaaggtcggcgcgcccgacaacttccacttcgtggaggactgggtcaggatcagcagccctgccaataccaaggtgaagagagagcacgcatcggtgccgttcgatgaccagtgctccatcctgcagaaggaggccgtgaacgtgtcgctccagaacctcaacagctaccccttcgtcaatgaagggctggccggcgggacgctcaagctggttggcgcccactacgac

SEQ ID NO: 18608 - DNA, 406 bp, Zea mays
  Clone ID: LIB189-001-Q1-E1-A1
aggtccatcgggtgcgagccgtgcaccaggcccgtcctgccagggcagcacgagcgtgaaggccggaggtggtgggaggacgccaaggccaaggagtgcggcctccacaagggcaacatcgacaaggacgcccaggcggcggcccccaggtccgccaacggcaacggctcggcgggcgccccggacatcttcgagagccccgccgtcgtgtccctcacccgcaccgggatccagaacctgctgcgcctggagaaccgcgccgagccgtggctcgtggtgctgtacgcgccctggtgcccgttctgccaggccatggaggcctcctacgtggagctggccgagaagctggcggggtccggggtgaaggtggccaagttccgcgcggacggcgagcagaagccgtttg

SEQ ID NO: 18609 - DNA, 413 bp, Zea mays
  Clone ID: LIB189-001-Q1-E1-A10
acccacgcgtccgccgctcttctgggggatcaccgccgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaagggtctactgtcctgacggcgctgcactgatctatcatcatcaggcggaggcgatgcgatgatgatgcagaactttgtacatgcgttggtggatggtggtgtaacatagtggctgccaacaagtcatgctcatgcaaaccgatgaatctatctctgtatcatcgatctcggttgcttg

SEQ ID NO: 18610 - DNA, 382 bp, Zea mays
  Clone ID: LIB189-001-Q1-E1-A11
cgatcgacccaggatacttgccaagaggcggcccacgcgtccgcccacgcgtccgtgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtccgaggtggaggcgacgcagaacctcaacgccatgaaccaggggcccaacccgtggcacgtgtccttctcctacgcgcgggcgctgcagaacacctgcctcaagacctggggcggccagccggacaacgtcaaagctgcgcaggacgcactgctgctgctcgccacggccaactccctggcgc

SEQ ID NO: 18611 - DNA, 406 bp, Zea mays
  Clone ID: LIB189-001-Q1-E1-A12
acccacgcgtccgcccacgcgtccgggcacagatgtaaaagtatggtttggaaaggttgaagatctgccagtttacttcttgggaccacaaaatggcatgttttgggttggatgtgtctatgggaagaatgatgatagtagatttggcttcttctgtcattctgctctggagtttctgctccaaagaggatcttctcctgatatcatacattgtcatgactggtcaagtgctctcgttgcttggctatacaaggaacagtatgctcttaatgggatgggaaatggtcggattgtatttaccatccacaatcttgagtttggagcgcatcacattggcaacgcaatggcacattgtgacaaggctacaactgtctctgatacatattcaaaggaagtggctggacac

SEQ ID NO: 18612 - DNA, 389 bp, Zea mays
  unsure at all n locations
  Clone ID: LIB189-001-Q1-E1-A2
aggcatccaccaaattaaaccgccggcgcctccacttcgcgttctcgcctcatctcctcccgctcaggatccggcggcgaaggtaaggcaagatgtacaccgcgaggaagaagatccagaaggataagggccttgagccctccgagttcgaggactccgtcgcccaggctttcttcgacctggagaacggtaaccaggagctcaagagcgacctcaaggacctttacatcaacggtgctatccagctggatgttgccgggagcaggaaggctgttgtgatccacgtcccataccgcttgcgtaaggccttcaagaagatccatgtcangatcgtcanggagctggagaagaaattcagcggcaaagatgtggtaattgttgccacaaag

SEQ ID NO: 18613 - DNA, 410 bp, Zea mays
  Clone ID: LIB189-001-Q1-E1-A3
cccacgcgtccggcatccagctcatcaaagttgtactcgctgtggtctgtgggagctttctccatttgcatccaaattaatgccttgatgttactaccttctacgtttacattacagtactttgggtgctgctgctttgacccatcctcggctttgtatcctcctcctgtcctccatatcgcttttgccgaaatgacgatgacgacggggctatgtgcatacaaaataaacatgttttaagatggggaaaaaagctatagatacctagccttgagggctagtttggcaacaccattttctcaaaggaaataaactaatttcttttaagaaaatgaaaattatttggaaagacgaggatgtcaaagtagccctaaatattagattcctccgctggcactggcaggcagcta

SEQ ID NO: 18614 - DNA, 409 bp, Zea mays
  unsure at all n locations
  Clone ID: LIB189-001-Q1-E1-A4
aaccttgacaggctgaggacccctgtggacaatgcccttagagatgcanagttgcaattcanagatattgatgaggttattcttgttggtggctcaactagaataccagctgttcaagagcttgtcaagaaaatgacaggaaaggaccccaatgtgacagtcaaccctgatgaggttgttgcacttggagcagctgtgcangctggagttctgtctggtgatgttagcgacattgtacttcttgatgtgacccccttgtccctaggtttggagacactgggtggtgtcatgaccaagattatcccacggaatacaaccttgcctacctcaaagtcggaagttttctcaacagcagctgatggccagactagtgtggagatcaatgttctccaangagaaagagagtttg

SEQ ID NO: 18615 - DNA, 390 bp, Zea mays
  Clone ID: LIB189-001-Q1-E1-A5
gagatcacgtcgcaagaacctgaacagaggtaattgggaaattacccttccccttcttccaaccaagcccttactatatcgggagttggaatttatactgcgcagtggcggacgcggacacgatggcgctggacgacatgcagcgcgacgaggtgttcaacagggacaacatcccgacgtggctgtcctacgcggggtacgccgcgctgagcctgatcgcggtgatcgccatcccgatcatgttccgggaggtgaggtggtactacgtggtggtggcgtacgcgctggcgccggcgctggggttctgcaacgcgtacgggaccgggctgacggacatgaacatggggtacaactacgggaagatcgcgctgttcgtgctggcggcgtggg

SEQ ID NO: 18616 - DNA, 415 bp, Zea mays
  unsure at all n locations
  Clone ID: LIB189-001-Q1-E1-A6
agcccacgcgtccgggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatcnccccggagaccgcgctgccgtggttcaagacgggcgtcatcc

SEQ ID NO: 18617 - DNA, 102 bp, Zea mays
  Clone ID: LIB189-001-Q1-E1-A7
agaaaataaataaaaaaagaaaaaaaataaaaaaaaaaaagaaaaaaaaaataagataaaaaaaaaaaaaataaaatataataaaaaaaagagataaaatgg

SEQ ID NO: 18618 - DNA, 409 bp, Zea mays
  Clone ID: LIB189-001-Q1-E1-A8
aggattgacgagacagagattcaggcagcgaagtggatggcgctggaggagttcgtgaagcagcccttcatccaggaagaccacatgttccagaagatcatggacatctgcatccagcgcctccgcaagtgctactgtgggctgacgccgcaccacgtcgtctccaagttcgacgacagaacgtccacgctctactacaatgtcgccgagcccgaggacgtgaactgcagcgccgcctgatgtaatatgatgtgagggggagggggagccaccccagcatctactagtctaatttttgctgcgcagaagtttcatgatgcagcagtgttagtcgtgcgattactgagagtgaaatactagtggcagactgcgcgaggcaatagagttgccgagcctgtacatatacgtg

SEQ ID NO: 18619 - DNA, 331 bp, Zea mays
  Clone ID: LIB189-001-Q1-E1-B1
gatcacatcaaacagattaaatatcatcagtgcaggagtgccatcttgatcacagtcaacacatagtattaagaaaatgggcatggtaacagcctaacacatggcagttccttcacaggaatttccacgaacacaaggcacacgccagcaaatcgaccaactacacccgaagtttccaactaacagcatagaggaattgatcaacagaacagcgacgccccttttagagatggaaagggggttagggttttaaacgttcctggtcgccgccctggccaccgggggctcacttggccagcatctgcgcggtagccgcctcctgctgctgctg

SEQ ID NO: 18620 - DNA, 332 bp, Zea mays
  Clone ID: LIB189-001-Q1-E1-B11
tttgaaagcaaagaattattaatgtctcttatttatctcatctggtcagctgattcgacccttcactagcaaaatgtatgcaagatgaaaccgttctcaagaattttcaagacgaaggtgaatacatcatacacaagagaggggtgaagtttcagttatacaagacttcttcatctagtttctttaagtacaacagatcacttccattccttcctcctacaccaaaagccatgtttcccacgtacgacgactgcccaactcgccagcagcgatgtgcaagcacaggtgcagcagctactaatagccgatgtccttgtcgtcgaacacgaagt

SEQ ID NO: 18621 - DNA, 407 bp, Zea mays
  Clone ID: LIB189-001-Q1-E1-B7
tagggataagggctatgacggtattgtgctcgagtcctggtcaagatgggctatttatggtgtgctggatgaccaagagctacgttacatggcacttgaatttgttaagcagctgggagaggttttgcattcagtcaattccaaaatcaagtagccaccatttggaattaatttatgttattccagctccaagaatgcaaaagctcaataataaggactttggacccaaagatctcatgcatctggctgacactgtagatgggttttctcttatgacatacgacttctcaggacctcagaatcctggtcccagtgcacctctgaagtggatacatcattctttagcagcacttccttcagcaaaaggttcctctcatagcaattcacattcacggatgatattcctt

SEQ ID NO: 18622 - DNA, 267 bp, Zea mays
  Clone ID: LIB189-001-Q1-E1-C10
gggatttgctaccacgaggaagagtaccaccctcaggacctagccatcccccacccttggtggcgatgtcacctagcattgttggggatttgctaccacgaggacctagccatccaccacccttggaggaaatgatcgagtatagcaatgatgtcctcggtgcaaatgataaacttgttggtaatgtaaggatgaatacataaggataatgtgatgtaacttatagacaataacataaataaaaagaatatcctatgttgtttaaaa

SEQ ID NO: 18623 - DNA, 356 bp, Zea mays
  Clone ID: LIB189-001-Q1-E1-D1
gtccttttctaaaagaaaaaaaatacagtcgcatctcgcctccagcagggtgagttcgcctcggcagggtgtggcataccatggagagctcgtcgccgtcagtgccgttcccgctgctgcaggcgccggtcgagagcacctaccgcgcctgcaccatcccctaccgtttcccctccgacaacccgcgcaaggccacccctgtcgagatccaatggattgacctctttctcaactctgtcccgtccttcaaacagcgggcggagaacgaccccaccgtacccgatgcgcccgcgaaagcggagaagttcgcgcagaggtacacgtcaatgcttgaagagttgaagaagaatccggag

SEQ ID NO: 18624 - DNA, 231 bp, Zea mays
  Clone ID: LIB189-001-Q1-E1-D11
cgggccgacccacgcgtccacccagtcgtccgagtagtcattcatgtacgcatggctgatcgatgagcttaaggctggtagtaacattggtatcactatgtggatgtttctgaggaacttttagaacagcacggtctatggtgcagttgttgatggtgctgtcatcagtgacatgatcactggtatgatacatgctgactgtgatgtcgatagtactgtctctatcattgg

SEQ ID NO: 18625 - DNA, 442 bp, Zea mays
  unsure at all n locations
  Clone ID: LIB189-001-Q1-E1-D3
cggtctagtaatccggctcgacncacgcgtcagcaatgatccaaaaacgtatgtggaagaagatgtttttgttacagatgaatctgggactaagaaaaggatacggctagaggacaatattgtgcggtggagaaccattaggaatgcagatggcactacatcttgtgaaagcaatgcacgctttgtaaaatggaaggatgggactatgcagcttctgattggcaatgaggttcttgatatatctgtacatgaggcgcatcatgaccagtcccatctgtttttgaggcatgggaagggaattctacaatcacaaggaaggcttttgcacaaaatgcgatttatgccatcctccttgtcttcaaagtcgcatcgcttattaactgctctggttgattctcagaataagaaaactgttaagatgcaaaaatggtttgagactaag

SEQ ID NO: 18626 - DNA, 278 bp, Zea mays
  Clone ID: LIB189-001-Q1-E1-D8
aaaaaaaaaaaaaaaaaaaaaaaaaaaaaaaaaaaaaaaaaaaaaaaaaggaggaagctcaaaaggataaaaaacttaggtacccgttcatgcgacttcatacttcgttaatagtgtaagcaagcattcaattcattgtacggtggcttcacaagtttacttcatgggataatctctttggtaagccatcttaggcgccttcacagagatccccctttcgcaagctgatgtaataacttttatgttcgcaccattgggacttcccaacatttgcccaa

SEQ ID NO: 18627 - DNA, 426 bp, Zea mays
  Clone ID: LIB189-001-Q1-E1-E12
gggccgacccacgcgtccagatgagatgacccaatcaggagcacgcggatttcaagttcaagcaagagctctggatggtcattagcatgtcctctgttgcggtcgtgaagttcttcctcatgctctactgccgaacgttcaagaatgagatcgtgagggcctacgcccaggaccatttcttcgacgtaatcacaaactctgtcggcctggtctcggcgctgctcgctgtccggtacaaatggtggatggaccctgttggcgccatactgatcgcgttgtacacgatcacgacgtgggcgcgaacggtgctggagaacgtaggcacactgataggcaagtcggcgccggcagagtacctgacgaagctcacgtacttgatctggaaccaccatgaggagatccagcacatcgacacggtgcgagcct

SEQ ID NO: 18628 - DNA, 308 bp, Zea mays
  Clone ID: LIB189-001-Q1-E1-E9
ttttgctgtgcacaacaatctcagctgacagcggcggtacaccgtctcacagtacattccgggtgatcaccatacataatgaggcaacaaggatgtacacattatttgcggctaacagatatgaccatcgggcgcagctctagaggcttgcaggtgttctcgtggtgcaacataatcagagtgcttgccaactatcttataaattccattcacaagacgtctatggtcaggatagtcattgtacaggctatgccattgcttcaagtgcacctctagcacgagatcctgctttctaaatatggcgaaat

SEQ ID NO: 18629 - DNA, 404 bp, Zea mays
  Clone ID: LIB189-001-Q1-E1-F12
cccgggccgacccacgcgtcaacttactccaggacgtacgtacgtacctagatcgatccatcgatcgctagctagctgacgaccatggcgtccctctcctctgccgccatcaccgccccttccttcacggtcgcgcccgctcgcgcagtggccagcaggaggtccttcaccgtgcgtgcctctctccgcaaggccactgccaccgccgccgtggacgttgccgccagcgtcctgcgtgccggcggcggcgccatggcccatgaggtgctgctgggcacaggcgacagcgggctcgtcttccaggccagccatttcacctgtcaacggcggcgacactatcaccttcaggaacaacgccggcttcccgcacaacgtcgtgttcgacgaagacgacgtgccgagcg

SEQ ID NO: 18630 - DNA, 87 bp, Zea mays
  Clone ID: LIB189-001-Q1-E1-F6
agcccacgcgtccgcggacgcgtgggcggacgcgtgggcggacgcgtgggaaaaaaaaagaaaaaaaaaagagaaaaaaacataaaa

SEQ ID NO: 18631 - DNA, 312 bp, Zea mays
  Clone ID: LIB189-001-Q1-E1-F7
atcgccagcatcgacgacgcggactcgtctgaaggtgccacgaccacgacagaggtagtcgagccctctgaggtcaggacagagagcgacccgtggaaggattagatagttctgtatgcaaggattatgccctggtgtggtgtatgagcactggatgtaacgaaagtacgaaccagagccaggatagaggaatacagcgtttgataagaacactggtgttaaaagtgtagatctctggtttgggttgtgctgataaatttttgtaggctatagccatccaatgaaaaatgccatctgcgctttcgtgcaaaa

SEQ ID NO: 18632 - DNA, 207 bp, Zea mays
  Clone ID: LIB189-001-Q1-E1-F8
cgacccacgagtcagctcacgcgtctcaacaacactgtctcgtctcactgtgcttcgaccaattgtcgtgtacgccagtcttctcttgtctggacacctctgtacgcctggcacgctggcatacagctgtctgcacgctttatggcctggtgtgcagtagtgagcctgtgcttctaccactactactattgatctgcaggttggcac

SEQ ID NO: 18633 - DNA, 434 bp, Zea mays
  Clone ID: LIB189-001-Q1-E1-F9
cggtctagaaatcccgggccgacccacgcgtccacggacgcgtgggtgcggcctggttccatttatgatgcaaatgatagtgcacagtttgcagaactgctgactcaaggtgaactaacacgtcgagcatgggcgaaagatgtgcaggtgatgaatgaaggcccgggtcacatcccaatgcataaaattcctgaaaacatggagaaacagttggagtggtgtaatgaagcgcctttctatacattgggtcctttgacaactgatattgcacctggttatgatcacatcacttcagccattggtgctgccaacattggagctcttggcactgcacttctttgctatgtaacaccaaaggagcaccttgggttgcccaatcgtgatgatgtcaagactggtgtaatatcctacaaaatttctgctcatgctgctga

SEQ ID NO: 18634 - DNA, 432 bp, Zea mays
  Clone ID: LIB189-001-Q1-E1-G8
gaattcccggctcgacccacaagtcagcccacgcgtccgagatcctgcagaggtccaatataacacggaagctagaagtgttgaacaggacccacccagagatcctgcacaggtccaacataacaaggaagctagaagtgttgaacatgacccacccagagatcctgcagaggtccaacataacaaggaagctagaactgtcgaacaggacccacccagcaacacagaagtgtggaagcctgacaataaggctacaactacagagcacgagtccgtgagcgctttcatagcattgagatctaatggggattctacagatgtggaggcggcaccaggcgataccttgatgatgcagggacaggagtcggaagccacaatgcaacaagcatcccacgcctgttgaccaggcccagcctaactatgaacctgaaa

SEQ ID NO: 18635 - DNA, 380 bp, Zea mays
  Clone ID: LIB189-001-Q1-E1-H10
acccacgcgtccgggaggccgagctcgtagaggcgctcgccaacctcgaggcgcagaatgaggaggctgtcaaggcgctcgacgcccagatcgcctcgctcagtgatgagatcgtcaagaaggtgctcccatccgcgtgatgaaaccaaaccggccctgccttatcctatgactatagttacatgaacatcataaattaatgataattttgaagaaattggccgatgactccgacactgtactcatgaaagattattggatgggctgtgtccaccgcctgtgttgggcgtggattgttgtagacttgcagtgatcttgctcgataagcttgtacagttcagtacagacacacattgaaaccatatagatacaggataaat

SEQ ID NO: 18636 - DNA, 237 bp, Zea mays
  Clone ID: LIB189-001-Q1-E1-H11
acaaaaaaatccaaaaagaaaaaattcataaaaaaacaaaaaaaaaaaaaaaaaacaaaaaaaagaaaaaaaaaaagcaacatggcggcacacatcaaaatgatacaagtcttaatatagcggggcggcggctctaaaggtctatggctaaggttcccttgctttgcatgattgactgcttctacatagctgcttaacttcaattcacgggcctttttttaaaaaagtcgtattgga

SEQ ID NO: 18637 - DNA, 289 bp, Zea mays
  Clone ID: LIB189-001-Q1-E1-H2
agggcacaacactggcgatatctgaggcaaggacagttggagaaggtgcaaaagatggactcctagttaccgtgggtgaagccagctaattaatgttttagagaaataattctctcttggagactactactactgttctacctcagcatcaccggtgctggtgcgtgtgtaacgtggtcactgtgggtatcatcactaccctaccctaagccctatcagaacataagcaccccttggagatttgtgccgtctaaatgaatatagttggttcagcgtcgtgactggaaaa

SEQ ID NO: 18638 - DNA, 412 bp, Zea mays
  Clone ID: LIB189-001-Q1-E1-H3
acgcgtcaggacagcggctgggcctcgccagggcgatcggcgtcagcaacttcaccaccaggcacctggacaaggtcctggccgtggccgcggtcccgcccgcggtgaaccaggtggagctgaacccggcgtggcagcagcggacgctgcgggcgtactgcgccgaccggggcgtccacgtcgccgcctactcgccgctgggagggcagaactgggacgggcggggcaacgccgtgctcgactcggaggtgctcgcggagatagccagggcgagggggaagaccgtggcacaggtggcgctgcgatggatacatgagcagggagtgacgtgcatcgtcaagagctacaacaaggagaggctgaagcagaacctcgagatattcgactgggagctgaccgatgacgaccggct

SEQ ID NO: 18639 - DNA, 416 bp, Zea mays
  unsure at all n locations
  Clone ID: LIB189-002-Q1-E1-A5
aattcccggctcgacccacgacgtcaggggaggcgcggagcagccgcgaccgcgagaaagaaaaggaagccgacgccacgcacgccatcgccgcctctatcctctcctcgtcctctccctccccctctctctccctgctccacctccaccaaccaatacacacctccctctctaaataccacttcgtccgagagcacaaagcagggtatcttcctttcaaaagaaacttggctgggtgttgacgcacgcagccggcggcaacctgtgcggggagcgccaagggctccaggaaagaatcggccgcgggctcgcgatcgggaaggggagcggggcgcatgcgcgagcactggcacggcgacggcgacggcgacgacgagcattaagcccaacccggggttcgggaaggccccngggca

SEQ ID NO: 18640 - DNA, 367 bp, Zea mays
  unsure at all n locations
  Clone ID: LIB189-002-Q1-E1-B8
agcggacgcgtgggcggacgcgtgggggcggcggcggtgtgccgcccatgcttgttggtggaaagcgcaagctgatgatacctgcgtcactggcgtacgggcctgaaccggcaggctgcttctcaggagactgcaacatccccggaaactccacacttctatatgaccttttcctcgtcgggatctacaagtgagccctcgatgacagggaatgttcagaacctaagagcagagacaaggaggaattcttggcggtgaaagcacctgcagaggcagagccacttgcagaagcttctgtactccagagagctacctggattgaataaaatgatgatatatataaaccatccttgttacgtaatanaan

SEQ ID NO: 18641 - DNA, 357 bp, Zea mays
  Clone ID: LIB189-002-Q1-E1-D1
agccaacgcgtccgcggacgcgtgggcggacgcgtgggtctacacgggtccgtgtcaacgatgacatgctgcgcgccacatttaaagaaatagcttatcaggccacacaggacaatttccagaagggctccatcttccgacccttcacacatcatcataaagatctctgcgcacatcactgcagccgtggttgcataatcctacgagctcggtctggctacacgtctgactcacaccattgacgtgatgatatatgcatagaactgcatgtacattcccgtctatcgcaactaccgttaatgctgcggggatcaattttgcagtaataacatatctatcaacgcagatggtactctg

SEQ ID NO: 18642 - DNA, 192 bp, Zea mays
  Clone ID: LIB189-002-Q1-E1-D8
agcccacgcgtccgcggacgcgtgggcggacgcgtggggacgacgcgacatgcgaaacactacgtgctagctagcataggaaaaaacaacatgaaatcgtacaaccaaccaatccctcgcactgttttagttgttagctgtacgcgaaactgttcatccaattgatcaaatgaaaattatttttccctaaaa

SEQ ID NO: 18643 - DNA, 260 bp, Zea mays
  Clone ID: LIB189-002-Q1-E1-G12
agaaaaaaaaaaaaaaaaaaaaaaaaaaaaaaaaaaaaaaaaaaaaaaacaaaaaaaaaataaaaaaagaaaataaaagtggaggatacacaagaaagcacaacgtttaggtgagctctgaatgctccttcagtcctgcttctttaattctaattaaagttcaattcagtggccgtctgtttgacaaggcctttcctggcataacccctgcttatcccaatttagccgcctcttccatacacttccgctttcagcaactt

SEQ ID NO: 18644 - DNA, 238 bp, Zea mays
  Clone ID: LIB189-002-Q1-E1-G4
agcccacgcgtccgaaaaaaaaaaaaaagaaaaaaaaaaaaaaaaaaaaaaaaaaaaaaaaaaaaagatcaaaaaggataacaaacttaaatagacataaagtaaatttggagggcttatcaactagtatcgcctctatggagttgaccgaatgtcgctttatcgtggtgcagtctagaaagcactcctctgtgagctaccgtacggtgcctttaaggatgccactgtttttgctaaa

SEQ ID NO: 18645 - DNA, 337 bp, Zea mays
  Clone ID: LIB189-002-Q1-E1-H2
agctagtccgccccgggcgcccgcgtcgccgacctccgtgtcgacagcttccgcgcgcatccgcccgtcgtcggactcggcctcgcgctgcgagctccgcgtcagcaaccccggcttcttcctcccgctccgctaccgcgcggtctccgacgccgtctcataccgcggacacttgctcagggtcgctaaatcgtggcccgggtccggcgagcttgcgggcatgaatgaagtctatgcggatgctgatgtgtgagtggacgccgggaaagtgctggctgacgtgatcgagctcatctgggacttggcctcagggtcagtgccgcttgagatcgtatct

SEQ ID NO: 18646 - DNA, 424 bp, Zea mays
  Clone ID: LIB189-003-Q1-E1-A11
taccggtccagaattcgcggcgtcaattcacgggtcgagccaagcgtctgcacatcctattccgaaaaagctgctccttctaaggagccaaaggcaaaggatgtcaagaaggaggctccaaaggaggcccccaagccaaaggtggttgaggcaccagcagaagaggaagcaccaaagccaaagccaaagaatcctcttgacttgctgccaccaagcaagatggtccttgatgactggaagaggctatactcaaacacaaagactaacttccgggaggttgccatcaaaggtttctgggacatgtacgacccagagggctactctttgtggttctgtgactacaagtacaatgatgagaacaccgtctcctttgtgaccctgaacaaggttggtggattcctgcaacggatggacctgtgccgca

SEQ ID NO: 18647 - DNA, 340 bp, Zea mays
  Clone ID: LIB189-003-Q1-E1-A9
acggctcctcctcagaaaaacaaagggaagacagctgcctacccaacctaccagccatggcgccacattcttactccatagcccccgtccaaagcgagctgaacatgacgctgtacaacaaggaggtgtacggtgggcgggggaccaacggagtgaccactctagtgaaccgagggccaatcggcaccacctgggtcttctcgtggcctgtcaccgacgggcccgccggcgccgacgcgaacgtcgtcggccatcttcagggcaccggcgttcaagtcgccacttaccccgactacatgtggcactactcccttgggctggtgttcggccagggaaccag

SEQ ID NO: 18648 - DNA, 305 bp, Zea mays
  Clone ID: LIB189-003-Q1-E1-B2
attccctatagtaagtcgtattattgctcatgtcaagacaacacctcatccacccttagctcaagtacctgcataactgtcaccctggacggcttcagtgccacggacttccatcgggggtgcgacttccagggcccctgcgtcgccggtgggtacatccacggcggcttccctttcggccggttcagcccggcggggtacccaagcaccgactatcactacgaaacgctggatgctttcctcttccactgcgcggaatctacgtgaggtccccgcgccccccgttgagcttcccaacgtgggcg

SEQ ID NO: 18649 - DNA, 72 bp, Zea mays
  Clone ID: LIB189-003-Q1-E1-B9
acggacgcgtgggcggacgcataggatcaaaacaaaataaaaaaaaaaaaaagaaaaaaaaaaaaaaataaa

SEQ ID NO: 18650 - DNA, 73 bp, Zea mays
  Clone ID: LIB189-003-Q1-E1-D11
ccaaaaggatcaaacctaacttacccttgaatgcaacttcaaaccccttcaaaagtgtcaccaaaattcaatt

SEQ ID NO: 18651 - DNA, 460 bp, Zea mays
  Clone ID: LIB189-003-Q1-E1-D3
ggtcaagactatccgggtcggcccacgcgtccacccaaggtgtcgggcttcgccaaggtggacctcgaggccggcaccgtcgacaagttcatctacggcgacggccggtacggcggcgagccctgcttcgtgccgcgccccgacgcccccgcgggcgccgcggaggacgacggctacgtgctgtgctacgtgcacgacgaggcccgcggcgcgtcggaaatgctcgtcgtcaacgcccgcgacatgcgagccgaggccgccgtcaagctgccgggccgcgtcccgtacgggttgcacggcacgttcatcgccggcaaggagctgcagcggcaggcctagtgtggtgccgttgccgtgtcgtgctgctgctacctcgtcgatcacgaactcgaccaactcacgtacatacactgatacacacaacagacactacaattaccaggcttgatattgacttggc

SEQ ID NO: 18652 - DNA, 437 bp, Zea mays
  Clone ID: LIB189-003-Q1-E1-D5
aggtactagtctagaattcccgggccgacccacgcgtcagagatctcgctcagaagagactctgaagagataacgagctgcgcttcttcgtcctcgatcaactagcttctctgatcgcttccatatggagagagctgcgtcaagctgcgctagcctcctagcacaaaggaggtgctactccgtggccgcggtcgtggtgaagggatgcgggcggaaggccgtggagaaggtggccaagcgcatcatgggcaaggaggtgaacaccgcggctgcctccggggagaagacgccgtgggtgccggacccggtcaccggctactaccgcccggcgggtggcgccaaggaggtggacgcggcggagcttcgcgccaggctgctcaccaagaggatcgccaactaaatcaatctagcagcagagcagtgccgctgaaaataat

SEQ ID NO: 18653 - DNA, 471 bp, Zea mays
  Clone ID: LIB189-003-Q1-E1-D6
gtacctagtctagaattcccgggccgacccacgcgtccacccacgcgtccgggtgaagccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatatctgctagtatagcaggtgatatggttcttgcttctgcttactcgcatgagttgccacgatatggtctcgaagttggtctgaccaactatgcagctgcctactgcactgggcttccgtttggtcccccttttgcacaagacccgtggtttagataaggaatatgagggcaatg

SEQ ID NO: 18654 - DNA, 406 bp, Zea mays
  Clone ID: LIB189-003-Q1-E1-D7
ggtacaggtctagaattcccgggccgacccacgcgtcagagcttccgtgacctctgttctgctgccgcctctggtccacatctctctacgccgccgccccgccgtccaccgaaaccgcagcgctgggaaggatcatgggggatcggagcaaggcgggggacccaccgttttgtcgcccggatcgcagcggaccgagaagactggcagcggttgcggcgcggccttgggatacggacgatctgcgatgtgtgcgagagcgcaacggcggtgctcttcagtgcggccgacgaggctgcgccttgccggccttgcgacgagaaggtacacatgtccaacgtgcttgctagtccgcatgtgagagttgggcttgcagaccctaataaactggcacgttgtgacatatgcc

SEQ ID NO: 18655 - DNA, 414 bp, Zea mays
  Clone ID: LIB189-003-Q1-E1-D9
attcccgggacgacccacgcgtccacccacgcgtccacccacgcgtccgagcagcccggcgaaaaccctagtaagcaaaccaccggagcagcggcgcttgcgcgggcggagccatggcggacgacgattacaacgaaattgacatggggtatgaggatgagcccccagaaccggagattgaggaaggagctgaagaagagcctgagaacaacgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagtcatggttgagcttgagggtgaaactgaccctcttgagattgcaatga

SEQ ID NO: 18656 - DNA, 455 bp, Zea mays
  unsure at all n locations
  Clone ID: LIB189-003-Q1-E1-E1
ggtcaagaatacncgggtcgagcccacgcgtccgcccacagcgtccggagaagagcgccgtgaagaggaagaaagctgacgctgcggcgaggcacgcggcgctgctgctcatgatggggcacgatgggttcacctccccagaggtgtgcctgcattacctatttgcatcagggaatgtggattccgtggtgcttggagcggctctggttgaacttgatggcggggaggtagtcaggttgatgagatatctcaacaagtggattcggaagtactggagcttctcagaagcgcacacttgcccggaggctgtgggaaacctcagattggagcagtgtgacagcgtgccgtcgtttggagcagtggctagggcgctaggagtgctgctggataatcatttttcacatcttgtgttgaatgctgatgttaaggaagacttgaagggctgcggccttgat

SEQ ID NO: 18657 - DNA, 473 bp, Zea mays
  Clone ID: LIB189-003-Q1-E1-E6
gtacctagtctagaatgcccgggccgacccacgcgtcaggtaatctggtccactagcgctccattcgaccccacccacagccatggctgccgtgaccgcggcggccgtctctctgccctcctcctcctcctcccctgccgccgccaaggccaaggcgtccgcgtccgcgtccccgtcgtctccatgcggccacctccagttcccgcggcggcacggcggcccgcgcgcggtgcggctgcgcgtgcaggtgtccaccaccgagaccgcggaggcggagccggtcaagaagctggagaaggtgtccaagaagcaggaggaggggctcgtcaccaacaagtacaagcccaaggagccgtacgtcgggaggtgcctgctcaacaccaggatcaccggcgaccaagccgccggggagaacttgcacaatggtctccagcaaagaaggcgaggtcccctacagagagggccagtccatc

SEQ ID NO: 18658 - DNA, 407 bp, Zea mays
  Clone ID: LIB189-003-Q1-E1-E7
aattcccggttcgacccacgacgtcagagagacttcaactggccttggaagagcaaactgaaatggcaaatcatagccaacagcagtgtgataggctaagaaatgaacggatcttgtgtcgaatttgctttgaaagagacatatgcattgttatgcttccctgccgccatcatgttctctgcgagccatgctctaacaagtgtcagtcatgcccaatttgccgattgaccgttgagggcaggctatttgtttatgatgcagtgatgtcatccaatccatcatgttacgcagtttaaaagtgcacatgttgacagtatttgtagggtacctacttctggtgttgacaaagatggcccacacctgtttcctggcagtgaatgacaggttgtgaaattcttggtatgaaa

SEQ ID NO: 18659 - DNA, 377 bp, Zea mays
  Clone ID: LIB189-003-Q1-E1-E8
aattcccgggccgacccacgcgtcagcacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactg

SEQ ID NO: 18660 - DNA, 399 bp, Zea mays
  unsure at all n locations
  Clone ID: LIB189-003-Q1-E1-E9
acccacgcgtccaaagcgagcgaaggacccggggcggaagaagagagagaagacgtctctctcctctcggcgtccccgttccccaacctctcgtctgctgcctgcctgcctgcaaaaaggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtcnctatgctggtggtgttttcttagtgaacattcatttcccgccagatttacccttcaaacctccaaatgtttctttcaagacaaaggtcttccatcctaatatcaacagcaatggaaatatatgccttgacattctcaaag

SEQ ID NO: 18661 - DNA, 376 bp, Zea mays
  Clone ID: LIB189-003-Q1-E1-F10
acccacgggcccacggacgcgtgagtgggtcgtctgccgcgtcttccagaagggcggcaacaggccgaggaggaggcagcgagaagcgtcgccgccgccgtccgctagcagcagctgcgtcacggatgcgtcgagctcggacctggacgaggtcagcagctagcttagctagctagctagcagaaccgaccgtacgtgccggctggccacaacatgcagtcaagaacgtacgtacgtatatgtataccgccaccagctcgtcgcgcgcgcagctgtgctgtgcatgccgtacgtgtgcggccggcctcgacctcgatctcgaagagaggatgtgatcaagctgagttacggataagggggaacaacccatccacac

SEQ ID NO: 18662 - DNA, 445 bp, Zea mays
  Clone ID: LIB189-003-Q1-E1-F3
ggtcaagcatatccgggccgacccacgcgtccacccacgcgtccgcccacgcgtccgactcggtgcacgtgcaggagcagacggagctggtgcacaaggcgctgcagcgcgaccccctcaactaccctttctgaaagaaacgaggcccctgtagattcttggaattggggaccttttgaatttgatataataccaatatagagagaacatgccttaaattttatctgtgcagccatttggtgaaataattgtttcgactctgcagtaccgcatgaaacaaaccgttgtaagtttggaaaaactccatctcgcagcgttgattttgtgttcctaaatgctggaaagtttgtatggctgaaagcctgaaacaccgcctgccgcaattttcttgcgttgaattgcaaagtccataaaagcaatgaactgaaaagtccatcaaccttgc

SEQ ID NO: 18663 - DNA, 410 bp, Zea mays
  Clone ID: LIB189-003-Q1-E1-F5
gtacaggtcaggaattcccgggccgacccacgcgtccacttgcatcccgtccccgtccgcgccggccgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccccgacttccccaagccagggatcatgttccaggacatcacgacgttgctgctcgatcccaaggcgttccgtgacaccatcgacctctttgtcgagcggtacaaggaccaagggatcaccgtggttgctggtgttgaagctagagggttcatttttggtcctcctatcgctttagccattggcgcaaaatttgtgcctttg

SEQ ID NO: 18664 - DNA, 460 bp, Zea mays
  Clone ID: LIB189-003-Q1-E1-F8
aattcccgggccgacccacgcgtcagatcaggttgccccaacgttggttcctctgctgaagttttacttccatgaggaagtcaggagagctgctgttgcggccatgccggaacttctacgctcagcaaaattggctgttgagaaagggcaggctcaaggacgtgatgagtcttatgtcaaacagttgtctgactacataattgcagcacttgttgaagcactgcacaaggagccagaaacagaaatgtgctcatccatgctggattctttaaacgagtgtatgcagctttcgggtcttttgcttgatgaagcccaagtacgagctatcatagatgagattaaaaacgtcattatagccagtgccacccggaaaagagaacgctcggagagaacaaaagccggagaattttgatcctgatgaaggagagctactcaaagaagagaatgaacaggaggagga

SEQ ID NO: 18665 - DNA, 398 bp, Zea mays
  Clone ID: LIB189-003-Q1-E1-F9
ttcccgggacgacccacgcggccgaccacgcgtcaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaagctgacctacgacgagatccagagcaaaacgtacatggaagtgaaaggcacgggcacggcgaaccagtgcccgaccat

SEQ ID NO: 18666 - DNA, 377 bp, Zea mays
  Clone ID: LIB189-003-Q1-E1-G1
cgggtcggcccacgcgtccgccccaaaagtaataactagtaaacagagctgcgtccaggcttcttcgatcggtccatggctgtcgtcacgagggacgcggcgtgcctccccctcgtcctcctgctcctagtcttctccgcggccccgtctccggctgacggctgcgaccgctgcgtgcgccggtccaaggccacctactaccaggcctcctcgctcgccctcaacgccgggtcgtgcgggtacggctccttggcggcgtccttcaacggcggcctgctcgccgcagccagccccgagctgtacaggggcggcgtcggctgcagcgcctgcttccaggtgcggtgcagggacagcgagctgttcagcgccgccggcgc

SEQ ID NO: 18667 - DNA, 379 bp, Zea mays
  Clone ID: LIB189-003-Q1-E1-G2
gggtcggcccacgcgtccgggaaaaaaggcccagaggcagtgccgtgaccgattcgagacgcaagagaaggatcgagacgatgcggcggttttccggggcagcatcgtctcggccacgaagatgtcttactcaaggggctcaaggtaagcactatttattttataaccttgaatgacctactttaaaaaccttcttgtttcaatttgtcttcaagtgatcttgctcggtgttctgatagtttttttacaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtg

SEQ ID NO: 18668 - DNA, 414 bp, Zea mays
  Clone ID: LIB189-003-Q1-E1-G5
gtacaggtctagaattcccgggccgacccacgcgtcaacccacgcgtccgcccacgcgtccgcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcaggcgagtgcccccctcctctccgcactagatctcgccgcccgatcgcttcgcctcccatttttgctgatttctgagtgtgtttttccgcgcagcgagaacgagaagtccgggttcatcagcctcgtgtcacgctacctcagtggggaagcggagcagatcgagtggagcaagatccagaccccta

SEQ ID NO: 18669 - DNA, 418 bp, Zea mays
  Clone ID: LIB189-003-Q1-E1-G7
aattcccgggccgacccacgcgtccacaggcaatcgcagcaggcatcttacctttatcacccttgttcctccaacaaccgtcagccctattacaacagttacctttggtgcatttgttggcacaaaacattagggcacaacaactacaacaacttgtgctaggaaaccttgctgcatactctcagcaacatcagtttcttccattcaaccaactggctgcattgaactctgctgcttatttgcaacaacaactaccattcagccagctagctgctgcctacccccagcaatttcttccattcaatcaactggcagcattgaactctgctgcttatttacaacagcaacagctaccaccattcagccagctagctgatgtgagccctgctgccttcttgacacagcaacagttgttgcc

SEQ ID NO: 18670 - DNA, 453 bp, Zea mays
  unsure at all n locations
  Clone ID: LIB189-003-Q1-E1-G9
attcccgggacgacccacgcgcccgaccacgcgtccgcgacagacaaaatcagtcaagatggtcaacgttcccaagacccgccgtacctactgcaagggcaaggagtgcaagaagcacacccagcacaaggtcacccagtacaaggctggaaaggcttctctgttcgctcagggtaagcgtcgttacgaccgtaagcagtccggttacggaggtcagaccaagcccgtcttccacaagagggcgaagaccaccaagaaggttgtgctcccgtcttgagtgcactgcctgcaagaccaaggcacagctcgcccttaagcgatgcaagcacttcgagcttggcggtgacaagaagaccaagggtgccgcccttgtcttctaagcgtgtctcctctttctctctcttttgctgggccctcggcgtagtcttcaagcggacangatgggtggctttc

SEQ ID NO: 18671 - DNA, 176 bp, Zea mays
  Clone ID: LIB189-004-Q1-E1-A11
agcggacgcgtgggcggacgcgtgggatcaaagctatgttatcgggttcagaggcagcttacatatcctatctaaacaactcattagcaaatagtataagtgtgtaagcactgtctacgatggtgttatgatggtggtatttgagatggctctaggttctagatccataatataat

SEQ ID NO: 18672 - DNA, 308 bp, Zea mays
  Clone ID: LIB189-004-Q1-E1-A12
ggcataaactgggctctagttcgtgccgccacgcccccagagctggaggctcccctccaggatacattggaggccacactgcctcctcctgcagctgatgcggcccacaccgatatgttctgatcatacattgatctatgatgctgcatgttaatttgcttaaaggaagaaaaaaaatagatgatgaagatgcatgactttggcatagatgagaacaataatgtatgttaaggactaattatcttgatccatcaaaaaaaaaaaaaaaacaaaagaaaaaaaaaacaaacaaaaaacaaaaataaaaa

SEQ ID NO: 18673 - DNA, 472 bp, Zea mays
  Clone ID: LIB189-004-Q1-E1-A2
ggtccgaaattaccgggtcgacgcacgcgtccggtcgtcatggggatcgctgctctcgtctgcacaacaggccaactatatcaccaactcttgtgcttgctaacatgtatcagcgccccgatatgataacccctggagttgatgctcaaggccaacctattgaccctgagaagatgcaggagcattttgaggacttctatgaggacatctatgaggagttggggaagtttggtgaagattgagaatctgaatgtttgtgataaccttgctgaccacatgattgggaatgtctatgtccagttcagggaggaagagcaagcagccgcagcatacaatgctcttcaggggcgcttttactctggccgccctataattgttgagtattctcctgtgaccgacttccgtgaagcaacctgtaggcagtttgaggagaacagctgcaaccgtggtggctactgtaatttcatgcatg

SEQ ID NO: 18674 - DNA, 451 bp, Zea mays
  Clone ID: LIB189-004-Q1-E1-A4
ggtccgaaattaccgggtcgacgcacgcgtccggattcacagaagataaaaatcttggaggaacaacttgcagagacacagagcaagttggagcatttccttatagagaaggaaagcttgactcaaacaaatagtactttgaatgaggagttggaagtacatcagaacaagttgaacgatttacaacttgcacttgctgctgcagtagcagaaaaggaggaggcattctgaagagattcaattcgctgcataaaacgctcgatggaatggattcagcacaaagcagaattagaaatacaggtatcttctactatacaagagcacgaagaactgaagagcaagtaccaaaatacaatggaagagaaacagacgttgagtgataaatatgaaaccgcaaagaaagagctcgaggatgcaatagccaagttggaggaggaaatgaatgtagaca

SEQ ID NO: 18675 - DNA, 459 bp, Zea mays
  Clone ID: LIB189-004-Q1-E1-A9
gtaccggtgcagaattcgcgggacgattcacgggtcgaggcacgcgtctgcacacgcgtccgcccacgcgtccgctaaagcgagcggcggtcttgcaccaggagttgctattcccaacgttgctgctgctggggagcagggacagcatatcacaattataacccttaacaaaaagggcccgttaaaggttctgctccaactggtaatggcccaagcaatgtgattaacaacacaaccagcatgccccccggcagaaacaacagcttcaagtcggtgagcagcagtccagctgctgctaccggtggcattgcggtgaactcgaaggtcgacgactccttccatcaactggaggacctcgacctcgacggcttgatcacaaacgaactgatggagagcgggttgttcggcgccggacaagggtggtgagcatgtcccaccacgcctcacactactatcgag

SEQ ID NO: 18676 - DNA, 436 bp, Zea mays
  Clone ID: LIB189-004-Q1-E1-B10
ggtaccggtctagaattcccgggccgacccacgcgtccactccggacgaaatcagcggcggcggagatgggagcggagtgccggtacgaggtggcgcaggcggcgtacatcaagctggcgctgcacgcactgaagcacccggcgaccgccgtcaacggcctcctcgtcggtcgcctcgtcgagccttcgtcctcaccggccgtcgtctcggtcattgacgccgtgccgctttctcaccacccgcaccatctgccgctgctccccacgctcgagctcgcgctcaccctcgtcgaggaccacttcgcaacccagggcgaaggcctcgccgtcgtcgggtactatcacgccaacccgcgctgcgacgacaccgagctcccgccagtcgccaagcgcgtcggagaccacatcttccgatacttcccccgctccgcggtgt

SEQ ID NO: 18677 - DNA, 435 bp, Zea mays
  Clone ID: LIB189-004-Q1-E1-B11
attcccgggccgacccacgcgtccacccacgcgtccgaatgaacaagtgtttactgaaaatgatgggttttttgcttggatgtttctgaaaagaaggaccttgtggcagacaattctttcatttgtttggcctctttttgcactggcagtctgcttatttccagtttacccataccagtgcaagattgttgtactgtactcatgtgctggagctctacttttcattgtctccattcttttgctaaaaagctgctatctttggtatcctatgggttctccttgggaaacgcgtgtggttcttccccaatataaatgcggaggagacaacttttagagaactcgttcgtttttggcctgaaaaggatgaaggagagcggccaaagtggacatcaagacttttctatgcccttgttgctctattggtgatattactgc

SEQ ID NO: 18678 - DNA, 295 bp, Zea mays
  Clone ID: LIB189-004-Q1-E1-B12
aacgcatgtgaaggcctggtggtctggtctgatggagaggccgtctgtccacaaggtcgctgccttgatgaagccgtctgcttgaaacggttgccctgtcaatcggtgaatggaataagccaagtctgttctgggttgtttgcttgttcagtgatgtgtctttctatgacgaaagttgagtgcctatgtgtgagcatgcttgcttgtaacgagaccttgaattgttcggaaatgagcattcctgtgctcttcttgaaaataaactttgcgttaggttcctcaataaaagatgtgg

SEQ ID NO: 18679 - DNA, 465 bp, Zea mays
  Clone ID: LIB189-004-Q1-E1-B4
ggtccgacattaccggggccacgcacgcgtccggcgaggactgcttcgtgctcaaggtggaggcggaggcgtccagcctgcgcgcgcgcaacagcagcagcgtcgagatcatccggcacacggtgtggggctacttcagccagcgcacgggcctgctggtgcagctggaggactcgcacctgctgcagatcaggtccagcggcggcgccggcgggagcgtcttctgggagaccaccatggagtcccgcctcggcgactaccgcgccgtcgacggcgtcaacatcgcccacgccggccgcaccgccgtctcgctcgtcaggttcggcgactgccaggacggcaacaccaggacgcgcatggaggaggagtggaacatcgaggaggtggacttcaacatctggggcctctccatggactgcttcctgccgcccagcgacctcagggatggcaaggagagccaggacg

SEQ ID NO: 18680 - DNA, 456 bp, Zea mays
  Clone ID: LIB189-004-Q1-E1-B8
attcccgggtcgacccacgcatccgaagcagatcgactactcagctagctcgaggttgaaggcatggctgcatccaaattctacgtcgccagctgcgccctcctcctaatcggcgtggtgctgctggggcagcagggtatagttggcgccgtcacctgcccccagttctgcctcgacgtggactacgtgacctgcccgtcctccggctccgagaaactcccggcgagctgcaactgctgcatgacgcccaaaagctgcacgctccatctctccgatggcacgcagcagatctgcagctagctctgaaccaatgtgtgcgtgattcgatctggacattgaccaacctgctggttttcgcaaataaagctttcgcgcctgtatatggccatcctaataaatgtgtgatcatctatatagaaaagtgacagactacatatatatacatatatagatata

SEQ ID NO: 18681 - DNA, 441 bp, Zea mays
  Clone ID: LIB189-004-Q1-E1-B9
attcccgggccgacccacgcgtccacggacgcgtgggattggtttctggaccaacaacaacattgctgaagtatctgcgcagccggctttcatccgatgaggaagcatcaggatccagaagcaccccaactaaagatgaccaaattgctgcagcaaggcgcttgtccttatcttcaaaggaactggacttgagtggccttggagtgaccagtgtaccagctgccgcgtgggagacaagtgatgtggtgaaactggatctttctaaaaattcaatagaagatctaccaaatgagttgtcattatgctcatcacttcaatccttagttttgtctaataacaagataaaaaggtggcctcacacagtggtttcctcccttccctgtctgtcttccttaaagctggacaataaccccttggtagagatatcatccactgatcttg

SEQ ID NO: 18682 - DNA, 359 bp, Zea mays
  Clone ID: LIB189-004-Q1-E1-C1
gggtcgagcacgcgtccgcactgcagctcgcgatatttgcgagagagagagagagagggcccgagagccgaggacgagtgaagtctggctggcgtgatgctgcttcggagcgcgtcctcgccgctgctcaactgcgggcgcgcgccggctgcggcggcgtcggtcgagcacctcgcggtggtttcgccgttgttgtcaccggcagtggcggcgcctaggcatgggccggtgctgtgccgcgccatgtccgagggggacctcgccgcgccgctcgtgcccaagaaggacgatggacacgggagggcgccgaggctgtccctgtccgcgtccttgtcctcgtccgcctccatcttcgtcga

SEQ ID NO: 18683 - DNA, 57 bp, Zea mays
  Clone ID: LIB189-004-Q1-E1-C11
gtaccggtctagaattcccgggccgacccacgcgtccatgctaactatcttgtcgtt

SEQ ID NO: 18684 - DNA, 462 bp, Zea mays
  unsure at all n locations
  Clone ID: LIB189-004-Q1-E1-C2
ggccggtccgacattaccgggtccacccacgcgtccgcaggacgcgtgggcagcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgccgcncgtggaccacgccgccgccgcgaggaggcgccggaggaggagggccaacagggccgcccagctgctgggggctgctgcgggtgcgccgcagcagtggcgcccctcgctcggcgacatctgc

SEQ ID NO: 18685 - DNA, 458 bp, Zea mays
  unsure at all n locations
  Clone ID: LIB189-004-Q1-E1-C5
attcccgggtccacccacgcgtccgacggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaagtccacgctgctcctgncggtggctcttccctgggaatactgtttggtggcaactgatgccgctcaacaagctatcacccc

SEQ ID NO: 18686 - DNA, 429 bp, Zea mays
  Clone ID: LIB189-004-Q1-E1-C6
gggtccacccacgcgtccgaggtcagagtggtttgagcttaaccgcgagctggctgtccagatagtagcggactacaagtactactccatcttcaggaagcactgcaggccatcctgttatccagacgagcattacataccgacttatcttcatctgttccatgggccactcaacgccaacaggactatcacatgggttgattggtcaagaggaggcccgcacccagcaagttatggtgccacagacatcacagaagacttcatccaggccatcaggaataatggtacgcagtgcttttacaactcgaagcccacctctgtctgctacctcttcgcgaggaagttcgctcctaatgctttgccacggctgatgaacctcacctcgaccgtgctggacttctgagccgattctcaccatgcgggcgggcg

SEQ ID NO: 18687 - DNA, 396 bp, Zea mays
  Clone ID: LIB189-004-Q1-E1-C9
taccggtctagaattcccgggccgacccacgcgtcagctgcccgactgctccacaggccactcgtcaccccaaaccaaaacgaagctgcgggcctgcggcggcagcaacagagagcagagatgctgcaattcccggcgctgatgcggcagtggccatcgccgccgctgatcccggcgtccacgctgctccccgtgccggccacctcccaggatgacgaggtcctcctcgccatggccgagtccgacctcgaggacaagttgaatgagatccggaagaccaacagccacctgattatcatcgggaagcccacaggcgacaccaaggaggagtatgacgctgaggtggaggacgacgatgcagacaacgtcgaggagtctgatggcgatgacttcgac

SEQ ID NO: 18688 - DNA, 445 bp, Zea mays
  Clone ID: LIB189-004-Q1-E1-D10
taccggtctagaattcccgggccgacccacgcgtccagtctactgggccgcgcagctgctcggcgccgtcgccgccgcgctcgtgctcaggctcgccaccggagggatgcatctgccggagtacgcgctggcggggggcgtgagcggatggaacgcggcggtgctggaggcggccatggcgttcgggctcatgtacgcctactttgcgacggtgatggacaaagcgcggagggtccgcgccggcgccggagcgctggcggcgccgctcgccgtggggcttctggcgggggccaacgtgctggcctgcggcgcgctggagggcgccgtgatgaatccggcgcgcgcgttcgggcccgccgtcgtgggctcccgtcgctggagacaccaatgggtgtactgggtggggcccatggtcggcgccggcctctccggcgtcctccacgag

SEQ ID NO: 18689 - DNA, 430 bp, Zea mays
  Clone ID: LIB189-004-Q1-E1-D5
cccacgcgtccgaccaagcatgagcctacgcattgatcgcatacgtcatgggatctgcacataaaactatagttcccagatcgtcaatatagcagggaaagaacacttcatcttttaccgcggtaattttgctgttatatgcataatcagtttccaagcagattaaagagaaaagattaaagtttcgtcagtttgccttaaggtggttcaaatggtctgtgatacgaaacgtatgttgctatctcgtaaggcgcatgtgggatagttacattgccgaatgctactatctacgagattttctcgtgtaaatatcagctagttttttgctgacatagtcagacacactgcacaagctggattttcatgagatggtgatgtacctgcagcatctcggaattaggacattagcacacgatgatctagagatagt

SEQ ID NO: 18690 - DNA, 439 bp, Zea mays
  Clone ID: LIB189-004-Q1-E1-D6
gggtcgacccacgcatccgaaaaaatcttgagctcgcaaccatgaaattgtcccaagaactggcagagcaattgcgcctggttatggaaccaactcttgctagtaagcttcaaggggattatagaactggaaagagaataaacatgaagaaggttattccatatattgcgagtcatttccgcagggacaagatatggttgcgccgaactaagcctaataaacggaattaccaagtggttattgctgttgatgactctagaagtatgtctgagggcaaatgtggaaaatttgctatcgaggcattagttactgtgtgccgtgctatgtcacagcttgaggttggacaatttgcagttgcaagttttgggaagaaggggaacgttagtgtgctacacgattttgatcagatctttaatagtgaagctggagttaatgtgat

SEQ ID NO: 18691 - DNA, 443 bp, Zea mays
  Clone ID: LIB189-004-Q1-E1-D9
gtaccggtctagaattcccgggccgacccacgcgtcaaggcgagcagcagtacttcaccgacaccaccaccctcttcatcatcgagctcatcctcatcggctgggccgagggccgccgttgggctgacatcatcaagcccggaagcgtcaacaccgatcccatcttccccagcaacaagctcaccggcaccgacgtcgggtaccctggtggcctgtggtttgacccgctcggctggggctccggctcgccggagaagatcaaggagctgcgcaccaaggagatcaagaacggacgcctcgccatgctcgccgtcatgggcgcttggttccaggccgagtacaccggcaccggccccatcgacaacctcttcgcccacctcgccgaccctggccacgccaccatcttccaggccttcacccccaaatgaggagctctgatgaac

SEQ ID NO: 18692 - DNA, 429 bp, Zea mays
  Clone ID: LIB189-004-Q1-E1-E2
ccggtcctaaattaccgggtcgacgcacgcgtccgatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcctcagtttgctatctctctctgcat

SEQ ID NO: 18693 - DNA, 421 bp, Zea mays
  Clone ID: LIB189-004-Q1-E1-E5
ttcccgcgtccacccacgcgtccgaaaccgcgtcgtaagcatccttctcggagatgccgttctgtttgccgtaggtgtggttctcgtcaaaggttaccatgacaagtgtgttgtgcatgcagttcttgttggtaaggaggggttccacgagcaacgcacttacggcatacatgacggcgtcttcagcatcgttcccggagatgctgttccggctgcgcgggtcggtaccacgaatgatgcctactacaaccagtacagcgagatctctaatgcacaagcgaattgcggcttgcacacatcaggccgttgggacgtaccgtgcaccatgttcatattcgtagctacgaatactgtgcatactgttgcagcatggtctgggaaggttgtcttcagcactacgtacatcactgcgtcggacact

SEQ ID NO: 18694 - DNA, 451 bp, Zea mays
  Clone ID: LIB189-004-Q1-E1-E8
cccacgcatccgaaatggtcaaatagccgaacaagagccagcaaattctgtctggtctagcagttaccatgtgtgattcagtaacttgtaccaggatgattgctggagttgctggggactattggattaagtggcacagcctgatctattgagcttggcccatacctgcagcactctgttaaatttcttttgagcatggtggtctttgaagcatgacaatggctgctcttaggtttgggattgccaccatcttctgggacaaagagggagtggaggatgattgatctgtcggcagtctgatggggatgaattatacgaggtcttcaacgctgacacaaagggttaatgaaacaaactcgaatccagtgattataggcgctccgcacggaccatatgattcatctccccttggacatgtagctacaagaatggtgtcagtgggccgttgctg

SEQ ID NO: 18695 - DNA, 451 bp, Zea mays
  Clone ID: LIB189-004-Q1-E1-E9
taccggtctagaattcccgggccgacccacgcgtcaacggacgcgtgggcacagtaagaaaagatggcgctgccatccatgagtcttgcggcaaagggtgtgcttcccttctcagcacgtacctcgagtggtgtcacacaaaggccggtgtcagtgaccgcttccttggagcacaaaaccagcgatgccagaaggaagttcctaaaacttgcacttgggaaccttggagttggactgcccaccttgttgggcgctaagaaagctctcgctgatgagcaaggcgtctcgtcctcgaggatgtcttattcgaggttccttgagtaccttgacaaggatagagtgaaaaaggttgatttgtttgagaatgggacaattgctattgtggaggccatttctcctgagcttggtaaccgcgtgcaaagagtccgtgtgcagcttcctggtctaagcc

SEQ ID NO: 18696 - DNA, 325 bp, Zea mays
  Clone ID: LIB189-004-Q1-E1-F10
taccggtctggaattcccgggccgacccacgcgtccacccacgcgtccgatgacagtctcctcagctgatgatgacccgagggttgttggagttgtaagctgctgattctcgcggtcgccagctatttaactgtcttgtattgagccttgagacaaagcaagctttgtgtatcatgtgtcgtcttgtttgccttgctatggaagtgtgtttgtatcgggattcgggagtcctattgttgtcatagtcgcaacttctctgcctttttacccccggaaagatgctcttgcgaccaaaaaaaaaaaaaaaaaaaaaaaaaaaaaataa

SEQ ID NO: 18697 - DNA, 428 bp, Zea mays
  Clone ID: LIB189-004-Q1-E1-F12
taccggtctagaattcccgggccgacccacgcgtccaaacaacctggtcggcaccatcaccctcctggaggtgatggctgcgaacggctgcaagaagctggtgttctcgtcatctgcaactgtctatgggtggcccaaggaagtaccctgcaccgaagaattcccgctctgcgccaccaatccctatgggcggacaaagcttgtgattgaagacatctgccgcgacgtccaccgctccgaccccgactggaagatcatactgctcaggtacttcaaccccgttggcgctcatccaagcgggtacatcggcgaagacccctgcggtgtcccgaacaacctgatgccctacgtgcagcaagtcgctgttgggaggttacctcacctcacggtctacgggacggactacagcaccaaggatgggactgggg

SEQ ID NO: 18698 - DNA, 411 bp, Zea mays
  Clone ID: LIB189-004-Q1-E1-F3
cgggtccacccacgcgtccgaggacgcgtgggcggacgcgtgggctccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccatgccccactcggctgctggtgagcagcccttgtcgccccctcctctcggcccgcccgcttcgtgcctccgccgctggcgccgtcgctaccagaagcagcgccgtgggccctcgcggtctggggctcgggctgctgccagcctcgcccgatcgggatggcaagtgccgccagcgacaggtgtcatgcagcgcggccggggatgctg

SEQ ID NO: 18699 - DNA, 467 bp, Zea mays
  Clone ID: LIB189-004-Q1-E1-F6
ttcccgggtccacccacgcatccgaagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtactt

SEQ ID NO: 18700 - DNA, 449 bp, Zea mays
  Clone ID: LIB189-004-Q1-E1-F7
gggtccacccacgcgtccgatttttgttaatgttcagtggatcgtccactttttcgtgtcaatagggtaacactacgaacttggttcttgtttcttcttcctaacggtgtgcagttctgatgcataacttttttttttttgctttgttcaggtggccttacccatttctagacttgacattccctggtgcacctgtatggtaaggtcgactagacgaaacaagtgactctatttttgctaaataccatggtctcatgtgtagcttacgcattagtttggctctgtttgtttacttccaggattatataatccagcttagggcctgttcggttagctctaaatccatgtggattgagtgggtttgggtgggttcaaatcccaaacaagtcaaaattgttctcaattttttccaatcccgtccaatccatagctaacgggattaaccgaac

SEQ ID NO: 18701 - DNA, 457 bp, Zea mays
  Clone ID: LIB189-004-Q1-E1-F8
gggtcgacccacgcatccgaccacgcgtccgcccacgcgtccgcatgtccggagttcaggcgatgccgacggccgtgggcgtcgcggggctgagagggtcagggttggttagcagcagcagtaccagcttgttcgccggcgactgcaagaggaaggctcgtcgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacctacaaggccgtgaggaccgtgctgacccagctctacgagctgaacccgccgagctaccgctggttctacaacttcgtcgctgtcaacaagcctaccgacggcaagcatttcctccgtgctctcggcaaggagaggcaggagctcgc

SEQ ID NO: 18702 - DNA, 438 bp, Zea mays
  unsure at all n locations
  Clone ID: LIB189-004-Q1-E1-F9
cggtgtgcaattcccgggccgacccacgcgtccaggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctgggaacggcgcggcgaacccttcgccctcgacgtcatcgccatcaacgacaccggcggtgtcaaagcagggtccanctgctcaagtacgactccacgctcgggatcttcgacgccgacgtcaagcccgtcggcgacaacgccatctccgt

SEQ ID NO: 18703 - DNA, 409 bp, Zea mays
  Clone ID: LIB189-004-Q1-E1-G10
tacggtccggaattcccgggccgacccacgcgtccactagaactagtgactcggtgcagatgcaggcaatgctgttggtcaggacgatatgaacatggacatggacccagatgttagcctgcctcaactgaaacaacatggtcccagacattagccgctcttgtgttatcacaatggctgtgactgtgagtatctttacagttatgctcgttatatccctgtggtgtacctgtttcgatcgtcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgc

SEQ ID NO: 18704 - DNA, 434 bp, Zea mays
  Clone ID: LIB189-004-Q1-E1-G11
cggtctagaattcccgggccgacccacgcgtccacggacgcgtgggggcgcgcaaggagcagtgcctggcgctcggcaccaggttgcgctccaagtacaagatcacctaccagttctaccgcgtcttccccaacggcgaggtgcagtacctccaccccaaggacggcgtctacccggagaaggtcaaccccggcagggagggcgtcggccagaacttccgcagcatcggcaagaacgtcaaccccatcgacgtcaagttcaccggcaaggccaccttcgactaatcacacttcacgtacgccgcacgccccagccgggatccaaattaaagaacttcttcttctattaattacagtatattgtaatttggctgctggtacggtggtggcatgatttgagatgtgcatgatgatccttgtgtaattttattacca

SEQ ID NO: 18705 - DNA, 360 bp, Zea mays
  Clone ID: LIB189-004-Q1-E1-G6
cccacgcatccgacggaattcgatggggagaagccggagccggcgaaggtttgacctgtaactctgcagcggatgatctcataataaggtaacactggcattttggtaaccatagacgaataagaatgagggaaatttcagaacatgttccggtgatactaattagctagaggaaaatttgacacggaaagttccttattctgtagaatgtgcctttgtggtgagtaaagatgtccatttcatatggcctttgtgatgagtatgtctgcattgaaaagttagtgctttcattcttgataatggacacttcgatttgattcaaaaaaaaaaaaaaaaaaaaaaaacaaaaaaaaaaacaaa

SEQ ID NO: 18706 - DNA, 445 bp, Zea mays
  unsure at all n locations
  Clone ID: LIB189-004-Q1-E1-G7
gggtccacccacgcgtccgcagcagctccgctcgtcgatcagctctcggctgaccactcaccgccagtgggtgcctgccgaccaggtctcgccaccgccgccgccgccgcggtagagaggggagggagagggagagggagaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtcnccttcggctgccgtgctggacccatcgacgacgcgccgccgcccgtggaccacgctgccgccgccgccgcgaggaggcgccggaggaggagggccaacagagccgcccagctgctgggggctgctgcgggtgcgccgcagcagtggcgcccctcgctcggcgacatctg

SEQ ID NO: 18707 - DNA, 290 bp, Zea mays
  Clone ID: LIB189-004-Q1-E1-G8
cccacgcatccgacaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtc

SEQ ID NO: 18708 - DNA, 414 bp, Zea mays
  unsure at all n locations
  Clone ID: LIB189-004-Q1-E1-H10
attcncgggccgacccacgcgtccacaaaattaatggtgtctttaagaaatgcatacgtatacaaggacaacgcatgaatagcagctgcacaaaaatatagtaaggctgcactgacatttaacacttaccatgaaagaaagcaaaatcatgtaatccttcttcagctcaaagagaagcaatattgaagtcaatgggaatgaatagactgaagctagtgtagcagccattctgacctacagaaaaatagagatagtgcacatcattacttatcgcatcaggaaaagtgagttgcaaagcaacttaccagagcctaggcttgtggcagtgcaacgacaacattaccctcagtaaagttgaaattattaaataagctaccgacgccctccaaaacagttccagcagcagctccaatc

SEQ ID NO: 18709 - DNA, 323 bp, Zea mays
  unsure at all n locations
  Clone ID: LIB189-004-Q1-E1-H12
accaataaactccttatttggatccaatggaggcaggagaattctgtacaatgcagactttaaaaatcaaacttgaaagcaatacattgacaatgtcatagaaggtgaggggcacgtatctatcttgacattgtctctcgtggtggggacgcatgttctcttctgtacgacgcaagcatgctaacccgtcactaatctctgatcagttcaattgtcacacttccagcttgacgtcggcacgcaggtcaggtantggcaccagctacagtgatcgttgccgttctctcctctgaacaccattaacaatccaacagcgaaccctg

SEQ ID NO: 18710 - DNA, 439 bp, Zea mays
  unsure at all n locations
  Clone ID: LIB189-004-Q1-E1-H3
cacgcgtccgcacacgcgtccgcccacgcgtccgcggacgcgtggggtgctggaggcgcgggaggtggaggaccatcccgcgctaggcgaaggagaggtgctcctcgaggtcgccgccgcgggcgtcaatcgcgcggacaccgtgcagcggatgggccggtacccgccgcctgccggcgcgtccccttacccggggctcgagtgctccggcaccatcctcgcgctcggccccaacgtcncctcccgctgggccgtgggcgataaggtttgcgcgctcctcagcggcggcgggtacgcggataaggtggtggcgccggcggggcagctgctgccgatacccgagggggtgtcgctgacgcacgcagccggcttgcccgaggtggcctgcaccgtctggtcaaccgtattcatgaccagtcacctctcccccggtgaatca

SEQ ID NO: 18711 - DNA, 414 bp, Zea mays
  Clone ID: LIB189-004-Q1-E1-H5
gggtccacccacgcgtccgaccacgcgtccgcccacgcgtccgcccacgcgtccggaggaatggtggatctgattattttggcaaaggtgttcttaagaaatgactgtgaatgggaaagtaactctcaaagacaaatattcagttactgttgtatatgacaatcaattctttgcactccgaaaaaagtgttgcccatccgagcttgcatatattacttctttaagccgctgcaagaagtggaatgctcaaggtggaaagagcaaggcctattttgtaaagacaacagatgacaggttcatcattaagcaaatcaataaaacagagtttgagtcatttattaaatttgcacctgattactttaagcatgtttaccattctctggacactggaagccaaacttgtctcgccaaaat

SEQ ID NO: 18712 - DNA, 427 bp, Zea mays
  Clone ID: LIB189-004-Q1-E1-H6
cgggtcgacccacgcatccgaagatggcgagagtagcttgtaccctccgtggcaagagactggaaggtggggtgctgtactctcggaaacatggcgggcaccatggcgagggtaacgtgtaccaaccaggccaacggctggaaggtggggtgctgtactctcggaaacatggcgggcaccatggcgagggtaacgtgtaccaaccaggccaatggctggacggtggagtactgtgctctcggttggcggggacccgttctggtcttgagaaacccgtgggcgagttgacatatgcaagggttaagtgctacatatgtcgtgtggttggagatccccagctgggtattaatcgattcggatcgccaaactctcggatatgaagactggatcttcgaccctcatcctagataacaggtgaaactaaaga

SEQ ID NO: 18713 - DNA, 403 bp, Zea mays
  Clone ID: LIB189-005-Q1-E1-A10
attcaagggtcgaccgacgcgtccaccagcacattcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgc

SEQ ID NO: 18714 - DNA, 353 bp, Zea mays
  Clone ID: LIB189-005-Q1-E1-A2
ttttagcttaattgcatgcatgcatcattagatatagtaacagtgatggatcgttacacgctgcagaagcatgcgcttagtcgttatttgcagacgataataagtagatcgatggagtagtgatcgagcaacacacacgtgacgacgtttgctcttatttacttacacgcacgcacgtgtacggcgctaggggccgtatatatatcgagttctgcatgcatatctcgatcgatgggatgatcagtcgtttcagtcgcagtagtaggagtagccgtgcccgtgcccgtgcccgtgcggcaccctgtgctcctgctgcctgctctcgtagtgggcctccttctgctcgcggtgct

SEQ ID NO: 18715 - DNA, 378 bp, Zea mays
  Clone ID: LIB189-005-Q1-E1-A3
gacccaggcgtccagatcagtaaaaagttggaaaccgagctttctgcctcttaacgttcttctgcgcaccaaaatgattcgccctgggtaccgatctggtttcttcaatcttttacatacttatatcgagtttagagaggaatattaacatgaataatgtggtaactgactgggaaattcaaaccgtgttcaccaactatttgccgctactgttcttcaggaaagtccaatacattgtacataaccatgcatcaaccatcagctcaagactaaaggctctcctgcagtattgtggtgcactgactattggtctatttctttcgaaagagagagagaggaaagctattagctagtgctagaaatataatggtgccccac

SEQ ID NO: 18716 - DNA, 427 bp, Zea mays
  Clone ID: LIB189-005-Q1-E1-A5
cggtctagaattcccgggccgacccacgcgtccacccacgcgtccggtagaagaggagtggcagagcagggtgtggaaggtgtgcgtgtacgtcatcaccctgggcatgctggtggcgctgctgctgggcctcaacatgtcgtggagcgccatcaccgccgccctggcgctcatcgtgctggacttcaaggacgcccgcccctgcctggagaaggtgtcgtacccgctgctgctcttcttctgcggcatgttcatcaccgtggacggcttcaacaagacgggcatccccagcgcgttctgggacttcatggagccgtacgcgcggatcgacacgcccacggggacggccgtgctcgcgctcgtcatcctcctgctctccaacgtcgcgtccaacgtgccgacggtcctgctggctggcccccccctt

SEQ ID NO: 18717 - DNA, 416 bp, Zea mays
  Clone ID: LIB189-005-Q1-E1-A6
ccggtctagcattcccgggccgacccacgcgtccaagcaccagacctcatctcactccgctaccccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctccttcgtcgccgccacgcgcaccggcttcctacagctgttcgactacatccagggcaagaacgcgtacaaccagacgatcgagatgacggcgccggtgctgacgcgggtgtcgcccagcgacgggccc

SEQ ID NO: 18718 - DNA, 384 bp, Zea mays
  Clone ID: LIB189-005-Q1-E1-A7
acggtctagcattcccgggccgacccacgcgtccacggacgcgtgggcggacgcgtgggcggacgcgtgggcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggacgtggcggcg

SEQ ID NO: 18719 - DNA, 403 bp, Zea mays
  Clone ID: LIB189-005-Q1-E1-B10
attccagggccgacccgacgcgtccacggacgcatgggtgctcttcttcctccacattcctaggactggaggccgcacctactttcactgcttcctaaaaaagctgtatacaaatgcgcaggaatgcccgcgttcttatgacaaactacggttcgacccaagccatcctgattgcaagctggttgttagtcatgatgactatagcttaacttccaagctgccaagggagagaacatctgttgtaacaatactaaggaacccaattgaccgtgtatttagcacatatgagttttcagttgaagttgcagctagattccttgttcacccaaacttaacttctgcaaagttaatgactacccgtgtgttaaaaaagtctcgtgctgtcagtactttggacatctgg

SEQ ID NO: 18720 - DNA, 78 bp, Zea mays
  Clone ID: LIB189-005-Q1-E1-B11
gaccgacgcgtccagaaaaaaaaaaaaaaaaaaaaaaaaaaaaaaaaaaaaaaaaaaaaaaaaaaaagaaaaataaaa

SEQ ID NO: 18721 - DNA, 401 bp, Zea mays
  Clone ID: LIB189-005-Q1-E1-B9
attccagggccgaccgacccgtccacccacgaatccggtggatttcttcgacctcgtgatcgacgagctcaacaagcccgaccctataatgaacgagaacatcgcgttggacctgttgttcctgctcctcttcgcgagccacgagacgacgtcgatgggactgaccgcgatactcaagttcctcacggacaacccaaaggccctgcaagaattgaccgaggagcatgaaaaaatcgtggaaacaagggtggatccggactctgatatcacctgggaggagtacaagtctatgagattcacatctcatgttatacatgaatctcttaggctagcaaacatcgctccggtggtgttcagacaggcaaaccaagacgtatacataaaggggtacactatcccag

SEQ ID NO: 18722 - DNA, 413 bp, Zea mays
  Clone ID: LIB189-005-Q1-E1-C10
attccagggccgacccgacgcgtccacccacgcatccgcggacgcgtgggcgggccgggcggctggacgacatggagcggctcttcgcggccatggagcgcggcgacggcgcgagcgccggcgccccggacaccagcacgtacaacgtgctggtgaacgcgtacgggcgcgcggggtacctggaccggatggaggcggcgttccgctccctggcggcgcggggcctcgccgccgacgtggtgacgtggacgtcccgcatcggcgcgtacgccaggaagaatgagtacgggcagtgcctgcggatcttcgaggagatggtggacgccgggtgctacccggacgccggcaccgccaaggtgctgctcgccgcgtgctccgacgagcgccaggtggagcaggtcacagccattgtc

SEQ ID NO: 18723 - DNA, 347 bp, Zea mays
  Clone ID: LIB189-005-Q1-E1-C12
attcaaaggccgaccgacgcgtccacagctcacaaagtgatcacgcgggcgaatgggctactcatcagctctctatctgagcttcgttagcaaataagttcagacttctctttactgccatgctcaagtctgtatatggccaaaacccaaaacgattgatcaactgcgctactgcagtgcaatagcaggatacgtatagttttcttttcaagggaaacaggaggggagtgcagtgcacccccgcccatactgcatgttattaataaaagaaagttatttacagaaaaaaaaaacatcataaaagccagtaaaaaaaaaaaaagaaaaaaaaaaaaaacaaacaaaat

SEQ ID NO: 18724 - DNA, 387 bp, Zea mays
  Clone ID: LIB189-005-Q1-E1-C5
cggtcaagaattcccgggccgacccacgcgttcagccaagccttccgaggataccagcagcgacgaagaccccgctagcttcgtcccgccgattccagtggccagcagcatctccagcgagactactgcggtgttagggcagggacgaccgctaccggtcgccgtggtgatcgatgtcatcacccagcaggaggaagaggcgcggaggcaggaggcactggagctgcagcagatagggacccagcggcgagccatgcggcggtcgcggtcggggcgcaagccggttccgacgcagctcgcccggtcgcactctacgggccactccctcgccgtccggctggaccgcgacctggagcgcttcacgctgcggctgccggagcacgtgcg

SEQ ID NO: 18725 - DNA, 416 bp, Zea mays
  Clone ID: LIB189-005-Q1-E1-C6
accggtctagaattcccgggccgacccacgcgtcagagtaaaagagaaggaacggagaaggactttggaggagatactctatgctctggttgttcagaagttcgttgaagctggtgtctctctggttccagcactctcacgctccaccgatccttctggaagagttgatcagtgggcagaaactgtggaagaaaagcttcaacgtctgcactcgcatgaggcctatgaaatgatcgagaatcacctcaccctcattctggggcagcgtcaaggtgacgccactatcgcagccataagtaagctccgtgttggccaggtctatgctgcatctgtgatgtacggttatttcctgaagagagttgaccagaggttccagctcgagaagacaatgaagggcctcccttgggggtcagaag

SEQ ID NO: 18726 - DNA, 455 bp, Zea mays
  Clone ID: LIB189-005-Q1-E1-C8
accggtctggcattcccgggccgacccacgcgtccacccacgcgtccgcccacgcgtccgacaccaacacccactgccgccgttttgctcgcgcgcccgctcatcgcactgtccagtgctttcacctcccctcatcgtgcgcgggtgccgagcggtccctcctccatctcggtgccgccactgaggagtcgatggtgccagtggcgcggcccgctccgatcgctgccccccgaaggatctccggccgagctgatggaagaggactccaagtttgtgccgttgaacgcggacgatcccatgtacggcccaccggcgctactgctcatcggatttgagaaaggcgaaactgtcacgattcaggccttcctgaaagagcttgaaggtgaattcctcaaggtgatccattgtacagaggagatgacaaagcaaaaccttatgggatgccatgcacactg

SEQ ID NO: 18727 - DNA, 332 bp, Zea mays
  Clone ID: LIB189-005-Q1-E1-D12
aattcaaatttcactctgtgaatagtagtctaaaatacagtagtgttttgagtaaactatggataaactgctggacaaggtctaagataagtgctgcgtggtggcaacaaacgacacttagtcttgtttggtggcaatgatattggaggggctaaagttttttcgctcctaaacaagctcctaagaatcttacgtgttatgttgcattatggaatatctatgtatctgcaaactctctgtagtctgtatgtacctcggatgtgctctatgtggctttgtaattctgaacggaggaagtaataataagataaatggatggcgtaacaagatat

SEQ ID NO: 18728 - DNA, 393 bp, Zea mays
  Clone ID: LIB189-005-Q1-E1-D5
cggtctagaattcccgggccgacccacgcgtccacccacgcgtccgatctctgtagaaaggaaggttgaacatcaattcaaaaatggactagcagagaacagaatggattctactgaggacaacaaaaacttcgtcaaaagcaaaaaaagcacactggagaaaggtagaaccagtgaaggtctatcttatgctcagaaccacgaaaccaaggtccatgattctgcacgttctcaagaaaaaaatcccaaggatgaaagtgatgggcacaaagatttggaccaacagaagaataatgccaccaagaaagacaaacctgctgctgagccgataattgttccaattgtactgaggatgtctgattttgatcacaaagcattgctagaggaatggat

SEQ ID NO: 18729 - DNA, 431 bp, Zea mays
  Clone ID: LIB189-005-Q1-E1-D8
accggtctagcattcccgggccgacccacgcgtcagagagcttgcaccttttgttgtgctcgcagaaaagcttgggcgcttggctgtgcaactagttgctggtggtggtggtatcaagtctgtgaaagtgacctatgcatctgcgcgggcccctgatgatcttgacacgagacttctccgtgcaatgatcaccaagggattgattgaaccaatctccagcgtttttgtcaatctggtaaatgccgacttcaccgcaaagcagaggggagttcgcatcacggaggagaggatcctgctggacggctcacctgaaacacctatcgactacattcaagttcagattgccaatgtcgagtccaaatttcccagtgcgatatctgagactggagaaatcactgtggagggcagagtgaaggatggtgttcctcatc

SEQ ID NO: 18730 - DNA, 429 bp, Zea mays
  Clone ID: LIB189-005-Q1-E1-E1
ctgcttgtaccggcccagaattcccgagtcgacccaggcgtccgcccacgcgaccgcccacgcgtccgcgctcctctccgtcgccggtggagctcatggcatcctccatggccgccgccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgctggagatttgttgcgggcgggaatcgctgctgggt

SEQ ID NO: 18731 - DNA, 359 bp, Zea mays
  Clone ID: LIB189-005-Q1-E1-E10
gtagccgagcagaagtagcgcgtcaggcaatggctccggcaccggtggccgctcccgtggcttcggtctcccgcgcggcagctgcgctcgcccgcgccggcgccgtccgctccgccagggtagcctccctgcaccctttccagtcttccaccaaaatcgtgctgctgccaccacggaccgccctgctcagatccgccaggcagatgcggcgcttggcggcacggagcagcacctcggagagcagcacggatgacgcccaatccctgaaacaagacaaggcgccgttcgggtacacgaggaaagacgtgctgctgatcggcctcggcgtcaccgccttcggcgtcgggctcaaatacggg

SEQ ID NO: 18732 - DNA, 410 bp, Zea mays
  Clone ID: LIB189-005-Q1-E1-E12
attcacgggccgacccacgcgtccacttacgatccggtgtacggcgcgcggccaataaggaggtggatcgagaagagggtggtgacgcagctgtcgaagatgctgatccaggaggagatcgacgagaactgcacggtctacatcgacgccgcgcccggtaaggacgaactggtctacagggtggaccggagcggcggtctggtgaacgctgagacggggatgaagtcggacatcctgatccaggtccccaccagctccaccaggagcgacgctgcgcaggccgtcaagaagatgaggatcatggaggaggacgaggacggcatggacgaggagtaaaaggcgggccggaggacgcggagctgcgcccaggccgcaggtctggcgccggcatcatcgagtgtcctttgaat

SEQ ID NO: 18733 - DNA, 400 bp, Zea mays
  Clone ID: LIB189-005-Q1-E1-E5
ttcccggttcgacacacgcgtccacctggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcgggccggggctggtggtgccagggatctactactcggacgacaagatgctgcagtgccgggtgttcgcctacgc

SEQ ID NO: 18734 - DNA, 386 bp, Zea mays
  Clone ID: LIB189-005-Q1-E1-E7
taccggtctagcattcccgggccgacccacgcgtccacggacgcgtgggcggacgcgtgggctccaccccgaccgacctatcctaatcggcgatggcgacggtggcgatggacatctcgaagcccacgccggtggcgtccggcgacgaggccgcggcggcggccaaggggaggagcggcggagggggcgaggggctgcggcagtactacctgcagcacatccacgacctgcagctccagatccggcagaagacccacaacctcaaccgtctcgaggcccagcgcaatgacctcaactcccgagttagaatgctcagggaagagttgcagttgcttcaagagcctggctcatatgttggtgaggttgtgaaggtcatggggaaatcg

SEQ ID NO: 18735 - DNA, 411 bp, Zea mays
  Clone ID: LIB189-005-Q1-E1-E9
accgacgcgtcaagtttaccattcttgattcacagtttgtcagcgatgtaacaaaatacatcagtggttgcatggcttctctatctgctatgattcagcttgaacttcctcatatcaacatcctttcaaagatggatctggtctccaacaaaaaagatgtagaagagtacctggacccgaatgcacaggttcttctttcacagctgaatcggcagatggcacctcggtttggcaagttgaacaagtgtttagctgaactggttgatgattacagcatggttaatttcattccacttgatttgagaaaggaaagcagcatacaatatgtgctatcttctatcgacacatgtatccagtatggggaagatgcagacgtgaaggtcagggactttcaagaagacgaagactaac

SEQ ID NO: 18736 - DNA, 397 bp, Zea mays
  Clone ID: LIB189-005-Q1-E1-F10
attccagggccgaccgacccgtccggttcaatctgaagggcaaatggcacttggacgtagcatttgggtgcctgctattcccactagttaatctactctcacacataaacatcagcctagttccagcgtcaccaggtccagctgtcggggtttccagcgtagaacagtccatcgtggcccgggatccagtggcaatggctttgtatgctgtggtagtcacggtatgcgcgcctatatgggaagaaatcgtgttccgaggattccttctcccgtctctaacacggtacatgccactcccatggtcgatcctagcgagcgccgctgcgttcgcgctcgctcacttcaacgcacagagggtgatgccgctagtgtttcttggagtggtgatgggaggagt

SEQ ID NO: 18737 - DNA, 400 bp, Zea mays
  Clone ID: LIB189-005-Q1-E1-F11
attccagggccgacccacgcgtccaagaccagttacggaccctgtggccaacctgtttgataggctgttgtgtgcaaggtccaggactttggaagtcgccctcccgatatcagatcctaccaaggcttcaagaagaagggagcgcggcgagagggttcttgaggaaaggttggctgccgacaatgctggtgacacagaggcctcgcctcgtggccatggcaccgcggaagactgagaactttcttgtgaccatcagctcctcttttaggagccatggctttgctccctccagcgtttatagctctgcacttttgtcttctggagatggagttattcagttcacagcgaacgaataatacgatgttcttagtttcttttttttttcccgcttctttgtctg

SEQ ID NO: 18738 - DNA, 460 bp, Zea mays
  Clone ID: LIB189-005-Q1-E1-F2
attcccgagtcgacccacgcctccaagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaacacactaaggtcaattgaactcggcttcttatttgcaacaacaacaactac

SEQ ID NO: 18739 - DNA, 456 bp, Zea mays
  Clone ID: LIB189-005-Q1-E1-F4
attcccgagccgacccacgcctccagcatcatcacgttcacgttcagggaggccgtggccgacgtggagtacaaagggttccttatccccaaggggtggaaggtgatgcctctcttcaggaacatccaccacagccctgactacttccaggatccacacaagttcgacccttctagattccaggtggcgccgcgtccgagcacgttcctgccgtttgggcacggcgtgcacgcgtgccccgggaacgagctggccaagctcgagatgctcgtcctcatccaccacctggtcaccggctacaggtgcgtccatctcctctcagatcctctccatatattccccgcttgtcctatagcttgtggaccaggatgacacatggctggctgctgccgctctccatggggctccggctctctctctccgtgaatgctccaaatctcctcctgtctgtatgta

SEQ ID NO: 18740 - DNA, 461 bp, Zea mays
  Clone ID: LIB189-005-Q1-E1-F6
accggtctagcattcccgggtcgacacacgcgtcaacccacgcgtccgcccacgcgtccgcagcagcttctgcttgctctggggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgaaggggtgctggacaacctgggtcctcctgaccaacaacaacgggctgtcaagcaagggcgccaacga

SEQ ID NO: 18741 - DNA, 462 bp, Zea mays
  Clone ID: LIB189-005-Q1-E1-F8
cggtctagcattcccgggccgacacacgcgtccacccacgcgtccgccccgcttctcggaagctcatcagccatggacgacgccgcgggagaggaagaagcttcgatgttcgagaccagccatgtccttggcgccctgctggcctcctcgccgctgctggcgtccgcctgggaccgctgtacgaccgccacagccgcggcgcccgggttcgtgcacggagaggacggcggcaaggtgtacgtggggttctccggggtgcaggccgcgctgtctgcggcaggcgcggcggtggccggtggtggcgccgacgtcttcgcgccggtggggctcggcggggacgcggcggggcggatgttcgcgccgctgctcgcggccgagcccgactcgtccgctgctggggagccggttgccgttcagggccctggccctgcattgcttcttgaaactctgcggtaaccctga

SEQ ID NO: 18742 - DNA, 413 bp, Zea mays
  Clone ID: LIB189-005-Q1-E1-F9
accgacgcgtccacggacgcatgggcggacgcgtggggaagaccggcaacaagcagcatttctgaaagcatgagggctccaaacatatttcggctccaaatcaaaaggtttctcagccacaaaatgaattaggtcttcagatattaagatatcaatgaataattttgaatcagacttcactattgttccgatgggtctcactgctgtaccttttaactgaaatcttctgctgtttctcagacatgatatggcagcatgaggagttgttttatcagttagcatatatgcatgtggttcaaaaattgaaatatgtccttttgttctcaggatgaacacttttactgattgtttaagttggaactattagtagccaaaaaaaaaaaaaaaaaaaaaaaaaaaaaaaaccccaaaaa

SEQ ID NO: 18743 - DNA, 393 bp, Zea mays
  Clone ID: LIB189-005-Q1-E1-G1
attccctagtcgacccaggcgtccgcggacgcgagggcggacgcgtgggcgctgatcgtgtacctggtgctccgccccacgcacccgcgcttctacctgcaggacgcggcgctgcggcagctggacctgagcaacggctcggccccgctgctgtccacggcggcgcaggtcaccgtggcgtcccgcaaccccaacggccgcgtcggcgtctactacgaccgcctcgacgtctacgccacgtacaagtaccagcaggtgacgctggcgtccaggctgcccgcggtgtaccagggccacggcgacgtcgacgtctggtcgcccgtgctggccggccccgccgtccccttcgcgcccttcctcgccgacgcgctcgccaaggacctcgccgcgggg

SEQ ID NO: 18744 - DNA, 421 bp, Zea mays
  Clone ID: LIB189-005-Q1-E1-G12
attccagggtcgaccgacccgtccacccacgcgtccgggaggttggcaggttacagcaggacagaatggtcattgggtcagccaggtctttcaggatttcagccacctcactgccagttctaagtgtgtatggacaacgaagggagaacaactctgacgatgacagtgcatcatcctaggacagcaaggctgagggacaaatcaccaagtcacaaaactgaattttggatggagcacagcacatcagctatgccatttttagctgctgaagcggatgtcgcattggcatttgccccgaggcacatgtttaaggttgggaggacgaaggtcgggagggggtggtatacttttggatcctgtggaaattctttttgtacaaaaggaaaataatcgtaacaggttctctctcttgttgggtgac

SEQ ID NO: 18745 - DNA, 411 bp, Zea mays
  Clone ID: LIB189-005-Q1-E1-G2
attcccgagccgacccacgcgtcaaatcagatcactttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttg

SEQ ID NO: 18746 - DNA, 338 bp, Zea mays
  Clone ID: LIB189-005-Q1-E1-G4
gatccaggcctccagatccttgcagacttggcttttgtcttttcttttctttttcttaccttgccgtaccctagctatagaggaattgtgtattgtctgggggcatatagtttgagattttgttttgtgccacacctgtgttactagtataagctttggtacaaaggaataccgaggcctaagctcacatctactacatgaatggtgtaatattgttgaagatagaaagcatctaatgttcggtggttttggctatggtttcggttattacgacacaagattattgtgacaaaaagtgtgttttgagagataatagagctcatatctagtacattttg

SEQ ID NO: 18747 - DNA, 464 bp, Zea mays
  Clone ID: LIB189-005-Q1-E1-G5
taccggtctagaattcccgggccgacccacgcgtccaagttgaatcatttgaggaagtaactaggttaggagctgaagcacctgttgaagcaaacatgcctctaccttccgatgttgcggtgataatgtacacaagtggtagcaccggattgcccaagggagttatgatgacccaccgcaacgtcctggctacactctcagcagtcatgaccattgtgcctgcacttggcagtaaagatatatacttggcctaccttccacttgcacacattcttgagttggcagcagaggcactaatggctgctgttggggcctcaataggatatggatcacctttgaccctgattgatacatccaataaaataaaaaagggaactctaggtgatgcttctgcactaaagccaacattgatgactggcgtacctgctaaaacttgttcgtatccgtgatggtgtcaggaaaaa

SEQ ID NO: 18748 - DNA, 461 bp, Zea mays
  Clone ID: LIB189-005-Q1-E1-G8
ggtctagcattcccgggccgacccacgcgtccacggacgcgtggggtatctccctccttttctcttgcactttagggtggaatatatacccttcccagccatttgtctggtgcagcaagggatttgattccaagaatgctagttgtcgatcctatgaagcggatcaccattcgtgaaattcgcgaacatgattggttcaaaattcttctcccgcgctatttgactgtgcctcctccagatagtgcgcaacaagtcaaaaaggttgatgaggaaactctccgtgaggttttaggtatgggatatgacaagaacctgttggtggaatcaatccaaaaaaggctgcaaaatgaggcaactgttgcatattacttactcttggacaataggctccgtacaaccagtggctatcttggagctgaatgtcaagaaactatggcacataggactcctcattctcaaac

SEQ ID NO: 18749 - DNA, 425 bp, Zea mays
  Clone ID: LIB189-005-Q1-E1-H10
attccagggccgacccgacgcgtccacccacgcatccggagcgcggcagcgaggcaggtcacgttctccaagcgccgccgcggcctcttcaagaaggcccaggagctctccgtgctgtgcgatgccgacgtcgcgctcatcgtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcagttggagaagaacctggaatctggtctgcatagggtgcttcaaacaaa

SEQ ID NO: 18750 - DNA, 424 bp, Zea mays
  Clone ID: LIB189-005-Q1-E1-H11
gaccgacgcgtccaaacacacctcacgtccaactcacacaacaaattgtcacgactcctcatccagctggaagaattcatcaccgcggctcatttgctcgaacaacccacaatcacacgggggtccgcagtcaagaccgatcagttaaggccacacactgaagtggatccattaacatccaccgcttatttacaccattagcattgtccaccagtcgccgatatctctcatattatccatgctgccatcttgacaccggatgagttgttgtcattctacgcgcacactgcgcccaacgcaggtatccgcatacaactgcaacaattgcctaaattcaggaaccgtacattcgaattttcatcaacattctcactgtataccatcaatgtgagttgcttcatttaaaatgcctaataattaaaat

SEQ ID NO: 18751 - DNA, 421 bp, Zea mays
  Clone ID: LIB189-005-Q1-E1-H12
ggtcgaccgacgcgtccacggacgcatgggtccgactatggaggttgaccctaggcgtttggttagaaaaactcacaaaggagagttccaagttgaagttgaagagccagatggtttctcagtggaggttgaacttgggagtaatgttactaacattccatcaaaagctgttgaagatcagacaaagtctaatggaacagatggtaaagtagatgttgaagaaaaggacaaagcatctgatagcgcttcacacaatgaggatggcagaacaggcaacaatggtataccaggtgatgtagaatgtatcgataatgagaaagctgatctcatgcaggaacttatcttggatgatgtgaaggacactgtaaatctcccaccaattccttcgttagatgaattcatgcagggcttagattctgag

SEQ ID NO: 18752 - DNA, 462 bp, Zea mays
  Clone ID: LIB189-005-Q1-E1-H2
attcgcgcgtcgacccacgcctccaggcggcgccacgctcccaatgtgccgctacggcccgtactggcgcaacctccgccgcgtcgccacggtgcagctcctgtccgcgcaccgcgtcagctgcatgctccccgtcatatccgccgaggtgcgcgcaatggcgcggaggatgtaccaatccgccgccgccgcccccgccggcgccgcgagggtcgagctgaagcggaggctgttcgagctctcccacagcgccctgatggagaccatcgcgcgaaccaagacgtcccgtgccgtggcggacgacgacacggacatgtctccggaggcccaggaattcatgaaggcgctggacgtgttccttccgcttctcagcggggccaacgcgtgggactacctgccggtgctacggtgggtcgacgtgttcggcgtgaggaacaagatcctgcgcgcggtgagcgcaag

SEQ ID NO: 18753 - DNA, 452 bp, Zea mays
  Clone ID: LIB189-005-Q1-E1-H4
gacccacgcctccgctctacaggcagaaagaacagttcagtgacggcgttggctacaactggatcgatggcctcaaatccttcactgaacagcaggtgacggatgagatgatgaacaacgccgcccagatgttcccctacaacacgcccgtcaacaaggaggcctactactaccggatgatattcgagaggctcttccctcaggactcggcgagggagacggtgccgtggggcccgagcatcgcctgcagcacgcccgcggccatcgagtgggtggagcagtggaaggcctccaacgacccctccggccgcttcatctcctcccacgactccgccgccaccgaccacaccggcggtaagccggcggtggccaacggcggcggccacggcgccgcgaacggcaacgtcaacggcaaagacgtcgcagtcgcgatcgcggtctgacgagagtac

SEQ ID NO: 18754 - DNA, 310 bp, Zea mays
  Clone ID: LIB189-005-Q1-E1-H5
ccggtctagcattcccgggccgacccacgcgtccagatcatttttgttctttaggtgcaggtttagtgggacatagtcgtcggtatcttacagcatgtgtttctgatggagtgatatggttagtaagcagtggtgaaggatacaggcatacgggcactggggcatataccatacttttggactagaccggctagagactgattttggagtccgttatgtttccgttttccgttctcttggttttctctgtcgtcaatgtattataatcatgatgatgaatggagaaatgagatggattttttttgagttc

SEQ ID NO: 18755 - DNA, 182 bp, Zea mays
  Clone ID: LIB189-005-Q1-E1-H6
ttcccggtctgaaacacgcgtccgaaaaaaaaaaaaaaaaaaaaaaaaaaaaaaaaaaaaaaaaaaaaaaaagggaggacgcacaaaaggataaaaagcttacataaacatgaaagcaaaagtcaatagctcttcaaaaatgtcaccaaaaattcaattcaatggggggtccttttaaaaag

SEQ ID NO: 18756 - DNA, 420 bp, Zea mays
  Clone ID: LIB189-005-Q1-E1-H7
taccggtctagcattcccgggccgacccacgcgtcaaatgacatctggtgcacataccaacttcattttgccttggacactattataatggaggatgactgtacaatctttactggatccacagtatcgtgaacagctgcaatcatctacttttgttattttgactggtatttctagtttatgtatcatcacatgtcagcattgccatgtagccacattggaatttattcatatatgaaaatttgaacataggctttcatcacttcttatatcacatggttgattcacttgtaccatcttttgctggttattttctgtactaaccccaatcaagtttacaaggtactgttctttctcataattttttaatttaaatgcagcctgttcaagaagaaacaaagaaggatattacagataaag

SEQ ID NO: 18757 - DNA, 389 bp, Zea mays
  Clone ID: LIB189-006-Q1-E1-A11
aagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactct

SEQ ID NO: 18758 - DNA, 458 bp, Zea mays
  Clone ID: LIB189-006-Q1-E1-A4
aattccagggccgaccgacccgtccaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactaccctctgtcggccaccatcatgtccgagtacgccaacaagaggacccgcggcgccttcatcgccgccgtcttcgccatgcagggcttcggcatcctcgccggcggcatcgtcacgctcgtcatctccgccgcct

SEQ ID NO: 18759 - DNA, 447 bp, Zea mays
  Clone ID: LIB189-006-Q1-E1-A7
tcccgggccgacccacgcgtcagggtggagcagcatctgctccagctccggcgccaccccgaccggcaccgtcctccggcgctcgccgccgccgtcgctgtccaggaaccgcacggtccgcttcggctggccccgcgtggacggcgtctcgctgaggcaggagcgcgagcaggaggacgccgacggcggcgcgcgcctgccgctgaagatggcgttgaggaaccccgccagccgcgcgccggggccgggggacgccggcttgcggcggaggtccctcagcctggcgcggatgctgacgccggccttcttcttctccggcgcgagtgcgggcgcggccacggccaccgcggtggtggcgaggctcgtgcgtatgggccgcaggcgccggtgctgcgacgactccgcctccgacgacgagaacccgccgtagctggagcactgatcggg

SEQ ID NO: 18760 - DNA, 391 bp, Zea mays
  Clone ID: LIB189-006-Q1-E1-A9
ccgggccgacccacgcgtcaacccacgcgtccgcggacgcgtgggtgtgcagaaaagcaagattttcttcattgcctggtccccatcgacatcccgcatacgtgctaagatgctgtactccacgtcgaaggaccgcatcaagtacgagcttgacgggttccactacgaaatccaggcgaccgacccatcggaggtggacatcgaggttctccgggagcgggctcactgaagctggttctccttttgaagggacctgtggagggccgtgaaccttcagccagatgcaaattcaattatcaacgatgaagctcccgccgtggtgtttgttaataagttcctgtaagcatatcatttagtcgctatgcatgacactagctgaagcgctatctaa

SEQ ID NO: 18761 - DNA, 440 bp, Zea mays
  Clone ID: LIB189-006-Q1-E1-B1
tcgacccgcccgtccggaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgccaagaaagagaacatcaagattcacgggttctaaaggacctgtaaatgct

SEQ ID NO: 18762 - DNA, 432 bp, Zea mays
  Clone ID: LIB189-006-Q1-E1-B12
ggtccagaattcccgggccgacccacgcgtccacggacgcgtgggcgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaaaggcgagatgctgttcggctaccagccgtgcgccaccaaggacccccgcgtgttcggcgacacggccggggacttcgtgcccgaccgcttcctctgcgaggagggcagcaagctgctgcagtacgtgtactggtccaacggccgcgagaccgacaaccccagcgtcgacaacaagcagtgccccgggaagaacttcgtggtgctcgtcggcaggctcctcct

SEQ ID NO: 18763 - DNA, 443 bp, Zea mays
  Clone ID: LIB189-006-Q1-E1-B4
gaccgacgcgtcaagaggggcagggcagagcaggagagagaaattcgatagggttcccatgccccttccccaccggccaccacttgccaagcgaaagcgggagtgaaggaggggagagtcccatttccccaagccctacacgagagaaagagagagaggggggagcagaggagcacgctacgagagagggaggtcgagggagacagcagaggctgcagcagaggccagaagcattagaagcggcagttgtaaccaagtggcatcagaagatagagccagccatccgtctatccatctatctagctctacaggtataaatcctcgcgcatcggtagggggcgaggggaggaccgggaaccggaggggatttctcgggggtggagtggcggccaggacctctgattgggctccagtgcgcgatctttgaacgcagatttggtgcc

SEQ ID NO: 18764 - DNA, 442 bp, Zea mays
  Clone ID: LIB189-006-Q1-E1-B5
cccgggccgacccacgcgtcagaacctccgtcatcagcgacctctccccaacggcgccgacgatggcgcaacagcagacgcagctaaccactggctcgggcatcctggatgccgtcccgctcttcgtcgtcatcctcctcgcggcccacgtcctggccctcgtgttctggatgtacaagctggcttccgagaagcaaccaccccggaggaagacacagtgacggcgccgatctacgccatcggcgatccttcgctagcctctttatcggttccattttcatgtgaaccagtaccctccagaacattcaggccgtcaattattcagagatatccatatagtctttcaatttgttttatttatacttattgcattttgggtattgtttgataacaacttagcgatattctatgaatcactatccgtttgggtgataaataaatg

SEQ ID NO: 18765 - DNA, 403 bp, Zea mays
  Clone ID: LIB189-006-Q1-E1-C1
attccagggtcgaccgacgcgtccggtacaacaattctgctggccaacagagcacaattgctggaattgaggctcagatgggtgtcttgcactatattttgggcaattatggcgagtcatatgattccttcaagagtgcgattgcaaagctccgcacctgtggtgagaaaaagtctgccttcttcggaattgccctgaaccagatgggattggcatgcgttcaaagatattcgataaatgaagcagcagaattgtttgaggaagctagaacagttctggaacaagaatacgggccttatcatccagatactttaggagtgtacagtaatcttgctggaacttatgatgcaatgggcagacttgatgaggccatcgagatcttggaatatgttgttggaatgcg

SEQ ID NO: 18766 - DNA, 413 bp, Zea mays
  Clone ID: LIB189-006-Q1-E1-C10
ccgggccgacccacgcgtcagcggacgcgtgggcgctgttaccggaggccttcaagggaatcaaacagatcggcgtaatcggctggggctcgcagggtcctgcgcaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgatatctgattctgctcaggctgataactacgagaaaattttctcgcacatgaaaccaaacagtattcttggtttgtcacatggatttctccttggacatttgcaatctctgggttttgatttcccctaa

SEQ ID NO: 18767 - DNA, 363 bp, Zea mays
  Clone ID: LIB189-006-Q1-E1-C11
gacccacgcgtccacccacgcgtccgcccacgcgtccgcccacgcgtccgcccacgcgtccgcggacgcgtgggcggacgcgtggggtttgtcatacttgccagtgatggattgtggaaggtaatgaacaagcattaagcagtggatctcgtgaactcaaccaaggatccacaggcaacaccgaagcgattgaccactgaaacgttggcaaggaatagcaaggatgatatctcttgcattgtcatccgtttccgctgctgagttaccctctctcaacggcactgaaacccactcatcgcctcatgatttagattgagacaatttgtctttgcccaattttccgatagaatatgctgtacctat

SEQ ID NO: 18768 - DNA, 421 bp, Zea mays
  Clone ID: LIB189-006-Q1-E1-C12
ggtctagaattcccgggccgacccacgcgtcagcaaatcgacctgatgttctggacccggcgctcctgcgtcctggacgtttagataggaagattgaaattccgctacccaacgagcaatcaagaatggaagttctaaaaatccatgcagccggtatcgccaagcatggggagattgattatgaagcagtcgtgaaactagctgaaggtttcaatggggctgatcttcggaacgtgtgcaccgaagctggcatggctgcaattcgtgcagagagagattacgtagtccacgaagacttcatgaaggctgtgaggaaactaaatgatgcaaaaaagctggaatcgagtgcgcattacagtgcagattttggcaaagagtaatgatgctgatgccgatgcaacggacaaatgcatttggcatg

SEQ ID NO: 18769 - DNA, 455 bp, Zea mays
  Clone ID: LIB189-006-Q1-E1-C3
attccagggccgaccgacccgtccacggacgcatgggctggtaataaccataaggctaggaaaaagtcaaggggtggtgtagaagagtcacagcagcagaaagttcaaaaaaataaaagcaaggtgtcttcacggggccgcaaaagaaccttgaaggatgaaacggcagagaagcctgagaagaagctaacccacaggatacgtcagaggataacaaaagaggttaaggctttactggaaacacctcgtgagcagataaaacccatgaagctaagcgcatcacatctcaggttgttacaagaagctagagagcgtgttaatccaaaagggattccatccgggccatcttctaatacaagaaactttcaactagatgatatggatgatttgggctacagagatgaggaagataggtttcttgacaacgatacaacagaggagcatgtacaaaatgc

SEQ ID NO: 18770 - DNA, 447 bp, Zea mays
  Clone ID: LIB189-006-Q1-E1-C5
ggtctagacttcccgggccgacccacgcgtcaggtcagcaattgatgatgagatggtcacaggctggcggaacccaagtatttctttcaatggccgtctctattcagctgactgccgggatggctgcaagcttagagtccatgatgagaacacaggaacatggacaaggttcatggacagcaagcaccacttgggcagctcacgtgcctttgaagctgcagctttggtgtcactaaatgggaaactctgtgtcatcaggaacaacatgagcataactcttgttgatgtctccaacccaacaatgagtgttgagacagatagtgcgcgcatgtgggaaactgttgttcggaagggccagcacaggtcgtttgtggcgaacttatggtcgagcattgcaggacggaacttaaagagtcacattatccattgccatgtgctgcaagtttg

SEQ ID NO: 18771 - DNA, 355 bp, Zea mays
  Clone ID: LIB189-006-Q1-E1-C7
cccacgcgtccgcccacgcgtccgaagaaactactagctggtaccctaataataattctgctggctgcggcgatccccaaataaaagaggcagggtgcgatgcatcgcggtcttctcgactctcgagtggtgtttgcgttagacagccagccactgtgtggctagtgttccaacatttgtcagcctgcttgcgcgaggaagtgggggtgactgactcaagagaagggcctggtcataggctgctgcattatgaatttctgatcatgtcttatgtctgtactctgaatcaactatgtatgagatctcatctcctttctcctactgaatgaatgaatcattattggcttgcttaaaa

SEQ ID NO: 18772 - DNA, 399 bp, Zea mays
  Clone ID: LIB189-006-Q1-E1-C8
acccacgcgtccgccctcttttagattgcttattagttgtaattcaataataaagttttttggatgatgtatgtggccaaccagaaataagaagttacatttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccccaaaaggattcaacccaaatttcccgttaaaggaaatttaaacccctccaaaagggcccccaaaattcaattcaagggcctttttttaaaaaagtcttaacgggaaaaaccctggctttaccaaactaaaaccccttggaaaaaaaccccct

SEQ ID NO: 18773 - DNA, 408 bp, Zea mays
  Clone ID: LIB189-006-Q1-E1-C9
tcccgggccgacccacgcgtcaggcggtacgacacagtgaacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacaactccgtgccgtggacgacgcaccacacgcacacggacaactccagcagcggctccgagcgcgtgctctcgccgtcgccggacctgcccgaccgcgaccacgccgagagccagcccgccgccgccggg

SEQ ID NO: 18774 - DNA, 439 bp, Zea mays
  Clone ID: LIB189-006-Q1-E1-D1
attccagggtcgaccgacccgtccaccaagatacaggacaaggagggcatccctccggaccagcagcggctcatttttgccggcaagcagctcgaggacgggcgcacgctggccgactacaacattcagaaggagagcaccctccacttggtgctgcgtctcagaggtggcatgcagatcttcgtgaagacacttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagaccatca

SEQ ID NO: 18775 - DNA, 382 bp, Zea mays
  Clone ID: LIB189-006-Q1-E1-D10
ccgggccgacccacgcgtcagcggacgcgtgggtgcaaatctttctctgaattgtgggtctccgagaatggcggcgctcgctccatccaagattctgggcacccagctcaacttcgcgggctcctcccgctacgccaccgcagcgcccaccgcgggggctcagaatattgtctcccttttcagcaagaagcctgcccagaagcccaagcccgctgcggtatcgtcgtcttctccagacatcagctacgagctcgccaagtggtatggtcctgacatgaggatctatctgccggatgggctgtcggaccagtcggacgttcccgattacctcatcggagaggtccctgaagactatggctacgaaccttttggcctgggcaat

SEQ ID NO: 18776 - DNA, 391 bp, Zea mays
  Clone ID: LIB189-006-Q1-E1-D11
ggtctaggactcccgggccgacccacgcgtccacccacgcgtccgcggacgcgtgggggctgagggagctcaacaccctcaagggtcacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctataccaccagatactgccatatgatggtatggttgggtacccgtctttctagggagtttcttttctctctctcttttttcctattgttatgtttttcaatagtggagtgtgcgcgtgttgtaatcgtttttacctgcgttttt

SEQ ID NO: 18777 - DNA, 416 bp, Zea mays
  Clone ID: LIB189-006-Q1-E1-E11
ggtctaggactcccgggccgacccacgcgtccacagcaatccacacaagcacttcgacgtcgcacgggcgctgcacacagacacaccaagcgtcggcaccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgtt

SEQ ID NO: 18778 - DNA, 449 bp, Zea mays
  Clone ID: LIB189-006-Q1-E1-E6
tcccgggccgacccacgcgtcagcctccctctcctctgccgccgtcaccgccccttccttcgccgcacccgcaccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaagtgccgagcggcgtcgacgccaccaagatctcgcaggaggagtacctcaacgcgccaggccagacctactccgtcaccctcaccgtgccgggaaactacggcttctactgcgagccgcatc

SEQ ID NO: 18779 - DNA, 458 bp, Zea mays
  Clone ID: LIB189-006-Q1-E1-E8
ggtctagacctcccgggccgacccacgcgtcagggcgcacagcacacgaacacacaccgcgcccagctccgaggtgatcttccggcggccggcgagatgagccgtggcacaggcgcgggctatgaccgccacatcaccatcttctcccccgagggacgcctgtaccaagtcgagtacgcgttcaaggcggtgaagtcggcgggtgtcacgtcgatcggcgtccgcggcgcggactccgtctgcgttgttacgcagaagaaagtcccggataagttgctggatcagacgagcgtgacacacctgttcccgatcaccaagtacgtcggattgcttgccactggccttacagctgatgctaggtcattggtttcccaagcaaggaatgaagcagctgagtttcgtttcaaatggggctacgagatgccagttgatgtgttaacaaaatggactgctgacaa

SEQ ID NO: 18780 - DNA, 403 bp, Zea mays
  Clone ID: LIB189-006-Q1-E1-F1
attccagggtcgaccgacgcgtccggtccatgcagtaccctttctggtgttgcttctgataatcttatggcacattcagatattttcaagatagaggttgggcgcaatgaagctgagaagaattctatctcgaaaagggcttccgtgtttctgaaatggatctggagagagtgctacagtcaccaatctacatacgccatgagatatggaaagaagcggtgtcctgagttgattcactcttgtgattattgctaccagatatacttagctgaagaaaggcactgttcttgccacaaaacattcaaacacattcacaatttcttggaacactcatcacaatgtgaagaaaaacaaagaacagatcccaattggaagatgcaaactgtggacctttctgtacccg

SEQ ID NO: 18781 - DNA, 420 bp, Zea mays
  Clone ID: LIB189-006-Q1-E1-F11
ggtcaaggactcccgggccgacccacgcgtccacccacgcgtccgcccacgcgtccgcggacgcgtgggctggtgtgttaaggcagcctatgcggtcaaggggactgcttgctcggccttatattcattcaatgcttgctatagcagcagtctgcgtatgcgtctgtgtattcatgcgagctttgctgcggatcaattctggaaaatccttcaagtgggagaggctggattacggtacagtataattgtggggacacacctgagccttgtggtattattaagttaacaggcagttgttatggagctattttggagccttgaagggtatggagattgtttcatgcttcctcgagactcgcccatccgtatggctgagtggaataatgtaatatttttgctggacaattcctttacttcctg

SEQ ID NO: 18782 - DNA, 413 bp, Zea mays
  Clone ID: LIB189-006-Q1-E1-F12
cggtctagacctcccgggccgacccacgcgtcagcggacgcgtgggcgtgtccccaaaatccgatatgctgggatgcttcagtatgatggtgagttgaagcttccaagccgttaccttgtttccccaccagagatagatagaacatctggggagtacttggtgaagaatggcatccgcacctttgcttgcagtgagacagttaaatttggccatgtcacatttttctggaacggtaaccgttcgggatactttgatgcaactaaggaggagtatgtagaagtacctagtgacagtggtattacattcaatgttgcacccaatatgaaggcgcttgaaattgctgagaaagccagggatgctctcctaagtggaaagtttgaccaggtacgtgtcaacctgccaaatggtgaca

SEQ ID NO: 18783 - DNA, 453 bp, Zea mays
  unsure at all n locations
  Clone ID: LIB189-006-Q1-E1-F2
attcaagggtcgaccgacgcgtccacccacgcatccggcttggcaagattggtcgaccggtcgagtcatggcttccatctctggcatgctccctaccgagatcacagccctccgtgatggtagactcatccatcttcctgccaaggacctggtgaacggagatatcgtccaagtgtcattaggtaacaagcttcccgccgatcttcgctttgtcgacgtgtcctcggacctgagactggaccgctctgtgttgaccggagagtcagagcctatccagggaaccatcgagcagacggacagcaacttcctcgagagcaagaacgtcggacttcagggtacactttgtgtcggcgggtccggtacaggtgttgtcattcaaacgggcgatctcaccgtttttggtcgaatcgctaagctctcatcctccggtgctccatcgnatgacactctgca

SEQ ID NO: 18784 - DNA, 409 bp, Zea mays
  Clone ID: LIB189-006-Q1-E1-F3
aattccagggtcgaccgacccgtccaaatggccactctaccttagcaccaaaaacacaatcctgaaaaaatatgatggcaggtttaaggacattttccaggaggtctatgaagctgactggaagtccaaatttgaggctgctggaatatggtatgagcatcgtcttattgatgacatggttgcgtacgcgcttaagagcgaaggaggctatgtgtgggcttgcaagaactacgatggagatgtgcagagtgatttcttagctcaaggttttggatctttgggtttgatgacatcagtgttggtgtgccctgatggaaaaaccatcgaagctgaagctgcccatggcacggttacccgtcatttccgtgtccaccagaaaggaggcgaaaccagcacgaacaacattgct

SEQ ID NO: 18785 - DNA, 445 bp, Zea mays
  Clone ID: LIB189-006-Q1-E1-F6
ggtctagaattcccgggccgacccacgcgtcagcttggaagagaaagtgcctggccgagtttggtattgtcacacagtgtctagctccattaagagtcaatgatccgtacctgcttaatttgctgatgaagatcaatgcaaagcttggtggtctgaactcgttgctgcaagttgaagcatcttcgtcaataccacatgtgtcgcaagtacccaccatcatcttaggtatggatgtttcacatggtcatccaggacaagatagaccttcggttgcagcggtggttagttctcgtcaatggcctcttatctctagatatagagcatcagtgcacacccaatctgccagactagaaatgatgtcctcgttgtttaagccgcggggtactgatgatgatggcctcatccgggaatcactgatcgacttctacactagctctggaaagcg

SEQ ID NO: 18786 - DNA, 456 bp, Zea mays
  Clone ID: LIB189-006-Q1-E1-F8
ggtctagaattcccgggccgacccacgcgtcagctcacgtgatcagggatccttggttgcttttgaagatggaagcactacttcttatgcacttcttaatgcacaagaaagaggtatgttgtttgtccaaccagggcaggatgtttacaaaggtcaaattgttggtatccatcagagacctggtgatttagcaattaatgtgtgcaagaaaaaggctgctacaaatgttcgttccaacaaagaaactacagtggttcttgatgaacctttaagctacagtttggatgactgcatagagtttatccaagaagatgagatagtggaggttactcctgcaagcatccgtatgtgcaagaacccaaaagtttcgaagaaaaagtaacataatcgcatccatttgtcgtcaatgcatcttctacacatagaagctgcatgctccgttgccaggtctcgtat

SEQ ID NO: 18787 - DNA, 451 bp, Zea mays
  Clone ID: LIB189-006-Q1-E1-F9
ggtctaggactcccgggccgacccacgcgtccacccacgcgtccgcccacgcgtccgcctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcgtgagctagtagctagtgccatgcgtcgtctctgtcgttcggttttgcttcgggtcaccgtgtaccctttgcctgcctgggttcctcct

SEQ ID NO: 18788 - DNA, 377 bp, Zea mays
  Clone ID: LIB189-006-Q1-E1-G10
cgcgtcaacagagctcgtcgccaccggccaccgccaccctcgatcacgccgtccgtcgaggtaaggtcagcatggtgagggtcactgtgctcaacgatgcgctcaagtccatgtacaacgctgagaagatcgggaagaggcaggtcatgatcaggccgtcgtccaacgtcatcatcaagttcctgacggtcaagcagcgccacggctacattggagagttcgagtacgttgatgaccaccgatcgggcaagatcgtggtcgaactcaacgggaggctgaacaagtgcggcgtcatcagccctcgctttgatatcagcgtgaaagacattgagggatggactgcaacgctgctcccgtcgaggcaattcggatacatc

SEQ ID NO: 18789 - DNA, 445 bp, Zea mays
  Clone ID: LIB189-006-Q1-E1-G2
attccagggccgaccgacgcgtccacccacgcatccgcggacgcgtgggctctgatccgggagaattctggcttcaccttcctacaccaaagaaaggactaacagggtggtccttccagctgcatgtccctttttgcacattctttttctccgctcaacctgtgcataactcatgtacatacgctcgtgccttttgctctctggtcagggcttgttagatgtattgtctttggtttgattggttggttggttctttcctcgatcctctcccaattttgttgggcgaagggtccacaatctatgtttctccatactgtagtgaaaaggggccggatgcccctggtctccccgagctgcttttggaaaagctcgtggtcattaagcagttaagcttgtggaaaaggttctccacatctaccgagtcgttcgttgtgtcgccttcttc

SEQ ID NO: 18790 - DNA, 73 bp, Zea mays
  Clone ID: LIB189-006-Q1-E1-G4
ccaaaaggatccaaccttacttacccttgcatgcaacgtcaaaccccttcaaaagtgtcaccaaaattcaatt

SEQ ID NO: 18791 - DNA, 446 bp, Zea mays
  Clone ID: LIB189-006-Q1-E1-G8
ccgggccgacccacgcgtcagcccgcagttcttcctcgtgggggcgggcgaggcgttcacgtacatcggccagctcgacttcttcctgcgcgagtgccccaaggggatgaagaccatgagcacggggctgttcctcagcaccctgtcgctgggattcttcgtcagctccgcgctcgtcgccgccgtgcacagggtcacgggcgaccgccacccctggatcgccaacgacctcaacaagggccgcctcgacaacttctactggctgctcgccgccgtctgcctcgccaacctactagtctacctcgtcgccgcccgctggtacaagtacaaggcgggccgccccggcgccgacggcagcgtcaacggcgtcgagatggccgacgagcccacgctccactgatccatccatgttcgatcgatcgacgaggcacgcgacggacgaccct

SEQ ID NO: 18792 - DNA, 367 bp, Zea mays
  Clone ID: LIB189-006-Q1-E1-H1
gttcagaacatcacaatccaagtactattttcttggtaatagttcaatacacacccaattttttttaattatcatggtatcaacttctccagttaaaaaaatgaatagcttagaagtcactcactgtcactggtagtggtagtacaacacaaccggcacagatggggaaagaaaactgtagtatcatcgacgagtttcaatggaaatccctcttaggcctgtagacgctggttcggttttcgaagtacctttcaaccctaaagacctctcaaaagactaaaggcatatgatgagctaaacgcctcttcagatcacagcagctggcaaaggcgacatgatgtgccctccctactgctgacatcaccaa

SEQ ID NO: 18793 - DNA, 73 bp, Zea mays; identical to SEQ ID NO: 18790
  Clone ID: LIB189-006-Q1-E1-H11

SEQ ID NO: 18794 - DNA, 272 bp, Zea mays
  Clone ID: LIB189-006-Q1-E1-H5
ctttgcgtgtcctttttgttcagaacatccaccctccaagtacgagtttcttggtaagggcttcaatacacggccacttttttttaattagcagggcaccagcttcgcgagttaaaaaaatgagcagcctacaagtcacgcacgtgtcactggtactggtagtagaacacacccggcacagatggggaaataaacctgtggcagcaaccacgagtttcactggaaatctctcctaggcctgctgagcctggctcggttttcgaactaccttt

SEQ ID NO: 18795 - DNA, 450 bp, Zea mays
  unsure at all n locations
  Clone ID: LIB189-006-Q1-E1-H6
ggtctagaattcccgggccgacccacgcgtcaaagagaattaaaaatcctaactacaagggtaaatggaagaccccatggatcgataatccaggtaagcaaataaaaatcctaactgctgattttgaatgaaaccacacttaagctttaaagatcaggcgctgtcaactgtattatttttgcagagtttgaggatgatccagatctttatgtgctgaagcctttgaagtatattggaattgaagtttggcaggtaaaagctggttcagttttcgacaacattctgatttgtgatgaccctgagtatgcaagaaaggttgttgaggaaacttggggtgcaaatanggaggctgaaaaggaagcttttgaagaagctgaaaaggagaagaaagctanggaagatanggaaggtcaaaaggcanaggacgatggtggccggcatcgaatacac

SEQ ID NO: 18796 - DNA, 444 bp, Zea mays
  Clone ID: LIB189-007-Q1-E1-A10
ggtaccggtccagaattcccgggccgacccacgcgtccacccacgcgtccgacgacaccgcgttcagccgctctagaaccctagctccccgccccgcgagatggccactgccgacggcgagccccagcccgtggccaccgaccccgcccaggtccaggctccggctccggcaccggcaccctacccctccccggccaagcgcaagcccgaggcggatgcggaagccgacgccaacctcgcgccccctaaagccgcgcgtcccgacgtcgacgaggaggccgccgctatggccgaggctgccaaggccagtgctcgcgcggctgacaagggtaagggcaagatggtagtcgaggaggaggaggaggaggaggaagacgacagcgaggagagcagcgacgacgacgagggcggcggccgcggcagcagcagcgatgacgacgagct

SEQ ID NO: 18797 - DNA, 393 bp, Zea mays
  Clone ID: LIB189-007-Q1-E1-A12
taattgtttaccatggaccagattttgttaggaagatctgatgttgcaggttggggtgcattcattaagaatcctgtaaataaaaatgattatcttggagaatatactggtgaattgatctctcacaaggaagcagacaaacgcggcaaaatttatgaccgggcaaactcatcttttctgttcgatttaaatgaccagtatgtgttggatgcttatcgcaagggggacaaattgaagttcgcaaatcactcatctaaccccaactgctatgcaaaggtgatgctggtggctggcgaccatcgggttggtatatatgcgaaggagcatattgaggctagcgaggaactcttttatgattatcgttatggacctgaccaggctccagcttgggct

SEQ ID NO: 18798 - DNA, 408 bp, Zea mays
  unsure at all n locations
  Clone ID: LIB189-007-Q1-E1-A2
gggccgagccacgcgtccacgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacttcgacctcaacctgcctccgcccgccgagatggtcatgtagcgttggagatagtaattctagcaaaaagggattgtgtagtaaataggaagggcaatcggtttgtgtagtactactggccagtttgcctgtgcactagccactagccaatttgcgacttcgcaatgcaaagcangaaatgaatcgacgggcacatattttttccccccctgcnnaaaattgcagtggcatggc

SEQ ID NO: 18799 - DNA, 353 bp, Zea mays
  Clone ID: LIB189-007-Q1-E1-A4
gggccgagccacgcgtccacccaaacgtccgcccacgcgtccgaagcaacatagaaagtggaatcagtagcaacaataaaagaacaaatggcgaccaaagatattttccctcctttaggcccttgctcttttcaaatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaa

SEQ ID NO: 18800 - DNA, 279 bp, Zea mays
  Clone ID: LIB189-007-Q1-E1-A6
ggtaacggtcaggaattcccgggccgacccacgcgtcagcggacgcgtgggcggacgcgtggggccgaaggaagttttgaacttctgatgttgtatatgaatcaatttgccttaaatcgtcgaggggaaaagaggagaaaaatggtaaaatatggacagaattcgacggtatatcatgttatattgtacctacctacatgacatgggacatgaaatagggctcagacatgcgctatggaacttggaatacacacaaacctaacacgccacatgctgcac

SEQ ID NO: 18801 - DNA, 412 bp, Zea mays
  Clone ID: LIB189-007-Q1-E1-A7
gggccgacccacagcgtcaggaagaacccagccaaatcctcagtcctcaggctgctcgcagctcgtgccgtccactctcccccgaggcattctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatgggctcaagctggacaccaccgctctgggcctacgcaccgtgagggtgagcaggtcggcggacatccgcgcgcagacggcagcggtgtcctccccgtcagtgacccctgcgtcgccgtctggcaagaagaccctccgcattggcacggcggtcatcatcggcgcgtcgtccggcctcggcctcgccacggcg
